United States Patent 8,067,671 (METHODS FOR GENETIC CONTROL OF PLANT PEST INFESTATION AND COMPOSITIONS THEREOF) - sequence listing, part 25

SEQ ID NO: 33992 - DNA, 902 bp, Heterodera glycines
ctgattcattttaaacggatttgaatagaaaacaccgacgttatttgacgcaattctgacccgaatggggacaactgagtcccggattttgccataaaatgtttaaaactcaaaggaatttttctaaaattttcagaccaatggataaccatttactgttagaactatcgaatgaatgatactgaattggttcgacacttatgaaaggattgctatatcccaaaactgtccctattttgatgaattatacccaattccgttggttggggacattattagttttgattttgacaccactgacttcctgcggagccgcttcaaatatggtaaagtccttgttcaactgctcgtccagctcgagaatggccgccacattgccgcatcggtagcaataattgggcgccgaccacacagtgagcacctgggaaaaatgggcaacaaattttggaggagcaaaggcaaatcccaacccaaccatgcctggtaggcatttgagtacataccactcctcccattttgccatatttttgaaaattgaccccaaatggcaaaaaatagtaatttttttttgtcgaaacggctacaaattcgtcgaaatacgggatttctaaaaaaacacttctaaaaaccgatttttaaatttcaggcccccccccccccccacaaaaccaagggtctggctgcgcccttgccccctgctatccattttttttttcaaatctacgggtaagatttctgaggacacaatacacccattcatgccaccgaaaattcaattttttttttcattaggttccattaaaacgaatcaaaagcataatgcctttgattcctgttttgttttccccccatttttggcattaattaccgtctcattgaaatgccatttgtatccctccatc

SEQ ID NO: 33993 - DNA, 1812 bp, Heterodera glycines
  misc_feature (13)..(13): n is a, c, g, or t
  misc_feature (45)..(45): n is a, c, g, or t
  misc_feature (113)..(113): n is a, c, g, or t
agggagcagtacnactcagttggtgcagacatatgccaatgagancagcgaaggcggagctgacagcaagaaaaagaagaagaagaacaataaaaagaagaaaaacgccccgnttgtctgtgcacaatgaggaagtagcaaaaaaagaatcgaaaaaaggtgtggaagacgagcgggaggatgacagttttggagagaagaacaaggtccgccttgaagggaaggggcgatttgatctgtgccgcatttaattttagcgtcggacttcgctcaccgattcgccattaactgagctcagtccgtcgtcaacgactagcaacggcgactcagcggacgacactgaggtggccaaaagcagcagcaaacaaggttttttatgctttcatatttaattattcatttccattgcttggccactttttctgcaggttcgtcgtgtgggactgtgtccaattcgtcctcctccaacttttacgttgtcaatgcaccgccttcctcttcatattcttcagttggagaacgacaacagcaccagaacatgcactttttgagcgaaattacagaagaggaaaacatcaacgaagtggagcgcgagtacgccttcgaaattgtaatcaaccagaaaaaggtgcagtttctgaaagaatgtgaaagggtggggggagtgtttttatttatttgattaatttccctctgatatttggcggttctttccgaattcgtttggccaaaaatcgttttagcatttgattaagcagctgaagtacaacaaatggacggagcagttgtgccagtcgatcttcggtggggatttccgcactttttaccgtcgcttcaaaatggtgatgatttgcctacgcaaacggaaatctgcccattacgagcgacttaccgatgcacaattggcgtcacacgtggctgaggtgaaacgaaattattcagtttttctagttgaaaataaatattttttagatgatcattgaaaagtttcacaacaaggagaatcagaccaccattttgatggttttgctcagcaatagtgagcgggaagtgaagtgtgcggaccgcgaccacggctattgcaggttcaaatagttttccaaattttttatgaagtatagtggctctatgggaattgaatgttgtgggttatggaatttgatacgaaagaaattgccttttgttagcatgacgacggatgcagttttttcgcggggggggggtgagtagcaccctcatgagtgacgatttttgcaattccaaggcacggcctgtgaaattggatccgttttttaaaatcagaatccagacctcttattgttaacgcatcaaaatattctttaggattgcgcatatgttgttgaagctattgactcgcagtcaattggaaaaattgctcgaagtgaccgcggcgaagagcggaaaaaacgcattgcatttggccactgccactggacagtcatgtcaactgcaagtactgctcgctcttacaggtcattttaccaacttggaatttaacgcattgtcttccaacgaccgtctttttaattgaatgattaggtatcgaatgtttcatccttttagaaattgatgcaaatcatttcgatttctcgatgcgtgcagcgcttcattacgcaattgagcgcaataatttggatatggtattattttattctcacttataatatattttttgcttttttatgccttctttttcaggttcgtcgcactttcacctgtccattttattcggtttggtggccgctgcagaaggtttcaacagaataatgcacaaattacggtgatttttgt

SEQ ID NO: 33994 - DNA, 910 bp, Heterodera glycines
  misc_feature (670)..(670): n is a, c, g, or t
  misc_feature (877)..(877): n is a, c, g, or t
gcctggcaggtcacatggtgtatattaaagtgaatatcaatgatttcgcattgaatataaatagaaattattattttgaagatcggaattggacataataacttaaataaagaatccgcatccctttattctcgctgtgggtgtcggcacaatctttgttttaattgcgcttaatcgcctgaatagcgtcccttgaggcgtaaaatgacggacaattggtagagaatggccgacttgtacttggcatgcacatgattcgcctcaattccctgcaaaatgccgagtgcgttctgcaggaacacaagagctttgttcaggtccctgaaatttcgtcatttttaatgccgtcaaaggaattgacagcttagggtagaatttccgaataatttagctgactatgtttagccacctgatcagtgtgaacaggttgcccagcccgaggctcagctgcagctccagcagtttgtccgcgttcgcattcgctattttcatggccttttcaaactgttgtaagctggactggaagttggacagccccatgtgggcgagtgcatcgcactgaaatggcaactcaaaatgatcaattaactagcttaaacaaaactcattaaattaaatggacaaaggggagaaagcaattgaccatttttctcgagcactggggcctatntcaattcagatcatatcccagatatgactctatgaatcatatcgccgatatgatatcgtatcgtatgatgccgtcgtcacatatgacaccccttcccttgtgcaaatcatatgcgggtgtatccgctccgaagcggagacatgccaaatcgtatataggataaaaattcataaaaaattttaaacttaatcgaaaattttcatttanaaaagattttatagaatgaacctctattattga

SEQ ID NO: 33995 - DNA, 1794 bp, Heterodera glycines
agtacagaagcctacaaccgaataaaccggctgtatggtgccggtattggaatcgccttgtccgggaaactccgaatcggacacgctcatttgcccgcgcttgccatcccacttgccggtgagtataatctcctcgccgcggccgcaagcggtccttcaagaagtggcggttgaaccataccgccgtcagcaggaactcatcgaccatcaccttgcaggatagtcgggacttgccgctgtagcgctgcagcaccggctctccgatgatataccccttcaccgtgacgcggtcgccgtccttcacactagctaaatcacgcaccgtgtaatcctcataccggaacggcacatattccagtaaatccataaccgtaaaaatgcccatggagttgagctcaagtgccttctgagcgcccactccatggacttcgcgtacttcgaattgattcaaatccatctcttacaccgtactcacgaacgctgcgatggtgcctggtccagcgtgtgcgccaataacaggtcccagtgtaatgtagtccacatgctctacaacaaattgctgcatgatggccgcgcgcagctgttccgcaccttccaaattgtttgcatgagcaatatgtaaactgcggattgtcttaccgggtacatccgccgccaacagctctaagattcgcgcaaccgcttttttgtgaccgcgaaccttatcaatcgcagcaacttcgcccgttcgatccagcgaaagaatgggctttatgtttagcaaagaaccgaaaagagcggatgctttgccgattcttccacctttttgcagaaattctagcgtatctacgaggaagtatatgtaaaagttctctctcatcgttcgtacaagttccaaatctcatcaacactttgccccgccttagctgctcgggcagcagctacagcaagagcgccaatcccataggaagccgagcaggaatcaaacacatgaaccttgcctgacgagtcctccagcatcgtggaagccagcagcgctgactggtatgttccgctcagcacggatgccaagtgaatcgagatcacctccgtatcgggctctcccagcagtccctgatacaagtccagaaactccgcaggagacggctgcgacgttcggggaaagtgcggtgacgaggtcagcttcggataaaattcctcagactgcagcgtcaccgtatctaaatattcttcatctccaaaatgaatcttgagaggcaccatctcgatgttaagttcttgtctgagtgccaaaggtatgtcggccgtgctgtccgttacgatacgaatgtttgtcaacagggctcactccatttcacgaatttactccacggctaatggtattcttttactcaacggaaaacaggtacgcatacaaaggctgtccgccaggatgaagctcaatttcaatgtcgggataagccgcctgaatgaacgcctccagctcctccgtctctgcatcaacggcatcttctccggtgaggatagtgacaatttcgctgctttcttcaatcatttcctccagcagcttcttgcaagcatccagaagactcggctgtgaagatacaatgcgcccatcttgaatgccaataaaatggccctgtttgatgtcaataccgtccgtgttcgtatcgcgcacgagcgtaagtaacttggcccgatttgacacgtcgaagtgattcactcatggcttccgtatttgttttggcatccgctttctcttggaacgcctagaatggctgcaagaccctgcggaatcgattggacgggacacaa

SEQ ID NO: 33996 - DNA, 846 bp, Heterodera glycines
tatgtgtttttacccgctggaagtttcagtaacgagtgcatttgtacaattcagtacctgttctgtattcggattcatagagaagtctatttgatatgttccattttgaagtctctatcgtttcggcgctgtcatttccggcgccgtcgtttcggcgccagggtcgtttcggcgccaaaccaaaaaaaatcatgaatcagagggaagggcacctatacaccttcgataaatcaactgcggataggatggtatgacaaaggtttggagatgcgaattcaatgacatttgcaaagtaagaaattgacgaccatttcattttttacgattcctcagcagtgaactgtgcagaaagtcaagacagcgacaaaacgttcactcaccacatatgaactgccagcacagtgacccgttgacgaagatcagttcctattgagtgactcctgtatttctttcgtgcccggaacgaaaatccacagcggtaacttcttgaagaaaaaaaaatttgcattcagcttcttttcaaggattctagtgggcgcgaatctttcggtcggtgggctgatcgaactaaagaatgtctcggagacggctgttatgggcaaacaaaaatgaaaatgatcgaaattacaacataaaggaaaatcaccatataaacaaatgtgcaaccctggcttacaaaatgccaatttcaaataaatttgaactaaataatcttttatctgcattcgcacttttttatttgcctatttttgttttttcttggtatccagcgattgcattttcttatctttttgtgtattttactgtcggattgtccactgtcggattgtcctcactctcggattg

SEQ ID NO: 33997 - DNA, 942 bp, Heterodera glycines
  misc_feature (847)..(847): n is a, c, g, or t
  misc_feature (883)..(883): n is a, c, g, or t
agcatgcaaagcattggtgcgcttgagttacggtccgtaaaacgcgaattagaaccacaagttcgcgccagcacaccaaaaccccacagccgagctgagcaagtaacgtaagaacacgtacaagtacatgatcccacgaagcaacgcacaagcagtgcattttatggtaacgaccctgaaccaggcgtgccaatggatgtaactccaatggcgcaatgtgcattcgaatgttttgtgttcaaggtttctgcagttcgcactaattatcgcagttggctgcgttcttcatcgatccacgagccgagtgatccaccgataagactagaattcattcttcaacagaagtgtaaaaaaaaataatgaaaaaaaaagaaaaagctggcggtgcccgagctgacactcattgagtcttaagccacgtgctaggccaagcacgggcactaccgcgtcgtctcatcacggccacggacgtagcagcaagcacaaacacaccgctagttacggcacgtaagaccgggaacgaaaccaccatccccagtcagtgtgttatgtgcctgccacaacaaccgctcaacgacgcacagacgccagcacagccgttaggtcgccccacgagcgtgcatcccacattggcgcagcgaaccagccaagcgaggcggcccgccaccgacacattgccacgcagcagccatacacaggctttcacacgtgcagcactgagcggtataccacagctccaacgtatggaagcaccccaaaagcatggctcgtgaggcagctgccccgtaatgttgggcagcgtccacaagtcatctcgaacgacctgtgcccatcagcggacgggggncatttggtggtgccaacgctagcccacaggacagcnaggtaggtgggtgataggaatcacttgggtaatgatccagcagcaggttcacctacagc

SEQ ID NO: 33998 - DNA, 1026 bp, Heterodera glycines
aatgatgttttattgctttaattacccacggttgagttgcctctacatgttttttctaattatcttgtataaaaagcttatcaaatgaaagattaacataaaattatgaataaaaacatctttaatattaattaaataaataaacttttctttataaaaagaattgaaaaaaagtaaaagtgggttcttcaataatattgttgatttttatcatttccataaaaagcgacattattatgatacgttaccaggatcgataatataaaattcatttttaaaataaaattaaacagaataatgaagaatttaaaaaattgagcgtatctctatgataaaatattataaaaataatgaaaaaatgaaataattgaaaaataaaatcaatttatatgaaaaccatttggatttttcatttaaatcctttactctttttcattgaaaaggttaattaatgattgaaaaatgtctaatcaaatggataaaaaaataataaaaatcaaccttaacaaaatcaattgaagaagattaatttaaatatgttcataggtcaataaaatatgtaataaccagacaaataaaaatggtgaacccgtcgagactgataagaaacggttcattcctgttcatgaaactcagcaacacaacaacaacaaccaacaaccgcagcatgaccgtttctgcatggacattcaaaatttaaaaatgcccaactcacaaaaacgggaccggttgagagcaactatgaaatttacttggatattgttattaaattaaaataattgattaattgaattcttcaaatttcagtgaaattttattatggcattaatttataactaagaaacataaataaattggtaaaaggtaataaacagaaaatagcggtcgggatatgttaaaaatgttacaataattaaaaaaaacaataaatttaaatttcaaagcgggcaaaatattaaaatattaaaaatataaaatcagaatatatgagaaatatttcaagactgacttttttaaatagttttt

SEQ ID NO: 33999 - DNA, 997 bp, Heterodera glycines
  misc_feature (846)..(846): n is a, c, g, or t
atagccaccgcggctcatcgttaaactttagcgtgcttctttattctctggagctgcgatcagcccacaaaagaggtcactaaatttgtattccaaatataattatcaccctctctcatagccaccgcggcacatcgttaagctttagcgtgcttcttaaattctctggagctgcgatcagcccacaaaagaggtcactaaatttgtcttccaaatataattatcaccctctctcatagccaccgcggctcatcgttaaactttagcgtgcttcttaaattctctggagctgcgatcagcccacaaaagaggtcactaaatttgtattccaaatatcattatcaccctctctcatagccaccgcggcacatcgttaagctttagcgtgcttcttaaattctctggagctgcgatcagcccgcaaaagaggtcactaaatttgtcttccaaatataattatcaccctctctcatagccaccgcggctcatcgttaaactttagcgtgcttcttaaattctctggagctgcgatcagcccacaaaagaggtcactaaatttgtattccaaatataattatcaccctctctcatagccaccgcggcacatcgttaagctttagcgtgcttcttaaattctctggagctgcgatcagcccacaaaagaggtcactaaatttgtcttccaaatataattatcaccctctctcatagccaccgcggctcatcgttaaactttagcgtgcttcttaaattctctggagctgcgatcagcccacaaaagaggtcactagatttgtattccaaatatcattatcaccctctctcatagccaccgcggcacatcgntaagctttagcgtgcttcttaattctctggagctgcgatcagcccacaaaagaggtcactagatttgtattccaatatcattatcaccctctctcatagccaccagcgcacatcgttaagctttagcgtgcttcttaaattctctggagct

SEQ ID NO: 34000 - DNA, 722 bp, Heterodera glycines
ttcgatctctgttcatgcattgcatttcaaaattgaaattttctttttaagtttggcgttttgttttttgatttgttgcttcgagggtaaagcctcaacttcgtcaaaatcggaaaaaatattgaataaataaaaacaaaataaattaaaaaaaaaacttttttttttcttaattttaaacgaatgttgaattaggttgttcgacacatgttgggttttagaattacattttaattaaattttaattcaactgagatttccttattccaattaatttctcatattcattcatccattcaaattggaatgccctcgaacatggacagaagcaaagaaacggaagaaaagaaaagcaccgtttcccaattccttcattgtccgacaccgtttccaccaaattttgtcggcggcaaattaaaaagaaaaagatagcggatggatgcgcgcgcgaaatttttccgcactcctcctcgcacctaatgggcattttgagtggcggcacaaatctgattaactggcgctttccaccgatgcgctttgaccaccaacaacaataaacaggtggttgttgtggcgcgcagcggcgatgccgcgactgcgcccctcaaattattgagagtgccggacgagatgggtcgcgtacgtccggaaacagtgcccaacaattgttgtcttcatcattcatgcagcacatccaagcggcgaagcgggggggggggggg

SEQ ID NO: 34001 - DNA, 1218 bp, Heterodera glycines
  misc_feature (1091)..(1091): n is a, c, g, or t
  misc_feature (1139)..(1139): n is a, c, g, or t
  misc_feature (1145)..(1145): n is a, c, g, or t
  misc_feature (1183)..(1184): n is a, c, g, or t
  misc_feature (1192)..(1192): n is a, c, g, or t
tcaaaatgatgcctcagaatccccaatcacacagggattgtgaggtcttaacgatgtcaaaagtaaaatctgatcacgtaatcctgatcagcgtcataaaatacccctaaagacatgtttttggaatattttcggtaaaaaaatttttccacccaaacatcctggtcacccccctatggtcccgaaacctaaaatcacttttatttttataacaattcgcaaaaaagagataaaaattggccttggacgggcgcttcgctcccgtttttaaaatttttttggtcttggacgggcgcttcgcgcccgtttttaaaagaagtacttttacttattaaagataaagttcgaaatttataatatagaatatttattgaaattgaaaggaattaatttctcgaaaattcaaattaaataaaacagttattcatcagaaaataatttaaaatttattaataaaaccatttaaataaaaaaattaaataatttaaaataccccttgagatttttcaaatattcgcccaaattcccaagggccaaaaaatttgaaaatattttcgaatttttaaaaaattctaaaatcgtacattcgatcgattattcgtcgtattttaatttttcggacaaattctaaataaaaaaacaaataaattctttagtttaaaaataaataaaaaatcaattttaaataaaacaattattcgaacaaaaaataaaatttaaaaaatttatttattatcggattaaaaaactatttatattaattaaaaacattcgtaaaataagccaaaaataaaaagaaaaataatgtacaccgcccggatccgaacttggtcccccccctcaaaatgatgccccagaatccccaatcacacagggaaaaatttatataatagagcaaaaaattgcggatttttgttgtattttacttttcccaaataatttttcagaaggcagttacgaatttttttctgaaaaatcgaaaatttccagaaattctggaataacttttgtatttttagagataaaaattccatataaatcccataaaattctccttatttttctatatttttaaagctttattgcattanaattgtctaacatttaagtgagttgcgaattttcaaatcttagcccanaatctncagggccaaaaaattgaaaaatatttttgaatttttannaaattccnatattatgaaacttaaataaacatca

SEQ ID NO: 34002 - DNA, 941 bp, Heterodera glycines
cataacttggtacacaggagagaagtgtacaacgaaaatgatgttcacaatgccgatcatcaatacaatgaggaaaattaggcctgttttaagcccaaacagagcatgaaaggtggacgcccagtcgaaactgaagtcagcccagcctgaattgctggcctcttcgaggctttcggagactcgggctccgaattctgactgttgtcggagtgggatgtaatggagttgtcccatcaaggagaatttggttcttccagccaagcacatgacatggcacgacgtgcttatttcggctttttggaatgggagcacgacagtgtggtccgttatattcggaccacatttgctcgtgaaatgcgaaccgtcttcgcattgaatgtcggccaatgtttggccgatgtcggtgtggcacgagtaagagaactgagctcccgtcgcacatttgtagcagccagagatgtgctttggtgtgattgtacacaaactctggtgcatttccaaggacatttgaaggctgtccatttgaatgttcatttggaccggactatatccggttatggcgaatattcgccttccgatattccgcagttcgtaatggcggaatgagagcggaagtctccgctgagggtcttccattagaccctcgagattggcgacgcgacaatggcacgagacagtcccgtctgtgtggtcgggaagacagcccgtgcatgcgtcaattcccagagtacaattgaaagcttgggcggctttcaagtctgtacaatggaaagagtccgtgattttctcacggacaagggcgacatttcgcccttcaatcaggaagtcagcgttcaataggggggccggtgcttggctgacccctattgttgaaaccgctgatgttgtgccatttgagcacacgacctggaagaagcacaggttcaactgtggcacttctt

SEQ ID NO: 34003 - DNA, 1310 bp, Heterodera glycines
  misc_feature (1299)..(1299): n is a, c, g, or t
ggcccccgtttttgggcccccgcgtttgggcccccgtttttgggccccgcgtttgggcccccgtttttgggccccgcgtttgggcccccgtttttgggccccagggtcgtttgggccccaacccaaaaatagaaaaatgtgcttttttaaaaattaagattctaaaaactaagcctgaaggatccctcgccacttggcataagttaggtttaaatatttcatcaaatgatttttgatggatttttttcttttctgatccgatcggatcaattagaatgatcaaaaataaaattaaactcagtaatgggcacaatttcatttcttttgcattaagctttaatttgaaaaaaaagaaaagatgacgcttctttataaagttgttttaaaaaacaattttcttagttatagaaaaatattaaatggaaatgattggcaaaaaatgattggcattttatttaaaattgaaatattatacataattgtaaaaaaaaaaaaaattgatgacgagaatagcaatttgtcaattgcctgtgattggctatttgaaaaccaggacattttgtgtaaagctcaggacattaacggaacaaatagaaaaaataagcattttgaaggttttttgaaactagtacaaatatagaaaaataaaggacatttctgatcattataataaatgaaaaaaatttataaaatgaacttcatggcctatgaatttgaaattttctataacattttttgtttttaaaattcagtcaaaaactcaatttttgcgtttttcctccaaaatactcgacgacaacagaggcaaaaaaagctaatggaaaattttttgaaaaatcttttaaactaatttaatgtcatacgatttggagtacagcagaagggattcgcagttctcgaatcggatcggggaaaaccctaaatacacaaaaacacaataaaatttgaattattaaagcagcaatttgtttaaattatgaattgattgatgaaaatcggggatgacaccaacaaatcaactgacaattattagcataactgtgatcaaatggaacaaaattcggcaaataaccaaacgaatacccaaagtgccggctgagaaggaagcgacggcccaaccttttggaacattttattgaatgcctaattaggcattagagtatggcgcaattttcaacgttttataattcacactaaaaagttggttaattttacatgaaattcttcttcaattccttcttcgaatgttttcccaattgcataaattcattttttattttaaaatatttttcaataatnttctctttttt

SEQ ID NO: 34004 - DNA, 601 bp, Heterodera glycines
aaaaaaacaaaaaaaaaatcaaaaaaaaaaaaaaaaaaaaaaaaaaaaaaaaaaaaaaaaaaaaataaaaaaaaaaaaaaaaaaacaaaaaaacccaccgcgggggggggggggggggggggcggggggagagaaaaataaattatattttcctcctccccccccccccccccccctcccctttctttcaaaaaaaaagagaagggagggggggtctcccctttccctcttttaataaaaaaaatatatttttttcccccccccaaacaaaaaaaaaaaaaaaaaaaaaaaaaaaaaaaaaaaaaaggggggggataaaaaaacaaacaaaaaaaaaataaaaattttttctcctccccccccaacacaaaaaactatacacccaaaaaagagaaaaagggggccccctttttttttttttttcttcccaccaaacaaaaaaaaaaattttaaaaaaaaaaaaaaaaaaaaaaacaaaaaaaaaaaaaaaaaaccccccccaaaaatttttgttttttttttttaaaaaaagaaattttttttaaaaaaaaaaaaaaaaaaaaaaaaaaaaaaaaattttttttttttaaaaaaaaaaaaa

SEQ ID NO: 34005 - DNA, 122 bp, Heterodera glycines
tttttttttttttttttttttttttttttttttttttttttttttttttttttttttttttttttttttttttttttttttttctttttttttttttttttttttttttttttttctttttt

SEQ ID NO: 34006 - DNA, 1176 bp, Heterodera glycines
  misc_feature (513)..(513): n is a, c, g, or t
gggggggggggggggggggggggggggggggagggggggggggggggggggaggggggggggaggttgttcatatagattatatatatttttagagatcatttgtacggacacccatcttttggctaaaggggaaggaagggggggtgggggaggggggggggtgtggagcacaaaaacatttaggtgggggattttgtggcccgggggtccccatagtgggccggccgggcgctccaaaaaacccttttttttttttaaaaagtatatcccaaaattctccaaaattgtggtcatttttaaggccaaaattgtggtagcaaaagggctcataacatacaaaaatttttcccgggcgggcgcctattggccaccgcccggcttcccggtgttcgcgaaattttttttgagaaacccgcaccggcaaaaaaaagagattttaaaaagcaaaaaaaaaaaaggccgtcgatttacatggccgggaccatttcgcaaaaaattcggttgccccccncctcttttcatgtatgatttggtcattgatcacaaaactgacaccaaaatctgaccaattctgaattcttaatctaaaaatgcacaaaaaattgaaatttttgaattttcgacttttggttaaagtttccaggattcagaattggtcttaattgttgtcagattcgtgagcgagaagttgagaaaaactgtgagtaaatcagcccacctctgcgtttatttgcttctgtcgactttcccgtgccaacactttcgactttcgtacgcccattttcgctccttcgccgtccgccgcctcatttttctctttggcgctgtcctttttggcacttttcgccggagttgtgccatccaaaaatgctgccaaatctgaaaatatgaaaggaggaggtgaaaaaagcccgagtttttgtgtatgtttagcttttgtttatttgtaaagccttaattacatccaaaaaatgggattaaacccagaaaattacagttttcaaaaagaaaaaggggtgttgccttttccactcttaaattagcaaccaaaaaattgccaaaaacaaacactccttttgaggaaccgtgggagggggagtccggcagtgccgttagcgccccgctgggaaattttttttgagttttttatggatttgttaggaaaactagccaa

SEQ ID NO: 34007 - DNA, 312 bp, Heterodera glycines
  misc_feature (169)..(169): n is a, c, g, or t
ttttttttctatttttttcttttttttttcttttttatttttttttcttttttttttttttttttttttttttttctttcttgataaaatatgcccccccctcccccctttgttttttttttttttttttttcttttttttgtcttcttttttctttttctatttttgngttattaaaaaaaaaaaaaaaaaaaaaaaaactaaaaaaaaaaaaacattgcttgtttaaaaaaatatctctaggttttttttttttttttctttttttttttttttttttttttttttttttttttgttctctttttttttt

SEQ ID NO: 34008 - DNA, 831 bp, Heterodera glycines
  misc_feature (8)..(8): n is a, c, g, or t
ctgctttnggtggaagatgaatttactggactgatcggagtagggatgggccaacgaatgtctcccaaagtgtcggcgattggcctttccctgcggcggcgatattccctcagcaccgaattggccattgaagctaatgattgttttaatttggctgctttatgactgatcgaattggcttatgacttttgtttctgttctccgctgtccaaatttcacttttagtcatccgtccctttcgttctcccttcactcataaattaatctttctttgaaatcgtcttatgaattctttttcattgctcacacattttccgttttgagccctccaaggaacttaggataacttacgcgaaaataggatatccatgaaagatttcaatttttattcgagttagcttcatggatcagaaattagttcgagatacatgcccgtactcacgattaccgacctttgcaaccccggataaaaaattatcatgcttctttatattaaaaaaattgtgcagaacaaaaggggccccccttttgaaaaactctacaaaaactgacactgtccatctagtgccaaattatccttccaaattgaatatactatttttcataacctattgtcaataaatcaaaggatcacttcttttatttacataaatctttgagaaggcataccgattcttcattaactacatcctaacgaacaccctaaaataatgcaagaagattctcgaacatcacttaacaatgcctttttgcttgcttactatactcgcatgaaaatggagcgtcatataactataatattatacatatacagtaactcatgcctaattt

SEQ ID NO: 34009 - DNA, 703 bp, Heterodera glycines
ttcttggcttatgtcgtaataaaacacacttcaaaaccatctttaacacttaaatttgtaagcattagcacaactaaaaatatgctgtgatgagactggggttttcttctgtttttttctctcgtttttctcggctattccctcgcattctcattcctaccttttctctaccacttccttaacataccctctcttatctttgtgactgtcgtttcgatgtctctctcttttctctcctactcttaccgcctgtctctatctctctcgtccaccctcctgtctcgctctccccactcctactctctctctctctctccccctttaatctgtcccgtatttggccatcccctgaggggtcttttgcactctgtcgcccacaacggagaggaaatgtttttggatgaaatctaatttttttgcacttaaaaatgaataatttttggctttttggaatataagtgggcgaaaattttatgcaaaactattgaattgacaaatcgaaatttttaaatttacaacaaatataatggcaagttttcttgattttttttgctttgaaggacgtttttgttattccaggcagattaagagccgggcgattttacacgtagttttattcgtcatttctgttgtctgttggacagtgagattttaacagatgaatatagaccagaaaaagctagatatttttttttgtccaata

SEQ ID NO: 34010 - DNA, 1003 bp, Heterodera glycines
  misc_feature (128)..(128): n is a, c, g, or t
  misc_feature (134)..(134): n is a, c, g, or t
  misc_feature (184)..(184): n is a, c, g, or t
  misc_feature (189)..(189): n is a, c, g, or t
  misc_feature (280)..(280): n is a, c, g, or t
cgaatcaagtgtcggaaaattgtggtcagaatccttcccaccggggttgacccgtgtcttaccccatttaaaagttcccccgggaattatatggatatttatatttttttgatggaatgtgggaggtntgaaangtaggaaaaatatgtttttagattgggttgaagattataggaaggatttntatantaatatttatgatatttttgaatatttagagatttatgtgaatattttgatatttttaaatattttggaattttgggtaatattttatgtngatattttggaatttttgaaaaaaacatatattagaatggtattaagtaggtaaattagaatttttgagaaaaaaaattgaaaaatttttcaaaaatcattttttagacaaaattctcgagaataaagttaaattttattaaaaattaataaattatgtcaaaaaataagcaaaaaagagaaaatttaggttgtgttgttgattttgcgctaatttcctcttcctgcttcaaatttttattctaagcaacattttaactgaaatactttgtggaggtaaggaaattttaaaaaatgtaaataaaaaaaaccaccaccaaaatagactaaacgtctacctaaattatgaaaaatttctccaacaaaataaaaacctaaaactgaaacaaaaccatgagaaaaaaaaatgaaaaaaataaaaatattaaaaaaaggaagtagaaaatgcagaaagaaaagaaattttaaagagtttgatctgaataaaaaagagccccaaaaaaaaaatattaaattaaaacctaaaaaagggattactctcgtacagttgcttagtttaggcttaggcaggcagcctaaattttaggctaggcttacgcttgggcttgcttgggtctatgcttaggcatacgctaaattattttgtaaaatatgagttgacgtttctatgagttgccttttgtacttgtacgagttatcattagggagtcccaattatatggaa

SEQ ID NO: 34011 - DNA, 497 bp, Heterodera glycines
cgtaggaagaaagggggggggggacggattggcattcctttagagaagagataaaaaggtgtgaatgatcatccccctctggtggcggaggttcgttcacttttcgttcgctttgctttctgtcgctttttcaccaccgaatcgtccgccgttttcacttcgccacacaattcgcttcactttatcatccggactcatttcccatccattttccaaatgatgaattccattttcgggttttacgaccaacagcaattaacgcccgtcgtctatgcccaactttagccccttttcccgcccacctggcgtcaattggcaaattattctccttcccccgaaggatttatcattaattttccgtccttctgtctgtctcttgtccttccttgctcacgtatcctttatctgtccttattcgctgatccaaagcccaattagggcagcgagtgtgcttcttctttcctcagtcaacccaccgggcatcggtgtcatccccc

SEQ ID NO: 34012 - DNA, 1228 bp, Heterodera glycines
  misc_feature (22)..(22): n is a, c, g, or t
aaatcaaaatcctaataaaatntagtgaatttctccgcctcttatttgtgcaaaattttcgaaaaagtaattttctatttaaaattaaaaaattcagaagcaaattcaagaatttttttatttttaaatgcattttttaccacatgaattatgattaaatttttgcgtttcgaattcattttggaattaagaaaaataaaaattgatactcatttgatcatttttagcgcactttaagcaccgccgttaggcagcgcagttacaaaatttattccatgccacagatattatgggcaggacacgccaagtacctcaaacttgggtaattaaaccgaagaaagaagtgcagtggggaagaatgacgcccaaaatgaaggaaatattcgatgctgtgcgaactctttgtgacccctctctgactctgccaatgcagcagttgaccatttttaccactatttttctctcactcatcgtctgctcgtctctcctttattataagctattttcctaagccaacgcccttttctccctcttttctgttagtcatttctcattggtgttgacgatccaacattcagtgtacaaatttgttaaacctctcaacattttaaatcaaaatcctaataaaaatttcgttgaatttctccgcctcttatttgtgcaaaattttcgaaaaagtaattttctatttaaaattaaaaaattcagaagcaaattcaagaattttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcccaaaatgaaggaaatattcgatgctgtgcgaactctttgtgacccctctctgactctgccaatgcagcagttgaccatttttaccactatttttctctcactcatcgtctgctcgtctctcctttattataagctattttcctaagccaacgcccttttctgttagtcatctctcattggtgttgacgatccgacattcagtgtacaaatttgtttaaccctctcacatttcaatcaaatcctaataaaa

SEQ ID NO: 34013 - DNA, 1621 bp, Heterodera glycines
tttggggatgttttgacaaaagatgggtacagtccatccctgaacaatcgagaggtaatcgaagcctttcctgtgccgaaaaatgccaaagaagtgaagagatttttgggaatgatgtcatttttcagaaaattcatccctgattttgcaaaattagcctatcccttaaatcaattgacaaaacaggagaacatagagtttaaatgggcagatcaggagacagaagcttttgaaaacttgaaaaggcaattacttaaagcgccctgtcttagagcgccggactataagctgccattttatttgtttaccgacgcatccgcaactgcatatgccggagcattgatgcagtctgagaaaagtgatgaaatgcatgcggttgggttttggtcgaggacactaaccgcaactgaggcaaaactcccggcaacccacggggaattggccgcaattgtgcatgcggtgcaaaattttcggccaataatatatggctccgaaataatcattttaactgaccatcgcccactgacttttttgttttcaaagtcgagttccaacccaaaattaaaccgttggctaatggctttacaagagtttgaacccaaggttatttacttggagggaaaggcaaaccgagtggcagacgctctgtcacgtgtgccaataaagtgggaacaaatagaagcaaaaataaaagaagaaataccatatttgctcgtttcagaagaaaacgaaaatgaaataagtcgtgataaaattgagaaagagacaattgaggacccaattttgtcagaaattgttttgaaaataagagaaaattggtcagagcccgtagaggaaaagctaaaaccgttttacagaatacgagaccaattgtacttagaggggaaactcattcgaaaaaaacccctaaggcaaattgtgatccctgagaaaatgcgtgatccgatcctaaaactgattcacagggcacattttggcatcgtacgcaataaggacagggcaaaaggattggtttggtggccaggtattaatgaaagcattgaggattttgtgaaaaaatgttggacatgccagagaaatgggccaaataaaccgcgcgagaaaccggaccgcagatggcctgaagcgcggttcccgtttgagcgcgtgcattctgatttggcaggcccaatttggggcaccaatttttttattgtaattgacgcattttcgaaatttcaatttgtgtaccaaatgagttcaacccactcttcgactcttattaatgcccttcatgaattattcggcatttgtggttcgccaaaaacatttgtaaccgataatggcactcaatacgtgtcaaatgaaatggaagaattcctcaaaggcgaaggggtgcgacacttaacctcggccccctaccacccttcatcaaacggcgaagcagagcgcttcgtcagaaccttcaaagaaggagttgggaaattgctagatgagggaaagtccctcaaaattgcacaattcgtttttatgcaggaatatagggcatcgccgtgtgcagcggcagagggagagagtcatcccaaaagtttttgggagagaatacggacagtgctggacacatataatgtcaactaatgcc

SEQ ID NO: 34014 - DNA, 1261 bp, Heterodera glycines
  misc_feature (82)..(82): n is a, c, g, or t
  misc_feature (1188)..(1188): n is a, c, g, or t
cgaaagggaggacgttcacatgctcggagtgtgccaggttttattgaattgtatgtttaagcaatgtgtgtaattcagggcncaaaagtcaatgtgtttcaattgcacaaaataaagcgatttgtcggacgaagcgaagtgagttacagccgagtgaaggaagtgccgagcggactgctctcggtgaaactcgactcggtgggtgggacggtcgcgtgtccatttgcgaattgggctttttacagcgaatcagcgcgtgtcgcattagccccgatgcgactgcgctcgctgtggcctcactcgacggatttctgtcatttttcgtgatcgaagaagacactttgcaaatggccagtcgcattcagccgttgaacaacaatcacattgaggagattattttcctggacaaccttttcctcaacactcagtaagaacccatcactttggtgatttattttccgattcaaatcgaatttctaataaataaataaatttaaaagttttttatcgaaaaattctggcgcattctcttttttcattacattttatctcaccacagagaacagttttggaagtatgtgacgttggcttccgacaatggtcgacgattggccattttcgactgtgacacttgggaatgtttggccaaattgcgcttcgagtgtcccaaccaagtgggccgaatggaggtgttggtcgagccgaattcgcattttctgtttctcgtcgattacgacatgtcggtgagtgtttcgttcgaatgcgttggccgttcctccctaagtcgaaaagattaattcccagaatatgttctgcatcgagttgagcaatggtctccgttcctgttccccgctttgttttgcttcctgcactttggtcactttctcctctcaactcgtcagtgttgtgccctccaggctcactgagcacgtttcggacatcggtcggcatttcacttcgaattgcccttccatccaacgaatgttttgccctttttagtcggcgacctttcgttggaagaagacgagggaattggcgggggaaatggcgtcgcctttccccagcgcacttctgccatcgccactttggtggctctcacccataaagcgctgtccgaaataactttggaactcgaccgcttcttcaaagttaacccggcgttggcattgaccaccatcccccagttgngacggagtcgtcaccacagtcagcaaaactcggagcagcaccaaacggaggagcagccgcaaattgccctttt

SEQ ID NO: 34015 - DNA, 1013 bp, Heterodera glycines
atgagaattcatgtgaaattttctggaaataggttagttagggcctatttaaactgtaaaaaaaatattttggggcgatttgaaagagaaatagaaagaaccagtttagatgaagttttggtaagccaaaaataatccaatcatttaaaaatctataaaaaatttaaaaatgagaattcatgcgagattttctgaagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctgaataagcttaatagggcctagttaagctgtaaaaaaaatttggggcgatttgaaagagaatagaaagaaccaggttcgatgaagttttggtaaaccaaaaaaaaatccaaacatttaaaaatctattaaaaaaataaaatagtgaagttttaaaaattaataaaaatttttaaattaagagttactggcgttagcatcatagcggtgcttttccttgtctttttgatgcccttgcaaaatctggtgcgcttctgatcagtttatataaaaaaagttaagcctaaactttttggcatgtttaaaaaggaattaaaaatttttaaaatatttattcatctccctttttgataatataagagtcagagtgccttattcaacttgtaaataaattttggtgcgtttcagagcagtttctgtaaaaatacttatgaattaattttgtaaaaaaataaataaataatgaaccctcctccttaataatttttcctgcgccc

SEQ ID NO: 34016 - DNA, 860 bp, Heterodera glycines
ttgtcttttgcataattaattcataagtatttttacagacatctctctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaattttgagggggggggggggggg

SEQ ID NO: 34017 - DNA, 891 bp, Heterodera glycines
tttccattgtcaaataatcgtgggtatcttgatggtttcattgttctaccatgagtaccgccgatgggacgtcgtcgcgcgacagggcaaaaatgcaaatgattttatcggttcctttttgcttttttttacttttccgtttttcaataaaaaatatatgtatgtatatggaatggaattttagagcgaagaactttcggaggaaatgctgcaaaatatccgtgctgacgaagcgtcgaaaaaggcaaatgaaaagaaaaaggctgttacgaggaaaatctcttctcgagagcagcaagttcagcttgacctcagcctggaactgaacgaagtttattcattattttacgttagttgcaaatttgtggtattttttcaggttggcgtcgtcgtcaaacatccccacactgtcttgaggtgccaatgctttatgtccaatttgtcatgggtttttttagtgctcgaattcaactgttgggtttccacattgaacccgttttgcacggggacagaggctggcaaaattggcattaaaagtaattttcttatttgtgtgccgtggtgccattttcaatgttttgtttcagatcggtccaccagaggaggacggagcagtccaaccatcaagcagctccatcgacctccaaacagcagaaggacaaagagacgagcggagattcgaaaatggcattgccacccccaaaattggccatcattgttgaagccaccgaaacattggacattaccatcgccaaatcattcctacaacagcttacccaactctctgaagtatgtccttttttgttttcttatttcctatttttctgttttaggcctttgataatgcttcctaacaaatcagcacccagcgatgtgagttgcctggcactt

SEQ ID NO: 34018 - DNA, 1032 bp, Heterodera glycines
  misc_feature (971)..(971): n is a, c, g, or t
  misc_feature (1008)..(1008): n is a, c, g, or t
aataaaatatatttttaaatatttcgtccttctagtgcgtctagtattatttatctaattgtttctatctgtttttgtcgcctaattaaccctcaaagatacaatttaaaattttagcattattatgctatatttcaacagttcataaaatctttaaaattaaaattaaagtcacattcttaaatttaacttctcattaatttataaattttggcttcaactatatttaatccgatgatggaaatgaacctcaaattaaataatttatttaaaattaaaataagcatctctttttcaataatcaattatccgcttctgtcatctcgctgcccattttgatgaatgataaggctgcactgtaattaagacattgtttttgtccaatggaacaacaacattttgtgccctcgttgacggcaaaaggcgttttggcaaaaaagtgccaattaattggtgccgaaatttgtcgcttgtgcacaacagcagccaactggacaacaccaaagtgcaaagatcggtgacccatgggtattggatgtaaatgatggcactgtactggggataaaatggccagacgaattcgctgacggaaagctgaaattggaataagtttattttgtagttaataaaaatttaaattaaaaatatttttaaatttaaatttacatacaaaaaacaccgccaaaagggcgtggccagcaaaagtaagcagcgagtaaattaacagtttccgctcaatgacgtgacagtcgcttttcggtgccgtttataagcaattagtgtcaacaaattgactaagaaacataaaatcagaaaaatgatcgacgtcagagatttcaattgattagaataatccaaaaatgtccttgactgaaattagatgtcatattcatttttactggattaaatttttaaaaaagatatttataaaaaggacgcggatttttaagtttttacttattttttctgcngctttaactcgacgagaaatgcacgaaaaccacattnttttttttcgaaattttgcctttt

SEQ ID NO: 34019 - DNA, 904 bp, Heterodera glycines
ggagcaagaacgacaacgcaccctggtcttctcccccaaggcggaaagcaatgccattcgcccatcggaacgtcttcaggaagacagggaagccgccacaaaaatcctggaccatcttgaagttgaggcccaaccaaccgccgtctttcgactcggacgttacgacccgcagcgaacaacaccacgcccgctcaaggtggtcatgccaacaaccacacaccaacacatggcactcggaggatggaagcgtgagcgtgctcgactccgttctctacaaaacctgaaccgcctgttcgtccgcccagcgctgaccaaagaacaactcaaggaagaatatgaagcgcgcgtccgaaaacgtcaacaaaactctgctcccgtggcaccagcaatgcaacatcgccagacaaatgttccgactcccgtcaaaaaaaatggaccaaaccagaaggaggccagcgacgacatttccaaaccgccggaagtttttgaccaaacaatcctcgtatgttatgaagcattaaaatcattaccaccaaacgacaaaattgttcaccaaattcaatcactcgaaaaacaataccctcgtcttttcaataaatagttctgtcagacctccaaacatttcctcaacaaaaaaaaaacatttattccagtacttcacatttctcaccaaaatttttcctcaaaaaaaaaaaatttttttttctcttctacaaccctaaaaaaacaaataaccacttttccctttgttggaggtctgacttttctaatttctgcttctccttcaaaatttcaattcttttatcactgctttccatttcaccttatttccgccaaaagagtaagtggcacatgtccttcttttggttatttttatttttgaataaataaataaataattttt

SEQ ID NO: 34020 - DNA, 953 bp, Heterodera glycines
agtcagttcatttaaataattttatccaaaaatttttttttggttttcggggcagtccccctgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcttgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccctccccataattgtttgagtaccccaaacggacacttgaataaatcgatttttttatttcataaatattttttcagaaagtgctctaaagcgcaccaaattttatttacaagttaattttagcactctgatgctttagtatcaaaaaggaagatggagaaaaaattttttaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgc

SEQ ID NO: 34021 - DNA, 417 bp, Heterodera glycines
  misc_feature (9)..(9): n is a, c, g, or t
atgtccctntttgagcgaaaagaaaactcaattcacttttggacaattcaaaaaaatattttaaatccatggaaattaaatttaatgatttaatttaaaaactaagagtgtttgggttcggagggtgccgacagggaaaatcggacctttaaaatgaagggcattcgggtaaggattatattccctaaacacagcgccccaatttgggaccagagcgtttgggcccccgtttttgggccccggggtcgtttgggcccccgtttttgggccccggggtcgtttgggcccccgtttttgggccccggggtcgtttgggccccaacccaaaaatagaaaaatgtgcttttttaaaaattaagattctaaaaactacgactgagggaaccctctccactggacatcaattaggttgaatta

SEQ ID NO: 34022 - DNA, 962 bp, Heterodera glycines
aattagccctctcaattttccttcgggcctcagcccccctatctctttttcggccaattttgtaccgatcaaagccaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaatttagtaccgatcaaagggaaaatggcttaattcaggccccaatgtgcgcctgaatcgctaattagcttggcactttcgaatattacatataaattagcccctctcaaattttccttcgggcctcagaaaatggctatctctttt

SEQ ID NO: 34023 - DNA, 319 bp, Heterodera glycines
agcatttcaatcactggggactcaaaccaccagcatttcaatcactgggactaaacccaacagcatttcaatcacttactcaaaccaccagcatttcaatcactgggactaaacccaacagcatttcaatcactgggactcaaaccaccagcatttcaatcactgggactaaacccaacagcatttcaatcactgggactcaaaccaccagcatttcaatcactgggactcaacccaccagcatttcaatcactgggactaaacccaccagcatttcaatcactgggactcaaccaccagcatttcaatcactgggact

SEQ ID NO: 34024 - DNA, 986 bp, Heterodera glycines
ccaggaacaaaattgatccgcgatcggatcaaccaagaccttattttcgaacatggacggctccaccactaccaccaagaggacccaaacggaaattgatacaaacagaccaagcgtcagaattaaagcaaaaatcacaaaaactcagaggaatgagacaggcgagagtcagggagcaagaaggattgatgcttccgtttccaacgaggggagtcaagcggaagcgacggtcctgccaacagtagaaacggaaatcccaacctaaagccagcgtctcaggccacaaaaatggaaaaatcaattaaaaatgtgttagaacgcctctacaatgacccaaaatcccctgctgcgttcgccggtgttgacagactgtggctggaagccaaaaaagaattaggaaataaaattcgtaaaaatgatgtaaaacattacttggagggacatcgcacctacactttgatgcgcccaaggcgcgtaaattttctgcgcgctcgaacgactgcagccggttttatgaccgactgtcaggttgatttggctgattttcaagcactttcccaacacaacagcggcaatcgttatttaatggtggtaatcgatgtcctttctaaacggattttcgtaacacctcttcgtaccaagaaatccgatgacatggtagaaggctttaaacgagtgttttcaactatgccaatgaaaccacacagaattttctccgacaagggtacagaattcagaaatcagcagctgaaaaaaattttgatgaagaggaagttgagaaatatgagagcacacattctgagaagaaagcagcattagccgagcgcgcaatacgacaaatcaaaaatcgtgtatatcgttactttgcccaaacaaaaaccctcaattgggtggacgtaattgatcaaatttgttgatggcattaataaatcaccgagccgagtgcatgggatgcgaccgattgatgtgaactttaaaatttcaca

SEQ ID NO: 34025 - DNA, 597 bp, Heterodera glycines
  misc_feature (23)..(23): n is a, c, g, or t
acttaataggacaattaaaattntggtattagtacagccttttaagccaaaaaaatggtcttaaaatcttataaaaaatgcttccagagttttcgagggcgctgattatgaatttgaatccgatctccatttcggcctaattcagagttccgaacttaacttcgaacatttgtgtcgccgaagcgacacaaatttctttgaaattttcctttattttttgatacttttcgtcgatcaattttcccattcgctcgctcctcttttttatgactcagctctttttctctcttcatttttttgttatgagtcatcatttttgagggaattttttccctttgcttgtgcacatttcttcacgtgcctggccccgcccccatcgattgtgagggtataaaagcccggcccattctccattttcttgagtcttatcaattttcgattaagtcaggtggacaggttgctgtccagtaaattgtaattgtctaagttgaataaagattgaggaaagagtcttagtgttctccctatctgtgaaagggacgctcaggagcgctttcatacagagcattaagtccttgacccccctaggggcagaaa

SEQ ID NO: 34026 - DNA, 775 bp, Heterodera glycines
  misc_feature (730)..(730): n is a, c, g, or t
agaaaaattttctgtcaatttattgtccacaatttactttaatttaataaggccaaaatgatgaattggactgtgcaaattagacattaaattattacagaaagttttattgatggactgatgattagtttacgattttttaaatttttcaaaaaagaataaaaatgtctgtcagagaaaagagcatgctcaggtttcggaattttccaaatagtaaaataaaaacggttgaatcgatgtaaaaaggttagaaatgggtaggaaaatagaataaaggcgcgttcgccctttctttgtttttattgaatgtaaaaaaaagaaaaatatgtgaacttaaattaaaaacttaaccgagaaggtaaaattcaatcctaaaaagaaaaaactcatctggacatatgaatatattgtataatatgaattaaataataagctttaataataaagtaaaataatttaaagcaaaatcataatgcaatattttaaaatagatttaaatcattaaaattattcatttacaatgtattttgctataaagctgtggagaaattttcaaaaattttatgaaattttcatgtgccaagcccgtagcccgtgcccgtgtaaatgtgacacagtttaaaagggttttttctccggcgaaattgagatttttttgagtttgagtaatacatttcaccaaaataatcattttactgcataatttgattaaaaaatctatttcttcagnatctgaaacaaatattcagatttagattatataatttaaaaatag

SEQ ID NO: 34027 - DNA, 890 bp, Heterodera glycines
aaaaaaaagaattttgcaaaataaccgccaaaagtcatttgttgttgcaagaattcaccatttttcaacgggacgtcaaaatttaagccaaattgatagattcccagccgccccctccttttaacgacgcaccaaaatgcgttcgttcggctgtggtgccaatgccataacgggcaaaaatgaggaaaggccttggatggagtaatggcccgccaaatattcgggagtggcgcctgaaagcgcatcaataaaaagttaagcagctacaattggttagctaacgactcaaaaaagaattagaaatgataaaaggaagtgcccaattatggccgctttacgccacttacccaccggcacctgcgagtcgtacaccacgaggccaactttggtccattttgcggccgggtcgacattcattccacgcgaaatctgaaggaacattcgcatgggataattgtttattaaaagcccaaaatcagatcagggcgagggaatgccaaaattaaaagggtaattttcagcttatttcgcaaaaatgattaaaatcggtcgtcctttctcacaaaccaatgcctttgccaactctccgcgccgcgttttcagcggatttgagcgaattgtcacaggccgcggctgttcattgctgtccaaaaattcgagtaactaaaaattggaataaatttcattttgggttttccttataaaaccaacttcagccccggtggggaaaagctccatgaatttttccatcaaaaattcgttgtagtcgtaataggagcacaggtcttttaagagaagctgaaaagcggagaaaatatgaaaatataattgaaaaataaccttttaactctaaattttgccattttttcaatttttctcgccttttttat

SEQ ID NO: 34028 - DNA, 737 bp, Heterodera glycines
ttacggccttttttgacccccgtcatgacggattacggatggcgccgtaactgaaaaaatcgccgtaatgacggattacggatggccgtaactgaaaatcagttacgtccagccctgctcgaaacgcaaggaagtgaaataaatatcaatcgtctcagcatcctaattaccagcaggatttttaggttctaaaaaccgagaataggtacctaaataagatcgccattttcgggcacacgcacagaatttaaattctataaaaataaaaaggtcattgctatttttttttaaagaataacgcagtcaaacagtataattggagctaattcaaatcaaacccccgccccgcgaacagccacgcccgcccacgggctcgaaccctagtataaatgaactaaaaatccttttgtgattttttaaaaattatttatttctgtgttaaaaaagttaattgatattaaaataaaataggtaaacaaacaaaacgaaaaaataaaaatgtaacaaataaaatgaaataaaaacgaatgaaatggcaatgaaatattcatttgtaagttttctaattcaattgatcttattattttttaatctgttttttaaacatgaattcaaaagattacaaaagaatttctgtgaaaaagggggcactttaatgtttttgtggatcgatcattacggttttattaatgttaaattgtaattttcaataattaaagtacattttgtatggtcgg

SEQ ID NO: 34029 - DNA, 494 bp, Heterodera glycines
tcaatgccacaattcattggcggcagaaaatcgaaaaaaccaaaggggaaataattcttttttacatttatgattggatttttggttttttgtgatagcaaagtgaaatgtattcgagccgtaaattttaaacggaattggctaattattttttttagtacaaaagtgttgccgttttgcgtaaccgcttttgtcgtcataagacatttttaattggatgaatgctaattaatgtgaaatataatgacttgcacttacagtacgcctcatttgttcattattgtcttcgtcattttcccattaatgtaatgctctttcaatttataataaattttgtagacttcagataagggcatcgtaagtctggtcacatgccgtaagcaacattggcatcacgtatagacacatgtactaaaaacatttcttattgtctttaggtcggacagacaaaatgccaaaaaaaaataaggaaaatactaaaaatgaattaaaaa

SEQ ID NO: 34030 - DNA, 878 bp, Heterodera glycines
  misc_feature (461)..(461): n is a, c, g, or t
atcgatcactccgtcatcgcttttcttcgttcaaatcaccaaattttcgacaaaagaggcaccaatttagagttgtggatttattccgcacacagctcggatggccagctgatttttgacattttcgttcgtgaaatatggccaatttttgcatcaaacattcgccatttacgctttaacatggtgatcatttggacaatttgcgtcgtcacacttcgccaacaattctcactgatctcaaactgctgaattcaattcattcatttggtctgttgcctgatgccattggtgattattttgacgggccaaatgcaactgctggccaagcgttgaacaaatggttgcactctccgagaaaagatggccaacccaagcgattgcgttgtgcacttatgaaagaacaagcgtacttcgattgggtcaacaaattcaaggaggtgtggtccggagggggggggggnggagcaggacaaaaaatcaaggaagttaaaaaaaaatttcgttttttttgttgtggctgagtcgcagaccatttggccaaatggtctacgacttagttacaactttactgattttgattacctctatttttgttttccaatttgtttaggcatttctccgtgccatttcttccgtttgttaccaaattcattttgttgttcatgtgccgtcaatgcaactggtgccatttgaattggtgaacgaatggacaaaggaaaagctgacattggccaaagaaaacgaaaatgaatggatcaactgttggataatgaaacgatgcaaaattggggagaccgcggcgattcagcagcaaaagaaagatgaaaattggaacacagtgttattttggctttttagtggcactaattgcattgggt

SEQ ID NO: 34031 - DNA, 1489 bp, Heterodera glycines
acatgtcatgtctacatcatttcatctttggtgtcctcctcttccacgattggtaactctctcttgtctatttctgttggggcagtttcccgcccaatgtccatcgcgtctacaaatgacacagtagtcgacaaaccagacgctgatcgcatcctctacaatgtctctgtagcgcctgttattaatcctggttgccgaaaaaatgctagtccccacataaaattgtttgttaatactattttttggtcttactattattttagtagaaaaacgatttctatattttggcagtaacatgacttctagcggattttgaattttgaatccagttatttgcgcccatgcttcatctacaaggtcaagattttttacatccggtccaatttgatgcggaaagaatgttatcatcactctcatcatcatatacattaaaatcgacatcaattgcttttatctcatttcttacactttttataatattataaatagttccactttcctcgtttgggtttgatgagtataactcagaattcaaagaactaaaatattcaagcttttccactttcggtactgagattatactgcctaagcgtggatactgattcagttttacatttggatgaactaatgcaaaatatggccatttgtcctctttacccagccgaacagccattgcacactcacccattctctggaaaataatcatccttagctgatcatcactatttttatccctttttttctttttttgatattcatcgctttctggtttaaccattgcccatgcaagagtatcagtacatcttaaacctattccagaactagaaggacagtctatgttattaataggttctgttggattcttttcatcacttttttagtatctctcagttcagatgttttctcagtatcacattttattgccaaagctgccattgtttttctaatcatttctctacaatgatttatttctgcaattcttttcgtttccttttcattagtactttggcttgccgaagcaatattttgactgatatttttatttgtttcactgttttcttgcccgtttcctaccatatgacccgtgcatgccccttctattttacttgccgaagcaactgattgtacaccgaattcattactacaagtttccctagaaagattcctagtttgatcttcgttttggcttgccgaagcagttattcttcccttgcttgcctcctcctcctcctccaatgtcagcatttcgagcagatgtaaatcgtttgtgtcagtcaaagtcgtggtaggcggcagcggattgtttgacattcctaaattgattatgtgttattaatgatgatttttacgtgcatttattttaattaaatattaataacaaaaatgctaaagtattatttataattttcactaggaccgtattcctttttatttctgagaatgatattctgagaactctatcctttacaaaattataaatttttactaa

SEQ ID NO: 34032 - DNA, 685 bp, Heterodera glycines
  misc_feature (637)..(637): n is a, c, g, or t
gaaaacgaaaacacgaaaaaattttgttaatttcagccataatcaagaaacataaaactttaaattgtattaccaaattgaagaaattgaaatccaagattttttggaaaagagtaaaaatgaataaatcaagaattcttagctaggtcataatccggaaaaaccggtcaaaaattcgccggatcggaccggattggcattttcaaaaatgaccgatttccggacccggaactctaatcgtctccctaatcctgagcccaattccgtccgcgtccgaactagtcaaaaacggtgaaaatatattagtcgtattgtgcggcttagcgttcccttctgtttaatggtcagcgtactgataacggatatcagttgatcaactgactgactctcgaggaaatgtttccgtttaaacagagggacccgtgggaaaagcaagggaagagaagcggacaatgaaaaaagagaaaatgctttaaagcgaatgtggataaatggcgctttacaagaacaataccgcactttcactgatcaaagaatcaaaatcggaacgaaaggatctttttcctaaaatgctcgtcaattcgtcctcctcaggccaacaatttctttgccgtttcgtcaatttgtgccctcattntcgcttccatttttgcgcacaatcgcaccgccgcttttcgcattgcgt

SEQ ID NO: 34033 - DNA, 928 bp, Heterodera glycines
ttcaagcggcttcgccatcgtttatgggtgtctcttttctttcggtcttctcggcaatggttccgttctgctcgcttttgcacaaaacaaaaggtgatggtattttatgcccatttatgcggggggaaaatggaaaaacaaaaagggaatggcaaaaggaattttaagcggtaaaaactccggcggagcaaatttggcctatccgctttttctaatagtgatggtgttttgctgtaaatattctgagttatctcttccgtttagacttcgatcggctcgcaatttgttcctgctcaatctcatcctcaccgacatccttttgtgtctcaccgctgttccggtcacgccttggtccgaccgtcccctcctcccctgtccgtttccgtccccacccccgccctcttttaaggtatgcgctgactaaggattggagtttcggctctttgatgtgccgtctcgtgcccttgtccaactcttgcgctgtgttcgtcaccaggttggcattgtgccatttgctccgcccttctcccatttgttttcgtttagttggagcttgacagccatcgcggtggacaagttcatgcacatcatcgacttgacccggcaaccttttgtccttttgttagccgtccctcggcttcatctccccccccccccttcagtgaacagttctctctgcgaaccgcgggcttcgtcactttcgtcatttggactttgtcctcgctgctcaacatcccttaccttctctcctattcgttggtcaatgggttagtattcgtctttttgtgacacttttatttttggcacattttagtgattattatgtgccaaagaattcgactcccttttgcggacaattttgtgagaaaatgttcaaattggtggcatattaaaatggtcatgttgaggtgatgaattaaattggtca

SEQ ID NO: 34034 - DNA, 1013 bp, Heterodera glycines
agacactaatgtgtgtcatggcttttgaaaaactttagtgcgatgcactaatgtgtgtcatgttgtgccataaggaaatgccaaaaaacaagaagagatgatgaaaatgccaagaatgttgtgccataaggaaatgccacaagaaataagaaaagacgaggaaaagataagaacaagaagagatgatgaaaatgccaagaatgttgtgccatagggaaatgccacaagaaacatgaagagatgatgaaaatgccaagaatgttgtgcaatagggaaatgccacaagaaacaagaaaagacgacgaaaatgctaagaatgttgtgccataagcaaatgtcaacaaacaagaagagatgatgtgttaagaaatgttgtggcataaaaaatgccacaagaaaatagaagagacaatgaaaatgttaatgttgtgccttaagaaaatgccaataaacatgaagagctgatgaaaatgccaagaatgttgtgccataaggatgccacaagaaataagaaaagtcgaggaaaatgttcggttttatcattcatttccggttatggggtttgtgaagaattggtgagattgaattatggtgtctggaatagagccgaagactccagttacgagagcgcgaagcggccgagtgagtacctttggcgcaaaaatttggtgagggggccgaaggcccccgtacggttgagtcccattgattgaaatgttggtgggttgagtcccagttattggaatgctggtgggttgagtcccagtgattgaaatgctgttgggttgagtcccagtgattggaatgctggtgagttgagtcccagtgattggaatgctggtgggttgagtcccagtgattgaaatgctgttgggttgagtcccagtgattggaatgctggtgagttgagtcccattgattgaaatgttggtgggttgagtcccagtgattgaaatgctgttgggttgagtaccgagtgattgaaatgttggtgggttgagtccccagtgatt

SEQ ID NO: 34035 - DNA, 104 bp, Heterodera glycines
ctaaaaaagttaagcctacattttttggcatatttaaaaagcaattaaaaaatttttaaaatttaataattttcctgcaccgaaggtactcaatcggcctcttc

SEQ ID NO: 34036 - DNA, 1416 bp, Heterodera glycines
ccttataattggtcctcgactccattggaccctcggttcccagttctgtccccgtctattcctccgacgaaaatttgggcaccctctccactgatagtgcacaccatgtcggcgcagccaacacaaaaaacaaagacaaatcaccaatgctgccccaattgagccggcaagcgtgccgaccacaaaggccagaaggaacggggagcaatgggggttaaggactctttcccaacacaaatagcatttgatgaggctacacccctccacgggctcgcactgaacttgtgatgagattttttcccctgcaattgaataagagatgtgacactcaaaaccgcttgccaacaggtccgggggaaggggcagtagatagggtgaagggtttccccgactgctgcatatgccctcacagcacattatgctattctccgcccgtgggttcaaaaatacccaaattccctgctcgtcgcaggagagagcccgggtggcagcatccgtgccacaaaaaagggttaaaattgggataaaaactgtgattaagggcaagcgcgtcgcccagcggaaatgaataggattgcctttgtcggctccgaaagtgggcctttttgagaggggagggcggtcggcccacttcaaaatcccttgtcgccgttggtccctctttttgcctgaggggggattgtctgtgagcggcacttcgctccatttcgctgcggcctccagggggaccaattgattaacggaacgttcgaattccctgccgcttccgactaacaccttagcgctgcggggtttatccggggggatcaaagaaagaatgcgcccgaggggccaatgatttcgaggaaagccctcctgttctattagcacgacatctccgattttcggtggatctggggcagaaaccctcgggccggcatgtgtatcctgagtcctaccccgcaaaattaaaaggtaatcccggctccatcttttccaaaattgccggagggattcgttggtggtgtaccataaatgagctaatttttcggatgaggaaggcttaaaggggtccggttcttcgggctccaccacggcattttgggtgtgaggggaaaggaagtccaggggacgaagtggcaacggaccatcctctaagtcggaaacaaaagtaatgggacgactgtttaaaattgcttctatttcacaagtcagggtgtgcaattgcccccaggtgggcgttagtcgtcccaaactccgacgaaatgccgttttgactagcccaaccatcctttcgtagacacccccggcccacggactgtacggtgggattagtttccattccaccggaaagtcgtagtaggccattagaatttgcctcccgagaattaactgtgtcccattgtcggaccaaactcgttttgggactcccctccg

SEQ ID NO: 34037 - DNA, 1211 bp, Heterodera glycines
gtggtataaatttcaaataaatcccataaaattctcctcatttttctctatttttaaagctttattatagttaaatcgatgaaaccatcaccgagttatgaattttcaaatattaggccaaaatcacgagggccaaaaaattgccaaaaaataaagaatttttaaaaaattccaaaaattatgaaacttaaaatagacatcatattcgtattcagcacctcaaaatagcccagaaaaatatttttcacaccctttttcgaccccaaaaaaatttttgaaaatttctagggggcctagctcgaaaatttttgaaaatttccaaacatgcagtacaccattcgatagagcttaaaaagctctacaattttggtctaaggcactttttggctaaaatcaacccctgacgagttatgggcccaggactcaaatgtcccgctcaggccaaaatttttttctatttccgtgaaaaaatcgaaatttttccgaaaaaaataccagtcgatagagctcgaaaaactatgttttggaagtggtcttcgtttttctgggaaaattcgttaaaaattcttaaaattcaaaaaccaaaaaaccgttttttaggcctagctcgaaaaattttcaaaattttcgaaattttaaaatttggaaaaatcgagctcaccgagctctacaataagtctgctggccaccctgcgctcaggtcaaagcctaatgagttattcaacggggactgaactggaaaaagttggtactgaaaagttgccaatttctgcagcccttccaagtataggtagaggcctggaattttttttgaaaattagaaaacacttcaacttaaaaaccttccagcaagaattttccgctccctgtcctttaaaaaaagttacgggccttcaaacgcaagcaaaagtgagaaattagccgccgggactcagttggccaccggagcaaaaaacctatagttttcccagatgcgcctcaaaaagttgtaagacccttccactactttcagggcgctcccggccttcggccgggagccttaatttttttaatgagtccccctttttctctatatatatataaactagcgtgttggaattgacgggggcggcgtaggcaattggcttttggatgaagagaaaatggacatgctcatttgttattttaaaacatacaaaacattaattgcattagtgtgctgtattaaagcg

SEQ ID NO: 34038 - DNA, 523 bp, Heterodera glycines
tttgttcattttcatcttctttctgcttgggtgcatttatgggtgtactcagttcgtcatgttcgacggcggtattggcggtgggggcgttgcttgtatttgcctcgaaagaatctgcttatgactctcctcatgagaactcagttaatgtcggcaccggaatattggcctctattaatgtttgaaaacacctaagcttgcctcttgtgtcatgcgttttcttattctatgtgaaaaactatcagttttctcaagtgcagctctttctctaaccagctgactcggtttcttgacgaagtggctgagagctcgatatatcaagacgaccagcatttccatttcttagaactgccatccttacaaattgaaattttctttacaaatttcaaggttactatcagcacattttgatagtatttttgtcaacgaaaaatcctagaatattattctatgcaatttactagaacaaaaaagttgggcataaaaattctttcggttgattgatattcatgctaattaatca

SEQ ID NO: 34039 - DNA, 1401 bp, Heterodera glycines
  misc_feature (1110)..(1110): n is a, c, g, or t
  misc_feature (1167)..(1167): n is a, c, g, or t
gctttttttaatattttttttgccttttccggtcggtttcaattttcgctgttttctctcatttttaattttttttgcgtaatttaatttcaactggccccaccatttccatttaaagtgcataaaaagttttaagtctttgatagaaaagggcaaacattctctcgtcccccccccctccctcaaattgcattatttcgcttattacgcctacggcatggaaatccaaatgaaatcccagaataaaatatagagccattaggggaagaaaattagcggccatctcaaattgcgtgcaaataaataaataaacgcttttacgatatctccacgccccaaaatcaattgacattttagataattatctcaaaatggacacatttcagaatgttcccatttgactctatagaatttgttaatctctttgcaacgatgtgttttctctctgtggcgagccctacagaaaatctactcgtgcgagggaatgctcaatgactcccttgtccaaaaaaaagttcgtccgcacaaattaggagtcaagacgtagggaaattcagtcgccttacctttttgacaatattagtagaaaaaattttctaattttattaagaaacgacctagcaccctgtaggggcatttcctttaaaatcatatcaatcttactgtaatgcgttttttctacagtcgtccctcgcttcgtcagtcgtacagcggcagtttgtacctttcggcactcggctgttccgacgcattggtaaggcacaaaatccaatcacggataattagggctaattgccttattaccactaatcccatccgagcgccaatcattccgccctaatcaggtgataatcactggcgttgtttctgttctttgtcgactccattcgtcgttattccttggcactttccattggctatgggtcgctttcgcccattggttaccccgcggcaatgatcgcgcagacgtgctccgtttacttcacactcgtggccggcatcgactgtttcgtacaggtgccaacattcctcatcaattaatggctttactaatattacttatggcttaatcataagacaaaaaatgccacttttggttttttaatattnttaaattggctaaaatataaattattatttcaattttaatttgactgtccctttgtnaacagaaataaaaattttgtttctctctaccaacattttttgctgttaaatttccgataaccttttcatatgtctatttcattgactaataagttaccatgccagtgttttttccacctcaatttccactttttgtttaagggttggctctcgtccgcgtccaaaggactttttgcgcgccatgcttccaaaggcgaccattttgtgcgtgctgattttcgcgttctttacaat

SEQ ID NO: 34040 - DNA, 866 bp, Heterodera glycines
aaatttttgaaaatttgattaaaatttgttgacagatttcaccaaaaatcatcaaattttgtgatttttgtatcatttttctaatgagaaataagagttttggcgcgccgctgagaacagtttttcatcaaattaccaaattttgcgattttgggccattttctaagaaaaaataggagttttgggggcgcggcggtgccgataggcgccaccggggaaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccataggctacggtagaggtaattaattaatcacttacaccgtttaccgtattttaaattaatttttacagtacatctttggtggagaacggaacgatcggctgatttatttaatgcactattcatttgtgtttatttatttgattttactcattaaaatattaattatttaattaatgaattaattaattaatgatcattgaacgacgaacatttagtcaacatttaactcattccaacagatttttaaactgctgttggtcagtaaagattaactttgtttcatgcagtttttctcagcaaacagaaaattagagaagactttggaaaactttaaagagataacaggcggagttatggcattttaggaaaactaaaatttaaagtaaaaataaataaaatttctcaattttttatgcactgaaaaaaac

SEQ ID NO: 34041 - DNA, 845 bp, Heterodera glycines
ctgatttgtaagagcagaaaacaatgtgacaaaaacgaaatagagagaagtgatcagcagagaaaggactttcacaattgtccaaacgacaaaaacaaaacaatttaaattatttaatcgcatgacaaaattgttttcgtttgcaattaattaaattttttttttttttaaattgttttcgttaaacagttttttttcagggtgaatttaataaaaaaaatttaattcataataaaaaatatttttcaacaatttttccaaagcattgaccgattggtttttgtttttctattagtgaatatttgtgagttttatcaacaaatttgcttaccgtagccttttcatccggaattggttcataattttcttccctggccaaaattgcgtcaaaatgccaaaaaaacagagaaaagagacaaaaattggcaacagaaaaggacaaaagggaatgccgtgatttgtgatgccacatttaggctaaaaatgtttcggtaaattctttaaaatttaacgaatcggcaaatattgcccggggaaacggtgaaaatcaatggcaatgccatgccccgcgggggtgttaaaaaaattgaccaaagggtttaaaaagagggaaaaaaccaaagaaattgggaggaagttaattagtatttcattcagaaaataataataaaaaaaaggatgagtgaattttttgaacacaattacggaaagaggcggggaagaactcgtcgagaagactcgccaaattgggcgagaagtgattgatggaccacaaaggccgacacggactttcgatcgaatcaaatgaggggggaggactgatcgaaatggggcacaaaacattt

SEQ ID NO: 34042 - DNA, 775 bp, Heterodera glycines
tagtaaaagtttcttttcacattcattgatttaaaattggtgggaaattagtaaaaagggaattgacgtcaacaaaagatatgacgaaagcaaagaaataaatgactgttctaatgatgatggccttttctaattgcaattaggaacaaataattcagctaaaattgagttgatttggaaatgaattaaacgagggaaatgggaatgaaatgattgaattgaatgagttcctaatccattccttagttcgattcaaaattggtgttcgaaacgctttcccggggcaaagagtcggagccgttcagcgacgagttggcggtggctttgaagcgactttgggctgacccgtcgctgaactcggccacttttgaacatgcgttggaattgcatttgcagagctcaaccaaacagtgcgttcttctgctgtacagcgacatttgctcatttgtatcttttgtatcttttgacagctttttggacagtctggaccgaatcagcaacccctcctacagaccatcggaacaggacattctgctgacgaggtccaatcccattcacataccgacaaacattttcggcattctttcagaattagaacgacgggggtcaccgaacagtcattcatcatcagggaaatgaagttcaggtgagtccggctgtctgagatggattgaatgtaatccatttttatttcagggtatttgacgtcggaggccaggtcggaacgaaatggagggagaaggggacggggagagagaggggatactcattttga

SEQ ID NO: 34043 - DNA, 1045 bp, Heterodera glycines
  misc_feature (757)..(757): n is a, c, g, or t
catgtaaatgccaccaaaaactctaagcattcttttcagggatagagttacgaagtcataaaaaaattaaaaatttcggttccaatccaaaaaaagacgaaattccgcgccatttctgattctttccccatttgttttttcaagtgaaaaggaaatgggactaaagaaagttgaaattcaaatttgtgtgctttagcacgctgagaatgcgctgaaccccttggctatggtcgggctcattgacttccgaaatgttgacgactttccatggcccgatttgcgttcttcgaaatctctcgggaggaccgtggagaacgacctcacacattcgaagtattccttgtccaatttgcactttatcaacgtgtacttcactataacaattggccatttgcacggcagcaacgaattcaaacgcttttccatccaacggactgtcaatggaccaaaaaaggccatttgaacaaacagaaatgaaatggcgacgatctccaatggatttactgcaaaattgccggacttttaaattgctattcatttgctcgttctgctgttttgctgtcgtctctcctctctaatcctcaactcgtccatctcagaatgtgttctgttctgtctgtctctgttttggatcattttattcattccaccaaatcattttgggtatactattgtcaacccccagaaaaaatgtcacaaatgatataccaatcgttaaaaacttaatgagagaattcggcacttttagcgtttttanatgatcaaaaccttgacaaatttggtatcatttgaaagctctttttttttgtcaattaaataaaatttgcgatttttttgtgttccaattggtcttttccttcacttcccatccctttttaagttaagcattcctctccattttgcttgttttccccttttccgcacttttccctttctttggtccctttaaaaaatttttggggaattgaaggcgaaattgccttcctttggcccatccctttgaaattatgcgccccagcaaaaagaaggatcattaccatttatg

SEQ ID NO: 34044 - DNA, 1398 bp, Heterodera glycines
cagcttgctgcctgaggtcgatagaaaaagatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttctcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaaacgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaacccaaaaaaaaattttttggatagaaattatttagatgaactgactagataatatttaaaataggttatttctcttcctttcagtatccctgcaaagtttggtgcgcttctgatcagtttctgaaaaaaaatgtaagcctaaactttttgggctgtttaaaaggaatacaaatttttaaaatttattctctccctttttgataaaaaaacatcagagtgcctaactacatgaaaataaatctgctgcgttttcgacccctttctgaaaaatattttaaaataaattttgcaaaaaaaaataaaaccgaaagactccaatttttccaaaatttttttgagccagctacttccgcgcttttttcaagggaaaattatccctttaccgggagaattccccgaaaaatttgggaagcttttggctcatttacaaaaaaaaaataggggaaaaaattttttaaaaaaaaaaaaaaaaccccacttatttttggtaaattttaaaaaaaaaaaaataaaattttttaaaatataaaatttttctctccccccaaaaagacccccctcccccccccccccccccccccccgggggggggggggggggggcccccccccccccccccccccccccccccc

SEQ ID NO: 34045 - DNA, 1041 bp, Heterodera glycines
gcaaataaatactttttaattaaatttttaaaatatatttattcatttccaaaagtgctccactgctgttgcgctctgagtgccctgttctacgcgttcgcgctgctctccagtgaggtgttcttcgatattgacaaatggcgatggtcggaggtgccgttggaacagacggcgcaccaccgaattgggaacggactgctcggagtcaccgttttcattgttcaggtccaaaaatatattttgggaatttctaatccattgccaggagcttatgtataaaaaatattgatgctatagcatctctgtctcgagaaaagtctaggcttttttgatcttcattttcgagaccgagacttttttacaccccttcatgattggattttggtaaacctaaaaaataatgttctttatttgaagatttaatattttcggtaaagaattttgtaaattttatacatttttaagccgattttgtaccaaaataagcaaatttattaattatgtacaaattctatttttctaaaatttattatttttaaattaatggacgattgctgaaataagggcaaaaaaaaaacaaaaatgttagaaaaggcctcaaaaaaaatgttttttaaatttataaaaattcaattggtttttaagtgtaaagggaaataaatctcgagtctcgggtctttttgatcttgagtctcgggaaacttttggtctcgagcataataaaatccaataaattcgttgattagattctctctctcgggcattgttaagcatgtctgctcataattctgcttatttattgtcagatgttctgttgccactcgccccaattggtcacttcctccgccattcttcagcttgtgctcagttcgttggcattcttcacgcttaattcggccatcacaaatgtgtattatttggtcagcattttgcattaaatttattattactttttaaacaaaatttcatgtttaaaatatgaaaatatttaatttaccataactataattaatcatcagggctggcaatttttttttctgg

SEQ ID NO: 34046 - DNA, 832 bp, Heterodera glycines
ttctatttgctgaattggtcgaaattggtgaaaaatgtgtggaaaatctgtgatttttaattttcggctttttaaaaatttaataaatttcataaggtaataaagactctatttaaaaaacaagaaaatttattaaatttgaaatggtgcatttatttgttcggaggctctcatcaatagggctgagaattaagtcaaaggaccatttttttgtttttcgctttaaaattacttaaaaagttctgcactttgtttgaagcttctaaactgcattttatttggcttttttttactttttggcattttttcaaatttcccccaattatggcccttttacaataatgagttttgctcgataaaattgaaaatgtaccttttttacattgtgaccaaattatcgtttttatacataagtattctataaattgtttcaaaggataatattttttacatttggcaatttttacgagttggcttagtacgagttgggtgtcgtccgctaatagagaactcttagagctatcgaatgatagcaagaatatttattttggtggttgactttgacaaaagttatgggcagttttttatcaattgtttggtcattggacaaatatttaggggagggcgaggggcagcttcaccactgccatttaaatttcactttatcaatacaaaatcacatgaaaatagtacataatggatacatacgtacaatatatatacccaattaatgtcggtatttacattaagaacaaacataaagaaaatagcatcggattgattgatcgatcactttcgcccgattttcatctcaaatcctttcacgccacca

SEQ ID NO: 34047 - DNA, 318 bp, Heterodera glycines
ccattgaagagatgagtaggtggatccatttggaaatggagtaaaattcctataacgaaaaatattttaaggcgagttcgggtacttggctttttctttctaagtcaaacaaattaaatattcttttataccaatcgttagatcggtgtactctactaaatttgaaaattttttcaaaaatttttaaaactaaatatttttttattttgcgggacctaaattttctctattcggcaaaattttaaaaaaattcttaaaatttggtttaaatttttaatagcgacatcgcaggccccaaatacatcaaaacccacttga

SEQ ID NO: 34048 - DNA, 1021 bp, Heterodera glycines
gccgatggtacgccacccggttgaactgcttggagatcgtgccgacccgcttgaagtccttgaacgagagttgagaggcgacaatgacgagtgtgttcagtggcagatggtccagcgggaatgaacactagtcaaccagcaggccggaatttgttgatgaacacggcgcatccttgttttgtcgcttctgcaaattgaaaaaaaggtaatagtttagatggtgccccacatttttgacaaaaaattcaaaaattttaaaaattaataaaaacaggtattatggggtttcggaggtcgctgatctcgaatataacatccatttcgacctatttcgaatcccgaacccggattcgaacaaaaaattgaaaatcaaattttaacaaaattcacattcaagctacaaaaatggttcaaatgcaagaacaaataagtaacttttagcaatcattcgcatggataaaattgggaaacatgcagccagaaattgtaaaaaacatgctcccgggctccgaagcgctgacgccaaacgaactccggaaaataggtatcgtacgtctcggttttgttcccaaattgctgtttgaaatttcttatcagcgttttccacaacgactcaatgttttgcgtgtgggcaaggcgattggcgggatttacaaaatttttgggtatggttgaccgtccaatgggtgtaattctgtggcaaattgggaatgccacggtacggacgccattcatccgaaacaatcgtggttcccggaagaatgtattgctgaataattgggagcaggcgatttgcggtccgtgattaacaggaaccatgaagacacgttcccaatttgagtcacgttccacacccccgaataaccacacttcttgtttcgccaaaattcgaccaacgccatatttccttttgacaacaagagtttcgtcaatttcaacgaaacgcccttcaaaacaaattagacttaaaaattccgccatcaaaaagctggaccgcctttcactgattgcagttacaaaa

SEQ ID NO: 34049 - DNA, 823 bp, Heterodera glycines
gggtaagtgaaaaattgaaaagtgacaaaaaggggggggagggaaaaagcaagcagaagccaatgattagtgatgagctgaaaaagggcgaagaaagcatatgcaaaatggaaaaggaaaatgaatttttgagtaaagtaaaaatgggcaaaatgattcaattagtaaaaatgtcaacggttgccatggcttttgtcattttttaattacctgtcagatcaaaaaaaaataataatttaaacttttgtacttttaagcaccgtttttcgggattgaattggctaacagacagaaaagacagctgattccttaaatggatcattaaaatgcgtataaagttttttcttttcttttttttgcgtgtggtaaaaaggggagaaaaggaagaagcagcagacgataaagcataataaaagatgaatgattgagacgataaataatgatgattgatgcggggttaccccttcttatgtactgttggaggaggaggaggaagaagaagaggagaaagacagaagagacggactgacgaatgaaagaaagaaagtgaagagaatgggtgattcatcagctggacggaagaggaggaggagaaagaggaggatgaagaggaggggagggaaatgggggatagaagaagaagagggaggggaagggagggagggacacacaacgcaaagacagagcaaacagacagcggaggggacggggaggggaggggaggggaccacgaatgaatgaatgaatgtgtgtgatgtgatgaatgaatgaatgtaaagggcggcggaatgttggcgaagggatcgatggaactgcggagggg

SEQ ID NO: 34050 - DNA, 969 bp, Heterodera glycines
tttattcaccgcggcaaaagaatccgcaggagaagagacatttttggacgcattaagccaactgaaagaatttgaggaattgtttagggcttcaaaaatggtgtaaattaaagtaatcaccgtaaatatgactcctacttttttgaaaaatagtaaaaagatcaaattttcaaatatttagtgggggaaacaaaccaaaattttgtgaattgtttcttacgcacactgaaaggtccgctttggcccaattaattgtggcagccgtgccattctcacggtcgccactgccgtcggcaacacttcgcttgcggagcggtggtttttgatggtttttgacagtgcaaccgatgggtgtggaagtggtcagctgatgcttcttttgcgtttcgctggtgttcatgtgcatttttgaaaactaaatattaattgttagtatagtggataattcataaaaagcataccatttcggaaatgttattgggaatgatcggatgttgtgtgactggcattgactgtgtgacggatggaaaagcctttttcggaccatttgcagcggaagtcgacttaagccaatggtcgatgggtaagcgaaggccctaccacgaggccgcgaagaggccgagtgagtaccttcggtgcaggaaaattattaaactttaaaaattttttaattgctttttaaatatgccaaagaaatgtaggcattaacctttttagtgaaaatttagatctactcatactttatttagctaacttgagctagaagccgtacgctaaactttgcagggatgctctccggtaaaggactaacttacactgaaatgagcgccgagctagctggctcaaaaaaattttcgaaaatctgagtctttcgtttttatttattttttgcaaaattaattcttaaatattctttcagaagagggttcagaagcgcaccgaaattttatttacatgttagtctaggca

SEQ ID NO: 34051 - DNA, 1486 bp, Heterodera glycines
  misc_feature (1479)..(1479): n is a, c, g, or t
cggcgcggatgggagggggtagagtgggtaaacgcgtgcgggtttcacgcaggattgaatgcgtgcgtttttgtgtgtgtgatgcgtgtataggagtgggtggaattagaagttagagaagaggaaaactatagagaggagatgaaaagggaagcgagagaggggatagaacgaagattcagaaagaaaggtgagagagacagagaggaagagaagagagatagaaaagataaaggaaaaaagcgagaatacaattaaaaagagagcaaaagataaagagcaatcgagaagtgggaaatgggtaacgatagaaagagggggaaaattgatagatgatagagagagagcagagaggatgggaaatagaacagagggagagcgaaagagagagagaagagaaaaaaaaacagagaagggagaaagcagtgagagagagagcgaagagagagagagagaggtgaaagagagcagagagagagcgaagggagagagagagaagagagaaagagggagaacgaaagagagaaaacgaaatatagagtgaaaaagggagagagaaaaagaaagagcggttggcgccgctcgtataattttaagaagcaaagggttaattttttttgaagcaatatacatatgtacatacatataatgcaaattggcaaaatttaaaaagaaatgaattccttagtttgtctgcatctaaaaaactgatcaaaaagcgaaaacagttatctaaattaatcacactttccttttcatagatgattccttcggtttgtaatggtgaaagtagcagttccgacgacgaatattacaacaatttttccaaatacaaagcgaaggcagcattggcattacgaagaaatgattgcaaaagtggcaaagagattactaaaaatgggaaaagcacaacgaagaaagtctcttcagaaccatcggatgttgagggtttgaagaatgaaacgattttctttttgaacaataaaaaatactactttagttttcacatcttgtccattatctgaacaattaatttcgcgggctgaagtcgatcctgagatttgtgtagttcaaattgcggacacttccgtaaactctgttgttgatcgtaattgcaacgctttttatacgttttatatttaaataaatagggcaattattaggaaggagtgttcatgggtccgaaaatataagtccaattcaggcgcagactgattctgaacatagatttagtgactgagacttactcaacgacggaatgcgcctcacctttgcgaaccaatccatcgtttttgaccaatgtttgcagaataaacatttcatccaaaggacaacaaaagattttcttctgtgatttggttggttattatttgacttttgtagatggcaattccggaaaataaactcgtgaaaatttgttcatagagttgatcacgaattgaaaactcatgaataacaagtttgcacgatttgttatgnaattttt

SEQ ID NO: 34052 - DNA, 856 bp, Heterodera glycines
caattgaaagagctttttgcaataccaaacaagccacgtgttttacattaattttttcatcgaaaattccgaaccaatttgttactttttacaaaatgttttggatacgttttataagcccattttggcattacaagttaacaattattttgttaattaagatcacaatgtttttacagaaatcaagtttgatgctgccgaatttaatcaatactatggaatagatcggccgcttcgcggcctcgcatccttttcttgatattttcctatggcagaacatttttgcatcttcttgtcacatggcatttttgcatttttgacataaaatttcttagcattttcctcatcttttcttgtttcttggcgttttcctatggcacagcatttcttagcattttcctcatcttttcttgttttttgaccttttcttttggcacaacatttctcctaaacatttctgcactttttattttattggaatgtacgggctcggccgcttcgcggcctcgaatccttttcttgacattttcttgtggcacaacatttcttagcatttttcttgtccagaacaatacaataacaaacaattcttttggacaattcaacacgtgtgtatctctaaaacattagaggagacatagtagtgtacatctcaaaacaatacatttaaaagactgataaatttcgcttctgtgtctcattgatgagagggacgataatgttatctcataacaatacaatagcaataaattcttctagaaaaattcaacacttgtgtggcctataaaaatgagagacaatagtgtgcatctcaaaacatttgaagggattacacataacatgcacattaatgtag

SEQ ID NO: 34053 - DNA, 819 bp, Heterodera glycines
aattaggggtaattaattgacaacagtcgaccctctcctccctctcctccccccccccccccctcgttcgtcaaaaggtggagagaggggagagaccaccgtggggcgtgggggtcggaccgtgttgggtcttttgtaaaatttgcatttgaattattggaattgtatttaatcaattatattgcctaattattttttctatgattacgataattgccaataccgtaatcggtttgctgcccgcgaaacggaagacgacttcgtccacggggcgcccgtggggacagatcagtgcgcagatggccagccgacattggcccacgctgtgcagaacgatcagttggggggacacgtgccgagtggggaaaaggccgttggacgaatggaccaggcatttggcgtcgagccaattcaatcggcggaagatccgtttgtccaaattgatcaatgttatggtggacgaacggttttcgctccttttttaaaaaatcgaaaattaatccaaaattattttaaaatttaaaattaccattgcgaatagtgaaaagttcgcaacacaaaaatttgttcgattgctttcgtccgtttgaaaagcgacaaaatgcttttgccgctttcttcattcctttcactgaacagaagcagaatgttgatcttcagaatcagaatgcctaccaaattgagcacagcgaacattcggtgattgagcattttaaagattttaattatttaaatatacataaaaataaaataaataaataaaaaatggaaatcaaaatgttcggatgactgaccaatgagctcactctcttccatttg

SEQ ID NO: 34054 - DNA, 1088 bp, Heterodera glycines
  misc_feature (44)..(44): n is a, c, g, or t
  misc_feature (50)..(50): n is a, c, g, or t
  misc_feature (72)..(72): n is a, c, g, or t
tagatcagagaagattttcagcaaagaagcgccgccatattatntaatgnatacgaaaatttcaaaaaagtntaagaaataaaatatgtactaagtagggcccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaaattttttaatttgaaaattatgttaataattaggaaaaaagtcgatttttagggggtgtatttttcaattttcttgtatttttattgcaatttttctcaaaaatgccaaaatatgtgcaaaatatgtgacaaaacgccaaaatatgtgtttttatgtttttataagtcgctctaaatcaaaaattgttcggagataatgctatttttgggcttctctcgccataactaagccgcaaaaaaaatatgtaaaaacataaaatccgggccctagtactaagcaaaaagatttaaaaaatcaatatgtataactacaaaaagtttgaaaaaaatacttaaaaagattaaattatacaataatcaataatactcaattaaacgaaaaaatattaacgccaatttagaaaagaaaaagaaaatttccttatttatacattaatatagtacgaggttaatgataattatatactttttcaaaaaaaacagcacgaaacgaagacgtagaattcgaatagggtagataagaacatttaaataaacaccccaaaatttaaatagcaaactaaggatatgaaatgctttagagaatttaaattaaaaaaataaatgcaaaatgtttttattatttatctattcatttaatgaa

SEQ ID NO: 34055 - DNA, 771 bp, Heterodera glycines
  misc_feature (722)..(722): n is a, c, g, or t
  misc_feature (727)..(727): n is a, c, g, or t
  misc_feature (737)..(737): n is a, c, g, or t
ggtttgatgtctttgaatgtcaaatagaactgaaaaaagaaacaatttatatatatttatcagcaggaataattaatttcatttaccgtattattgttaaggtctgacataattctaaataatatttttaaattacatttaaaattttggtacttaattaaaatgaatgaaagtaaaaatgttttttgtcgggaaaaatatgccaaaatttgatcgcttggcttctaaatttctggtagcgtgctaaatgtccttttttataaaaaaaagtcatttaaataatttaaagtaaattaacatttaaatgttattggataccaaccaattaattcgtgagaaaatgaaaaaatgccaaagtcacgctttgaaacattttctttatgggaaatatcaatcttttcaatattgtctgtctacctttttaacaacgtttaaagattgcgtgctgtaagcatttttatttggacaaccacagaacaattaaaaatttatgcgaggcgcaaatgagggagcacacacttttgaaattttttcacttttctttttgatgaagaatttgttttttttaacagatggtacacatttagattatgacaatctgccggctcggcgaccttttttggatggaatcaatttacgttggatttacgaattcaaatatctgtgaacaaatttttcgacttaatgaatgctagggctaaagggaaaaaaactattattanagctntctgtgattntcttcgtcataataatacttttattcgccatatt

SEQ ID NO: 34056 - DNA, 780 bp, Heterodera glycines
  misc_feature (188)..(188): n is a, c, g, or t
  misc_feature (211)..(213): n is a, c, g, or t
  misc_feature (215)..(215): n is a, c, g, or t
tttttttttttttttcccttttttttttttttttttggggggttttttttttttttttttttttcaacctttttttttttttggggggggggtttttttttccccctttttttttttttttttttggggggaaaaaaaaaaaaaaattttttttttttttttttttttttttatttttttttttgcgnggggggggggggggggggggggnnnanaaaaaaaaaaattttttttttcttttatttttgtcatggtgggtgtttgttttttttttttttttcttctcttttttttgggtgtttgggggaagaaagtgggggggcttgtttttgttttttttttgtcgtttttttttatttttttggccggaggagggggggttttgcttcctgcggatcatgggggtttgttttttttttttttttcttttttaatttttttttttttttttttttgctcgtttaggggctggttttgccccttttttttgtttttttctttttttttttttttttttttttttttttgttttttttttttttttttacttatcgtttattcattttcttatttttttttttttttttggggtgggcctcggtgtttttttgggttttctttgtacctatagttgatatttttttttttttttttttttttttgttttttttttttttttcttttttctttttcttcaatcttgtttttcttttttttggtcagtctttttttttttcagtattcttctgtgttgtttttttttttttttttttttttttt

SEQ ID NO: 34057 - DNA, 1146 bp, Heterodera glycines
  misc_feature (45)..(45): n is a, c, g, or t
  misc_feature (77)..(77): n is a, c, g, or t
ttttttcttttattaaattcaaactattttttagatcgacagttntggctctgtccgggggtgattctcaacgatgnaatgcatgttcgcacgtcccaataaatttgattttcgtcaaatatgtgccactatgcatcagactgcacttttgcaaaaagatccagtgatttaatgtattattttataaagtgcaaattttttttttcattcattcgtttgtttcattttttagtcataatcattatatgatttaatgattcttatatttattaaatatcaaacaaatttctgctttttttttattctcggtttgaacctccataattgccggtgtattcgagaataaccttttctctgttgctcttatttcttacaattagcactagcttacaatttaggcataagtacataactcagacggatagccagagggatttgaccccacccctcccccacgcccaccgggaacagacgcgctcatagaatagcaccgcttccatttttaaattttggcgcgttttccattcgtttattacctttctcatttggttttgggtaccaagaccgtatcgtgactgacttgcgctacttcaacttgtcttgttcatttatcgccaattgacgagtaggatcatcgctatccaatgaatcgctaaatcacttgcatacaggttagtattaatgaaaaaacagcgcagagaccatggtaagtttatcatcggatagacagtgaaatgaatccgacaaaaaatgcgataaatgggacataacacatacaaacattcagccaaatggaaaaaaatcaaataaattaatatattgtcccattaagaatgaacatttcattgcggacattagcgttgctcccaaattatcaattggagcatttagcctaattgtgatggccttctaattgtgcacgaaattgccagaaataattgaaaatccgatggaaagatggattaaagattgccctctgtatgcccgtccccattcacttgccgaatgtaataaaaacaacgccccatctccaaaaccaacgacgctaatcatgcttttaatttaatatacatacaacttaaaaatgaattaactttccgtccttgtaaaaagattctggctggccgcaattgaagtgaatgagaa

SEQ ID NO: 34058 - DNA, 860 bp, Heterodera glycines
  misc_feature (5)..(5): n is a, c, g, or t
ataantttgttaatccaaaaaaactaattaagagacgaacaaattgcgcagccaaaacttagcgattcacaatgagaaacacgacatgcaactttcacaaaacaaagaggtgcggaaacactttttaagcatacaattagtaatttgcgattaatggaattatttaagaaaatagaacaaatccagcgttcgtttgatgagctacaacacacgagtttgtttaagctgatgaaccatctcaagaaaggtaggaaaaagttaacgaaaaggaattaaagattagaaaaataaaaataattgctctaagtttaacacatctgaaaatttttttacagttttttcttttatttcagggggatttccccccccctcgccccctcactctcgctacggaactgctgctcattcaatttatcttacctttcagatggaaacatccaaacactgcgctttttgcgagacttacacaatcttttgggttttgaattcgttggaatagattcgcacggtaaagttgaacaatcgcagcacggcgtcgttgaaaacgtctcggtaaggatccgattacatagttatccaattggcagtaacaatacattcatacataagaatggagtcacccgaaataattgcgaaggggtctgggggtggttcgaccctcttctattttttataccgattcattttcaatatttttaaataaagtccatatgccgacattgtgcaattttcgttcgacttttccagcatttcccagggtgatgatgcgcaggaagaagcaatcggtcaaaatcgccaagcttcttacgacagcattcaatccgcacaattggtaaaaatgccaatttatataactatcg

SEQ ID NO: 34059 - DNA, 812 bp, Heterodera glycines
agagtctgatcaatgggaaataaaaaggaattcttattaatttttgaaaacctttgaatgttctgattaaatttaattgataacattttttcaggaatgatggtaaatttctcaaattcgttaatttaagctatcgaagtttatataaatttaccaatttttagaaattaaacatttttttattattattctcgagaaaatctccccaaaatgatttcttttttttgtaaaaatttatgaactttagggggtcaaaagggccgctttataagatgcgaataaaaaatattttaaatacacaaaatatgcacataaagcaagcaaatattaccgttatggccttgtcaaagaaaagaaattaaattattgagcatttcgcaattttctttaacaagtcataaataaaaaataaaaaacatcaacctaattattacgatcgtttgttcatatttttcgagattgaactttcaattctgacaaatttaggtcatcccaaaatgtgtggaagccaaaattatttgtacaaatttaatttttttttttaatataaattttgtaaattttcaaaatattttatgcctaaaattaaaagatgtacaaatattggattaagtgaccggtaactttcaagaacatccgcagcagagatggcactgcacggaattccgatttcccacttccgaaatttaaggtaaaaagtcggaaattttcgtaaattcttttttttttttgagttttttgcgaattcaagtgttttatttaaattgtaaaataattaatttttgtatgaatttattttctacttcatcttt

SEQ ID NO: 34060 - DNA, 579 bp, Heterodera glycines
ggttctagtcggttttacgcgtcccatgacactttacgcgtccaatgacattttacgcgtcaacaacactttatcgtcccatcatattttacgcgtcaaaaaatgtttttcgaaccgtcaatcgaaaactttataccttccgaatagtctaattgttcttgtttgtatactttgaccatcgaaatgtgaaaaagcaaccctaagcacacttaatgatgtcaacagaaattcaactaatataagaaaaaaaattacaaaagcctaagctaaggcctagtctaaccataagccattgttcgagttgcctgtatatgagttgtcatgataaccttaggtttaacaacgaaatttttagttaaaaaaattactgaatacctgacaaaaaaatagtttgtctcttagttattaggacaactataataccatgagaccagggatggcacggaattccgatttccgaaaatttttggggcctcgaaatgccatccctgccataaacacaaaatgtcatgggacgcgtaaactgttgttgggactcgtaaaatgtgatgggacgcgtaaaatgccgtggggcgcgta

SEQ ID NO: 34061 - DNA, 1447 bp, Heterodera glycines
tccccacagttttcacatttttcatactctttgcaggccaatttcttgtgttcttcaaagcattggatattatagaagtctcgatggcactcgtcacagttaatttccgggcacttttccgcacatgggaacccgagtcccatccggcaacatttcttgcagcgctccttgcattcaattcggtgtcgttctttggtccaaaaggtcacttcacagctaacacaaaaatttttgacgcaaaaaaaccaggacaccgatttgatcccgtcccagtgattgccttctcttatcacgcaaacttcgtgcttacggacaccttcccccttgaaaattggcttaagtccaaatttctaaaaaaatgtaaaaaatgggttaatttcaagctaatttggttaccatttcaaaagccgcaatgcgaaacatatccgggaattccctgtcccaaaatttttgtacaacctcaaggtgttggaaccaaaagttttgtcacccatgctaatccctgatttttccatcagttcgatggccaattccatttgtttcttctccgtcttcatcagataacggaatttgttttccgttatacctttccctatgagctggtagcttcgagcaatttccaaagcataaaaaagacctaaacacaagtaaaagatcctaaatttgtgcggaatttatgggatttggaactcactaaatttcccctttggcgtattaagccgacccgattcattgatttgggcgaggggacaaaagcgagacattttatgaagggagtaaaaaaagccgttgagttgctactgcgagaaaattctttcgggaaaaatacaattttgtttaattatcagaaatatcaattaaaaattatcaaattaaaaaataaaatttataaatttatttaaattttatatctttggtgagttgtgtggggacatcgaaaaataaataaattcctgttctttgggccattggtagtaataaatgatctgagcgaaacaatcttctcatcatggaatagaacagacatttaacaaaggatgccaaaacaaaatttacgagcagaagccgatgtgtttttggagggggaagagcatcaattatttccttgatcatttcggcggggagcgggcagggcataattgtggcgaattttcaaaaaaagggggtataataaatgaagaattaaccgtttcgacaaaaccttattaatgcgaaaataaaacacaaaaagtaaagtccataaattgcaaaaagaagaaacattccgaaaatttcgtcatttcttttcgttttttcgtaatctttgtctatggtaaggtttagcatctaatttcttaaaattttaataatttttaaacaatttaggtaacgggatttaacccttatcaattcaaaaaattaaaaaacaacaaattttatcaaattggaattccattcattcattgag

SEQ ID NO: 34062 - DNA, 113 bp, Heterodera glycines
gaatcatcctgctgttcttcttcaattatgacttgattgagaggggaggggttgaactgtccgtaatcccctgttgcggatgtcaggattttgggcaagatttggagtgatgg

SEQ ID NO: 34063 - DNA, 634 bp, Heterodera glycines
aaatcaaatcttctcagggaatttttcagattaaaaatgaaagcaattcaatttcatatgcttcttcaatgaaaccaaatcaaaaacacaccgctttttaactatcaaattattttctcaaataacaaattcatttatatcattaacaaattcaaatgaaaaacgcgaacaaaaaatcattaaataatgtagaaaagtaaaagtaatttttctcataaaatcatgaacagccattttcatttttcttttattaattattttatataataaaagatgggttataaataaggaagggatgcgagacaaatttcccattatctctccctttcctttcttttactctcttttcttttccattgcaatttactctctttttttctcactccctccttctcccacacacacgcacgcgtccaacagactgctgctgcacagcagcacgcgtatgttcactgtatccccctctgaccctgccgctgcccgcgtagacagacaatcatacagtgcactattttcccacctttccctcgctctacttttttcaaattcattttaacgcaaaaattaaacaaaacgccacacaaattcaaacactggacacacaacagacaccaaactttttatataaggattt

SEQ ID NO: 34064 - DNA, 730 bp, Heterodera glycines
  misc_feature (66)..(66): n is a, c, g, or t
gttgatccaatattttaacagagatgcaaattaaatcctaaatacatatataactcattaaaatantgcggaaaaacatacttttataactgagataatgttggcaataatgttgacaaatatttattaaattttcgtgaaaaacaaacatttgctaataaatgtctagactgatatttgtgcatccgacaaatgttctatagataaaattcaaaaatataatttttatgaaaattttggcctaaatggattattattttttggcggatttacgaaacgccctggcggatttacgaaacgcccatagtggcggatttacgaaacgccctggcggatttacgaaacgcccatagtggcggatttacgaaacgcccacgttggcggatttacgaaacgccctggcggatttacgaaacgacctagcaccctttaagagagcaaaattaacttttgttttgtagaaaaaaagatattgttaacatttatgatatcaaatcattttaaattatttttttttgaacattgaatttgatggttactggaaaaattcaaaccgaaaatattataatgtatgatttattatagcttaaataatggcattcgtatcaagcattcaaaattgccgtagctgatcaaatacatgtattatatcagatggtacaaagaagcaaaatacagtcaatactagcatgaaataaaaacctgatcattttgtgtccataattaccgt

SEQ ID NO: 34065 - DNA, 1085 bp, Heterodera glycines
cgggggatggcaaaatgggccaacagtccccggaaaatggcaactcgtacaatataaagcctaagcgtaagcctagcctaagccattgtacgagttgtgatgccactttgtcccccgggggcgaaaactgtccaattcccatcatttcataactcactgatcgtttttccgtttattcttctgaattaaatgcgtttcctttttgctgctctgtccgtcgttttccgtcgtctggttttttcgttttaaaaaagtgatcggaagggcccttctcgcgttggcgaagttatagtcgagcagaagagcgacggttgtgggctcggaaaagggaaaagcattgacaaaggcactccgaaatagtgacggatggttcaaaatttgatttgccttcgccgctcatttggtcgaaggcgtggcattgtttgaaacatgcgattgtctctttgagcgcgggacacttccgtcccgcgtttgccctctcgcgcaccaccgcccgcctccgctccctcgtcccaactccgcagtttccgtcgtccgctaaacattccgtccaatcggaccatcggctgacctcacaatcggctgctgaattattattattattattattaaaaatgcattttatgataataatttacgtggacaagcttgcgcataattcgtgcagcagtcgccgaattcagcgcataattcgtcacaaaagcaatcgacgcccgactcggtcagaatttgcaatggccacggctcggacaccgctgcccattgacctgctccctcctcatttcctactgctgtccctccctcttcctcttcccattcttcctcttcctcttccgttctctcttccgttctcttcttctccactcggatgcgccgtttcacaattctcaacgacaaatagcggcttagcaaggagtatctgcacaacaacaaaaaatgcttggcattgccattaaatcggccaccaccgactgaccgtacgacgggcgactgtcgccctccttcgccgtcgtcgcccatttcgcgctgtttcgggcccattctctcccgaatttgcgcttcgtgtccaaatttatcacagtctc

SEQ ID NO: 34066 - DNA, 128 bp, Heterodera glycines
aacgaacaaacaattcgggggcatttgtataataataataaaaaatgaaatacgagggaacggacggacggagggacagacagaaaaaagggggagaaagaggggaaaggggggggggggtaaagggg

SEQ ID NO: 34067 - DNA, 1049 bp, Heterodera glycines
  misc_feature (182)..(182): n is a, c, g, or t
  misc_feature (346)..(346): n is a, c, g, or t
agtagtttagtattttttaaaaactttaaatttttatcatttgagaattgaaaaattgaattccgaggctgcgggggaaaatttatttggctggtaatttgtggtgggtcatttggctctggtgagaaaaattttgcaaagactgggattggtttatctctttaatttattaaacaatttantttgtcaaaaattctctatatgaaaaacaatgcttatttttctgttttattgcattacatttagttaatgtaatgcgcctttcaagattatatgttcttaaaagcaaattggttaaatgatagtcagggtgagttgcaaaaagcgtatgtgaaaataaattatnttaattaataaaaacgatattttattttaatattttgcttatttacctttttctattcaagcttattagcttccatatatttaaaattattatgaatattacaatttttattttagagtgattagaaattcccatatatatttaaaaaagaaataacaaatgctttaaaatttgcaaagcttaaaaattttcttgggaaaactcggttttttttaattaattatttaaatttcctttaaattattatctttttaaatcattaatactttttataaaatatcggtgtggtcgatatttgatattccttcggaaatgaatctaatttttaacacattttttacaattatttatctaatttattccatttaatactcggtgtattgaataaactattaatgacagcatctttacatactcgctagatttcacttattattgttttattttttatttgaaaattaatataaattttaaattgtatatttataaaaaaagtttatttatttctattttcaaatttggatattttgactagaataacttaaattaagcaaatttattatttgaaattatttaaaaaataattttgccaaaatttattaatttattaaaatgttagaaaaatatctttagttactaaaagctaatatttatatatgtaatcttattatctgagcttttttaataaattaattttataata

SEQ ID NO: 34068 - DNA, 724 bp, Heterodera glycines
ccaaattttaccgcactattccaactcatcataaaactttccatccctcaaaaatgtgcctcactcattttactctacttctccaaggcttaccgcactcttcctatcaactttaaacggtccgccaaattttaccgcactattccaacccaccgcaaaactttcttattcttctaaagttatccgctctcaatttaccctactcctttaagacttaccgcactccctatttactttcgagaacatttaccgcactcccttttcctacaagacagtagttaccctccaggtttcatcgtcacgtgtgaaaatgattaatgggttccgaacttttctttgcactctctcacaaattcagcttccttctcagcattcccttttatgtcggcagcaaaccctgatgcttgtattttctgcgacatgaattcggctatgtaggggcgaaacagctggtcatcgctacgctcatattccaacacacgaaatactttggtgactcggtaaccctcttcaagcgcagcattaagttcgattgaagtgcaggtgctcacccatcctcgttgtttgtcgttatgtctacagatgtatttccgttctatcccgccttttggatggtttttggtgcacttcatacataacggaaagcagagcctgtcgtccactttgacgggcaggactggcacatcgcattttcgtggaggaatcacccaaactttgagaattg

SEQ ID NO: 34069 - DNA, 809 bp, Heterodera glycines
  misc_feature (685)..(685): n is a, c, g, or t
tttccactataactttctacaacttttttctttgtcatccaaatccaacattgttggtatgattcgaaagcttaatgtatttagaaactttttctaagctattgcttcgcgattagacaagtatcaaaaaagttatacatgaaaattaagaaaaactcgaaattttaaagttttttcttaataaaaatttttccaggcttgaaaatcttttcgctttttgtaagactaatagagatataaaaaagctatattggaaaaacgtgctggcgcccaaccgtgagcgcccaactgacgggttccgcttttcgatatatttttgtaattaaaaaataaataaatattaatttcacctgcctttttaaaaaatgctttacctttcaattgtgccgtaaattcagcttttctcatcagttctccaatggcattttcatgcaaaataaacaaaaactgcaaaaagttttccccctcacacaaattttttgaattaagcgttattttatcgccaaaaattgaatttttcatctcaaacaaaacaaggattagctgagtctcgttttggaggagctcatccactgaaagcgcttcccttgcgccgttcatcaaaagttccaattcggccaaatgattatccaattgttcgctttttccgtcggcggaagggcgcaaaaggggcgcatttttcttnaagctaaaaacaaaaaaaaaaaaatttaaataatttttattaaaaaaagaaacaaattattttaaaaagtaccactgataaaagaccaaatgttcagcaatatttgaggcgtgtcttttggttt

SEQ ID NO: 34070 - DNA, 723 bp, Heterodera glycines
tggggcatcggaattgcgacttccgacttccgaaaatttttggggcatcggaattccgacttccgacttccgaaaatttttagtgcctcggaactccatccctggttggtaagagagacactctctagtcgaatgacacaaagcaatggaaataataccaattaaatgcaactgaaatatatgaacgagcggggaagcctttgagggaaaaactatggggcgggccggctttgaaccggcgtctctggctttccggaccagtgttctaccagctgaactaccgaccctgccctctccagctccccactttgctcgatcatataggatcaattgttgcctcaattgatccattaatcttcctctcgggaagcttcttcttctctatctcattccgggcctctcttatggacgtcctcgtccattcttcttcttctctgcgtcagctgctgctcggctgaaggttgcagattcgatcacttccagtgccagctttatcctctctcttcattttcgcttctctgctgctgctgggtgaactggaagccgccaagggtcgccatgaaatatatgaacgagcggggaagcctttgagggaaaaactatggggcgggccggctttgaactgtcgtctctggctttccggaccagtgttctaccagctgaactaccgaccctgccctctccagctccccacttttctcgatcatataggatcaattgttg

SEQ ID NO: 34071 - DNA, 821 bp, Heterodera glycines
gtgactggagcgcccgcgagtggtcacattcttttcaaatcacacgcgtgtgatcatgtcgcaagcgctcacattatgttcagatcacatatcatttatttaatgcaaaatgagtgctcatttgtgttggatttggtccatgcctatttcttttaaaaggtctggtgaaggattttctaagtgaatttcccgctcttctaattcttggaggccaactaatctgattaattggttcttcatagatttctccttcttgctgaattttagtttccctcaattttcttacccttttcccagctttctgaattgttgtaccaaataaaaattgcctaagcgcccattccctgcataaatttcacttaaaccaattgtcaatcttatcgccaagtcaattgacaaaatggtgagaattagagacataattattaaccatatttttctgtaatcaccaataactgctttgaccatttggctttcaacctcttcccattcctgagaaattgaagctgtgatttttgtgtccttttcatgaatctgataagtcatttgactcaatttgaccatgttgctcacaaaagcataatcttttatgtctgttagatttaatagaataatttgtgaaaagcatgtgcttctatttaaggaagcaaattgttgaacccaaattttacttcgtgatgatttaatttattcgggcttaccgaagtaatttttccttctatttggtcaatttctaaaatttgaccttcaatttgaattataatttttctaaatttctcacaggtaccttttcttgacgagggagagactatcatcgacgt

SEQ ID NO: 34072 - DNA, 513 bp, Heterodera glycines
atttttcagttccgtctcgaagattggtttatttttcgaaattttcatcacaaaaagtaaaattttgccttaaaattgtaaaaagtcaagaaaaaaagtcacaaaaacgcaaaagtcataaaaatcccaaaaagtgtaaaaaagtcaaaaaaagtcacaaaaaatgtatgttagaagcttcaaacaaagtgtagaacacttttgaactcattttaaggtcatttagagtcagcaaaaaaagtcatttgacttaaattcccatccctatttattcctttgttccgagaaaagaagggcaaacaaaaaatcttttcacaaattcaattttatgaatgttattgagaaatttaagtttaatatagtttaatatttaagcacgggtgacacgcatgcccattcgccaagccctcgggttccaactgagcatgggtgccacgcatgcacattccaactgagcacgggtgccacgcgcatgtgccggtagctgctactgcacgaacatccagacacgca

SEQ ID NO: 34073 - DNA, 1141 bp, Heterodera glycines
  misc_feature (1079)..(1079): n is a, c, g, or t
  misc_feature (1135)..(1135): n is a, c, g, or t
ccccggaaaacaaaaaaaatagatttttttcaaagtgtccgtttgggggttctcaaacagattatggggagcaaaaaatccaaccccagaattaaagtacagatataagggaagctattcgcgaaggattcggtctcccattaaatctgggcgcatcggttcggggggactgcccggaaaacaaaaaaaatcgattttttcaagtgtccgtttggggtaatcaaacaattatggggagcaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggacctacaatccaacgcagaattanagtacaggctatagggaagctattcccgaaaggattcggtctccccataaatctgngcgcat

SEQ ID NO: 34074 - DNA, 578 bp, Heterodera glycines
gattctctctttcttcctctttctcgtcctctttctcttccaactttctctttctcctcctctttcccttcatctttctcttcccctttctcatcctctctctcttcctctttctgttcctctttctctatgggataagctataattatacaaaagatttagtaaaatttttatcatagacatttattggagctgagcgaattatttgttattatggttcctttacatcggaaaatagtatggcataaatatttattttttgtctccgtcggcacttttgcacgtaccagcaggtgtattcgacagtggttgatttcgacagtagttgtaaattcttttttctatataatttacgttcatatgaattaatgtttaatataatttgtataaacaaaacttataatttaagtaataatgaattaaatgataatttatcaaaagatatatcgctttcacgttttctatacaaacatttatgtgcactcaaaaacctaacaaatttcctagattcttgaatcgcgtgggaaagtcctactaactaaatcaaataccgggtttgaatgtccagatgcgaacct

SEQ ID NO: 34075 - DNA, 926 bp, Heterodera glycines
acttcgtcctctgaaatttaatttttattttgctcacactttcagcattcagttcaccgttattccacagcaatttcgtttccttcaattcggacttcgcaagtttttctcggcattccttaaatataacaaataattacagcccaataaataatttgtaatttgtgttcatttcataattgaatggttttggcaaaatgccatcaaattgttcgaggaataggtcggccctttctccttttaattttatatcattggaaaacctttaaaaacgaatggaaattttgaactaaattttccataaatctttctctgtttttggcctcccctcccctcccgccgcggtttgatcatttgtccattcaaaaatggcccaccttcagcagctgctgatcagtgacgaacagttcagctgacaattgatcactcaaatttccgtgccaactgaacacttcgtatttgcccacttcttctgctgctgatgctgctggtgctgataaaagttagattttgaatttattttatttttaataattattttcttttttcgtaatttttttaaaatttttccattactttgatcagttgttgaacggaaaaaggaatcggacgaaccgatggatgatgccattgttttaattaaagaaaatgtattgtgctatctagaaaaatgttaaaaatttataaattaacattcatattaaaaagaaatgtaaatttggaaaataaaattcatcactgccaaataaatgaatgaacatttgctgttttgcgctgaatctgttcgccttttataaggcggcattggtagacaaaaagtaattaggcaaatttatttgtgacctatcaatcaattaaatattcactttcaatgaatagtttaattcttttttggctttttttgtcgagcaaaatgatacttaaaa

SEQ ID NO: 34076 - DNA, 739 bp, Heterodera glycines
ggtataagggacaattttcaaatgaatttccgccgggcatttgtcggattatgccaccagcagaagaaagaattaataacacagagattacggatcacggcatttataaatgcttccgtataattacggcttatccgtcttgtttagaatttgatcaggtccacctcgtttagcaccttcccaatttatggttttgaaatgaaatccatctgtcagtgtcttcatttgaatgcatttgccgggtggcacattacaataattaagcgcttaattgaggctggaggggagaattaattttggctacgcgtcacttaaaatttcagtgttttttttgcttagagttttcacctagctgtacttttttaaatgtctggtcaatcaatctttggttaattttgggttcactttgcagttaattaataatacgctttaaaaaacaactgcacaatgtaagttgagtaggttccggtattcataggcttacggtatgtgatacagtgtcataggcaggtgagaatcaaaacatttgtagaccaaagccaaaatggtggaaataccaccccataaatcatcaacagagctcttttctgcacctgttttgttggattggacgaggggtgcaatcggcttcaacaatttgtgggtgtggcagtgtgtggggagaggaaaagccgtccgggtgaatgggctgataacgaccatgaccgcctctccggggaaagtgatatgcctttttggg

SEQ ID NO: 34077 - DNA, 651 bp, Heterodera glycines
atgaacgtgaaaaatggcaagagaaaaaataaacaatatgaaaaacatttgcttaaacttgtggcaaatttctccaacgaagggctcgatgagctgaccaaactgaaaagagacagaaaaagtcagttgataccgtaagcgaaatcttaagttcaatagtaaggatgaatttcaaaaaaaaagaaataaaatttcgcttaaattttcaacataagccctacttacactgccggacacaaaccctatcaaattgttcaaattttatttaaaaatccattaatgtgtcattttcggctagttaataaatctatctaaattctttggtttaccacagagcagccaatttaaaaaaatacagtgataaaaattcgggaaaaaggcaaaaaaattgggtccccccccccccccccccctcggcgagcttgaacatatttaaagatttttgcgcagatggtcgaagacgaaagcggaatccaagcaacaacacaaagtccaaacttgctacagtaatcgttatcgtagtgatgttgatggcactgtcattgtgcgtgatcaatcactgtgacaacagtgggggaagcgaaaattctgatcaaaatcatcatcgacagcagcttcaagacagtgacgcaactcagacatcgaatggta

SEQ ID NO: 34078 - DNA, 1524 bp, Heterodera glycines
ggcactctttcctcttttcgcttcttcgaatcggatcggtcattcgtccgactcggcgcccaacgtttttatttttcgtgggtccttcgtcttcgtaggcactccgtccgtgtgcttttttttttctttggatcctttgtcactgcattaggcatatggccatgtggatattatgtgtctatgtgacgaggaggaggccgtggcacttttgcaggcggcactgtctccgctccgctgttgtgttgttggcttggcttggtttgatgcgctaggcttgtggcggattgggtcggggtcatcttttcgccccattttcatcgtttgccgtacatttggtggcttggatatatatatatatatatatatagctgctagccatagccaccagtgttgtcattggtgctgcacaaaaagccccccatttctcatccgccgttgaccccaccccatccaatgcccattaattttgccgcggtcggccgacggattcgaaataaggaagggtggtgaccacaaagaggtaaggatgggacgaatgggggaatggcacaaaaagggacaaatgctgggcgatgaacaaaatttggaaataaaaaatcaattaatttgcttaattattgaaataaaaaatggtcattcgaaataacaaattgtaaatgttatccattaataggttttcctgcataagctagacctgtacatcgatttttttatatccgaccttgacctggaaatccaagtcctggaaaaacccaggttgccaaaagatttgagtgcagggctcggcgtcggcatttcgccaattcaccaatgctttttatttttttgttgcgatccaaatgaatgaaagaggattttgaaaaattgaaatttaatttagaaaatttatataaaattcctcggatttaaaaaatatataaatattgtatgaacttttttgtggatgaatatgacttcttcgttgtctatgatattaatatcccgtaaaatagccaatatttttgggggtcgacaaagaaaattcgtgaaacatttgttgtaaaaatagtcaaatttatcgtcaattagggggaggaacatggaccattagatgatggtgagcacaaaagtgagacagacagttaatgaacattggttggcggagtaaattctcatcatatcaatcgggcagatcaccgcagcatgatggcattttgggcgccacttttttcaaacatttttttggcacatcaaaggaatgaaattttaaaaaactgtcgataaacggacgggacgacacgggcgagtgaaaaaagaatttttttttttttttgttagccaaatcgcagaaaatttgggttggcctggcggtactcgcgcgtgaacggcgtttcatcatcgtcaccagaaatgagcattgctagatgtgttgatgggttttcggggtaaaaaaaagagttatgcccatttaaaattaattaaggtataacccatttaaatactgtatgtatgctctatccatcagagtacggtatattgaaatga

SEQ ID NO: 34079 - DNA, 1690 bp, Heterodera glycines
  misc_feature (54)..(54): n is a, c, g, or t
tgatcagtcctccttatcactttatgataagaaggacgacgacgcatccgactntaagccggagactgtgcgggggcatgcccgagtctgtgcgccggttcaacgcagccacttcgcactcgatctcatcgatgtccagtgggcggtcgtcaaggggcttatccgtggacaagtattcccgcacttgacctggcacattcgccatcatgatctcgttgacttcatcacacgtgtcaatgtgcggagcgagaatcaaacgattgagtagctcgttgtcattgccaaggagttgttggaagttaggatagacataatctatcagctcttccttgctcttaacgaggaacttcggaggaatccagaagtgctctccggtttctccaagcccgatttggcgggccatttgcaagtacgcttgctgaccttggcccagtctctggttgatggtcaatttaatcgtggtgaattgaccaaacaacggagacttttgaaactttgcacacacggtcaatgacctctatcaccgtgttgtgaagcatggtgatatcatcaatgatgatgagttgtgcctcacgaatccgtcgggcaaataagctctccagcggaatgcttgggagtttgtctaatgacacttctctacccagacgaaacgtggaatgggctgttttcccatatggcagcaaaatgactgcacacccagtggatgccgtagcaagcactttgtaggtgtatggggcctttcgcaagcgcctaataatcacattataggctttctattaaactagtcaacgagatgccatttcatttccacgaattcgaagtttttcaaaaaataattattacattaaattttcaaatattattattcattatttaaaatgaaattttttaattgttatcatttttgtgataggaaaataaaattatttgttttgggtttagtttattttttatgggtttttcgtgaaggatttttatattattttcgaaagtatttattcgtgcgatttattaattttatttaagttcagcgaaatcttttctttcaaaaggttcagttctcattacgattgttgtcggcgcatataatatattaagtgttattttattcagctaaataatatttgcattttaaatcgagatataaaattagttttaatcagggggttcttcaattatttttggattttttgctttgagagttctattttttgcgaaactattcatttatttgtttttattagttgctatttttatttttaccatttaatttagacactctcaaacaaaaatgttattttctatcaaatgaattaattttttatctactaacctatgatgaagattgattggtaaaagatttcaatctgttttgtcattgtttatttgttatactgaagacattattgagtacagcagaaattcatttttttaataatattttatttattttaaatgcaattataatttgatataatcatcagttattggacttcattatgatgtatattttgcttttaatgtagtctagactaatttttaataaaaatttaatcaatttaaaatttctctttatataataatttgtttaaagttcattgttttatacaattaaacgtttgaaattctcataaatcttacaagataagttagcgaaaaattttaacatctgtgcaaaaatttttttaag

SEQ ID NO: 34080 - DNA, 1019 bp, Heterodera glycines
ttttcaagggtccgtttggggtactcaaccatttatggggagcaaaatccaacgcagaattaaagtacaggctatagggaagctatccccgaaggattcggtctcaccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaatttattcatctccctttttgatagaaaaa

SEQ ID NO: 34081 - DNA, 800 bp, Heterodera glycines
cccgtacgggtccattttccaagtcccggtcccggccatttcaaaattccgggctctaataaacataggtacgcaaaaaaagaaaagttgaagggtcgcaacttttctggtacatcccaattgtttaacaattgcttagtaaataaaaatctttcctggggttttcgggttcgctgatcacggaataaaggatatccttggctgattaaaaactaaaaatcttcgcctttgcaggcttttcctcttgcttttgcccctcggtttcaccgcctcagttttgatacttcgatttaatttggccattaaatcaaaaaaaatatttttttgcaaatcttaagttaaatcacgaaaatgtgtatttattataaaatggctgtattacaatatatagaatttttttctctatcgacatgctaaatttaaagaaattctgtatgaggaaaaaaaagattcttagagcgaagtgaatgttgtttttccttatgtaaatgcattttttcctggcttctccatgtctaaatagtaggaaaaacactttcttttttgtgtttgcgtataaaaatcgagacttttatttgcatattttggatgtttatgcatattttgggtttttctggacatttcatgcatattttgccattttttgtacatattttctgattttagcatattttgccatttttcgtcaaatattttccgatttgaatatatattttttatttatcgaacaaaccacaagatgggtcaaattaaataaacgattgatataaatgaaagaaaatcacacctctcaatcgaga

SEQ ID NO: 34082 - DNA, 1257 bp, Heterodera glycines
  misc_feature (67)..(68): n is a, c, g, or t
  misc_feature (109)..(109): n is a, c, g, or t
ggaattcatcctatctgacatcaaaagacttcgtgaatcttacatagggtcctgtggaattagttgnntttgggggtaacctgaacttgagagagtgaagggaattggngaccaaaaagtggaaaaaatctatgtacgtttacaaatgaattcttacattagaaattcgatttacgaaaacaaaacaaagttttcccgcttttgaactcatttaatttcagacagaagcaaaaaaattagttccgatgtcatttaccctcgccagtgtcatacattgcaaacgttcgcaattaattctcattgaaacgggaagtcgtgaattgaatagactccttggaggaggaattgagacaagttcaattactgaggttgctaaatcaatccaatattcccatgagattaattggaaatccatgaaaagtgggccgtaaattagcatagtgcgcgtgttgtaaaggaagaaatggagggaaaaatagaacctaaatcaaaagtccatgtgattccttattttccaggtttttggcgaatttagaacagggaaaagtcagctttgccacactttggctgtcacttgccaacttcccgttgacatgggaggggcggagggaaaatgtctttggattgacaccgaaggcacttttcgaccggaacgattactcgcagttgcggaaaggcaataaaaataactgtcaagtcggaatatgctactcaacttaagattcaagctagatggacaagccgtgctcgaaaatgttgcttatgccaggtgccataacacggaccatcaaatgcgactgctcatggaaggcgcttcaatgatggcggagtgtcgctacgcactcgtagtcgttgatagtgttatggcgctttaccgaaccgattacaccggccgaggcgaactctccgcccgtcagcagcatctcgcgtgctttttgaggggccttatgaaactggctgaagaagtgcgtttttgttcagatttggtttttacagatttattctgcttccgttttttctcagtttggtgttgccgttctggtgaccaatcaagtcgttgctcaagtcgatggcaatgccggaatgtttcaaacggacccgaaaaagccgattggagggaatataatggcgcattcatccacaacaaggtaaaccaatcatcagtcagcaacataaatgaaatagtaggggaggggggtcggtacttttccattatgcggccacaccccaaaattttaaaaaaagagggggaaagcg

SEQ ID NO: 34083 - DNA, 124 bp, Heterodera glycines
caacaccatgtgattactacggcgcagattgcgtgccgatcaaaagtttattgttgaaaattgaggcattagaaaactgctatccgggagcaaaaacaatgcggtaaaaacagaaaaaaatatt

SEQ ID NO: 34084 - DNA, 1279 bp, Heterodera glycines
  misc_feature (1161)..(1161): n is a, c, g, or t
  misc_feature (1228)..(1228): n is a, c, g, or t
tgccaaaaatgtcagggcacactcaaactattggcatttttaaataattaataaaagaaaacttgttaatggatttgaaaaaatgccatttcccgagttggcgaactggagggggggggggggggggaaactgcctaaaacttgcggttggcaagcaaataaatatgaaaattaaaaacgtgcaaatgagtttggcttcgcgagactgaccaatgctatgcaaaccatacctttagccatgttttctggttttcttctgaaaaagtcaatcgaacttccactccaaagggaaggaataaataagagaactatttttctttgttttttccgatttttacaatttgattgtgacattgtatgaacagacgaaatgagcaataatctttttgtctcgaacatgatcagaatttctcttattaagtgacgtttcctgttaacgattgcttcccattttgttgcctcccctctgactctgtgctctcccggtctgtcaacgcgtcgtccgccggcggcattttcagagggacaagtcgacggtagaagaacaaccaaagggcgatcatcaacacaatttcgcccatttccaccagccaaatgacacgagggccattgttagtgtacataaagctgaaagtattaaaaatggaattgagaattcaatggcgcgttaaagcatttattatccgactcaaaactgatcaatgtaatcagattcaagactctcgactaccccccgtcaaacccgatgagtagcgggcccaacattcgtccaaaaccgccgaacatctccagcattccctgctgcttggattgcattcggggcccaatgatatgcgagaaaagtgtgttcatcgttatgttgatgtttgagaaggctattcctatgcaagagctgatggcaatctgtctagggagaggaattttcttaattttttttctaaatattccaatttctgaaaattatgcacattaattttgtgtcaagttttttttttggattattttttcaaaacttacgtaataaatccagatattgacgcgggtcatatctgcacaccaattcaattggctgatatcgcaacccttcgaggaattaactgaaatcgaaaaattacggttataattaaaacctcctaatgacccaaaatgatgctaacctanagtgccattgtaggagtggaccttttctggaaaggatggccaagaaaatgtgaccaaatggaagaanaggaggacaaacaacgaacacagacagcacaatcggtcgttgactctgatc

SEQ ID NO: 34085 - DNA, 754 bp, Heterodera glycines
  misc_feature (96)..(96): n is a, c, g, or t
  misc_feature (113)..(116): n is a, c, g, or t
  misc_feature (119)..(121): n is a, c, g, or t
  misc_feature (150)..(150): n is a, c, g, or t
  misc_feature (157)..(157): n is a, c, g, or t
  misc_feature (165)..(165): n is a, c, g, or t
  misc_feature (176)..(176): n is a, c, g, or t
  misc_feature (192)..(192): n is a, c, g, or t
  misc_feature (200)..(200): n is a, c, g, or t
  misc_feature (205)..(206): n is a, c, g, or t
  misc_feature (210)..(210): n is a, c, g, or t
  misc_feature (266)..(267): n is a, c, g, or t
  misc_feature (275)..(275): n is a, c, g, or t
  misc_feature (292)..(292): n is a, c, g, or t
  misc_feature (295)..(296): n is a, c, g, or t
  misc_feature (312)..(312): n is a, c, g, or t
  misc_feature (331)..(331): n is a, c, g, or t
  misc_feature (333)..(333): n is a, c, g, or t
  misc_feature (353)..(353): n is a, c, g, or t
  misc_feature (358)..(359): n is a, c, g, or t
  misc_feature (380)..(380): n is a, c, g, or t
  misc_feature (386)..(387): n is a, c, g, or t
  misc_feature (392)..(392): n is a, c, g, or t
  misc_feature (407)..(407): n is a, c, g, or t
  misc_feature (432)..(432): n is a, c, g, or t
  misc_feature (439)..(439): n is a, c, g, or t
  misc_feature (447)..(447): n is a, c, g, or t
  misc_feature (452)..(452): n is a, c, g, or t
  misc_feature (481)..(481): n is a, c, g, or t
  misc_feature (486)..(486): n is a, c, g, or t
  misc_feature (494)..(494): n is a, c, g, or t
  misc_feature (505)..(507): n is a, c, g, or t
  misc_feature (527)..(527): n is a, c, g, or t
  misc_feature (539)..(539): n is a, c, g, or t
  misc_feature (559)..(559): n is a, c, g, or t
  misc_feature (587)..(588): n is a, c, g, or t
  misc_feature (597)..(597): n is a, c, g, or t
  misc_feature (604)..(604): n is a, c, g, or t
  misc_feature (629)..(629): n is a, c, g, or t
  misc_feature (634)..(634): n is a, c, g, or t
  misc_feature (643)..(644): n is a, c, g, or t
  misc_feature (650)..(650): n is a, c, g, or t
  misc_feature (659)..(661): n is a, c, g, or t
  misc_feature (671)..(672): n is a, c, g, or t
  misc_feature (684)..(684): n is a, c, g, or t
  misc_feature (693)..(694): n is a, c, g, or t
  misc_feature (700)..(700): n is a, c, g, or t
  misc_feature (724)..(724): n is a, c, g, or t
  misc_feature (728)..(728): n is a, c, g, or t
tctgttaaacctcaatttcagcaccatcgcgctcaatctacaatgggtccgacaccatccaccaaatcaatagtaccaacatcagacgcgccaccnaaacccccacccccggnnnnccnnnccgcaaaagcgacccccagagcaccgacnccgccangagacgcnccaccgcgcanagaaggagaggaaaanaaaaacgncaaanncaangcgaagccaccaccaccgccgacagcagcagcgcaaagggacccagcgcgcacganncacacgcncgacccaccaagaaganagnngaaaacgccgccagcnaaccagaacccggggaacnangcgccgaaggcggagacagnacccnngaacaaagaagcggaacgacncaaggnngcgcncaacgaggaacacancaggcaggggaccgccacaccgcanacgggcnaagaccanggganacgaaaacccccagcaagaggaggcaaangaagnagccaaanacggacaagannngcgaggaggcaccacaagcngcgcggacaacncaaaaggacagaccgagaanaagaacaccgggaacacagagagcaccnngcaccgggnagagacnaccagcggagccagcccgggggacnacacngagaagaannacgacncaccgagannngcgcgagggnnaccacgggaaanaaacgaaanngagaangaacggcgcacaagggacaaaggncganagggggccgacgcccaagggacgacg

SEQ ID NO: 34086 - DNA, 1071 bp, Heterodera glycines
tatctagtcagttcatttaaataatttttatccaaatttttttttttgggttttcggggcagtccccctgaaccgatgtgcccagatttatggggagaccgaatccttcgggaatagcttccctatagtctgtactttaattctgcgttggagttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaagtctgcgttggatttttgctccccataattgtttgagtaccccaaacggacacttgaaaaaatcgatttttttgtgtcataaatatttttttcacaaagcgctctacagcgcaccaaatattatttacaacttaggtttagcactctgatgctttttctatcaaaaagggagatgaatacatttaaaaaaattttttatttctttttaaacaggccaaaaatttaagcttgtgtggtagtgtgaaggactgtgttcctccaggcaaaaaattctacaaaatttataagaatttgaagggttctcaccaggtttccccggaaaattttggtggagtttttgaatagtttaaaaggggggggggaccaaaggcaaaaaataatttaaaaaaaataaaggtgggggggggtaggggggaaaaaacgggggtttccccc

SEQ ID NO: 34087 - DNA, 895 bp, Heterodera glycines
ttagccaatgaggatgttcaatttaactacgacagtactgttcaaaaatttattgtctatctttcctctgacgtcacccatatagatttgtcaaaacacctcgcatatgttctggggtttaagaatacaaggctatttcacgcggaagaggcgacttatatgccggatttgacgggaggtgtaaggcagctatacatttatgcaccaaatttaatcgaaaacacaattatcggcaaccggatggccccactcttaagaatagttaacgtcgtcgatgacccgggatcaattagtgaagttatatatagcaccgagtattttcatcgtctacaatcgaaacgaatttcagaaattacaattgaaattcacacaccgtttggtgaattcgttaaatttcactggggaagttgtattcttacattacattttaagaaaagtatattttaaaaaatgacacacgtatttttcgatcccgagtcggtcgattggtcatcttttttcacttcacaacatgggaggggacagaagcaatactttgtcggaagcaagtatcaacggggattcggtttcctcggtaatgtggcacgtttcttgacccctattgcgaggaatattgcctcgagtgcaggacatgaggggttcgccgcggggcagagagttctgagtgacatcgctcagggccgtgatttaagggatgccgtcagggaacattcaagacaggtgttgactaaccttaccgactagttacaacaatgtgggaaaggagaaaggtctctgatcactaataagaaacggaaacaagtatatgatcagttaaagttcatctaagggtataattgggagaaaaaatacgaaaagttgaaaatgaaaaccttctaaaaaatcgacacggcga

SEQ ID NO: 34088 - DNA, 623 bp, Heterodera glycines
tttatttatttttttcctaatgaattcttaaatattttttcagaaagggctctgaatcgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaagggcggggggggggcgggcaataaaaattgcaatttgcccttttgaataaataattacactatgaaattgtgtcgtcaatataacgcagaaagaggaacccaccaaagcagtaccgcgccagatgccccgcagccagcgcacacaggaagaggtgcacgtggtgaaaacgagtaacatgctgtgccaaaatgagcagaatgcacttcggctccactaccatttcagacaaatcgtacaaggatttcacctgttgatacaagttcgtacaacacggatactt

SEQ ID NO: 34089 - DNA, 582 bp, Heterodera glycines
ggcgaaaatttcagtgaattttttgcctgaaattcatttttccccaatcgtccccgcccaaaccccccgcaaaccacaggtcaaccaaatgacgccgcaagtgatcagcgcgggcaaaatccgcttgcacaacgacacggacaacgcaacggcgcactttgagaatttgcgcaaggagtacgcggacgcgctgaaccgcctccgcgcgtatgtggacgacgcgattgacgcgggcgaatttgtgcgcgccagcgaaggcgtaagcgggcggaggcggggtcaaatgaggggggggggggtggtggaggtgtttggaatcgctgagcaaataatgaggaaaattacttataaatacgcaaggatgggtatgaaacggatagagagcaaatactgtcactgtatgctaagaatcattcctgaaaggtacaccgcgaagacggattacagacgacgaggatccgaatagagaggcggatcccgtgcattatcgacacatcggttgaagacatccgagctatgagtcttgccattgtggttgtgcgtcaacaacagttgctcattattgagaccaagtagtttata

SEQ ID NO: 34090 - DNA, 835 bp, Heterodera glycines
ttatatgcagagagtctagcgcatatatgtcagcgcctctcggatgactaggagcgttcttactggtctccgacacctcctgatagcggcttcccaatggcatagctgatttttttggatctggaattttcgcatagatatatgcaaattagataaccagtgcttcatttcaattatttctcgcattctaacaaaataattttttactatgagtggttggtttggaacctgtctaaaatgctctcggctcgccctcattgccactattttcttgacaataccatgaaaagtgctctaactccaagagacttagttgagcgcactgcaaggagaaccctaacacagatcatcgcaaaaaaattaactattcacgcttgagaacgcgaagtttgctgcggagaatgtgaattatatgtctgaaagaaccagaagcatatactctcagtcgcctagtgcatgagtaggagcgtttttactgatttctgagagcgcctgaaagcaactttccagtggtatatctgatttttttggatctggaattttcgcatagatatatgctcaatatgaaccaaagtttcgtttcttattatttctcgcatactaacgaaataatgttttactatgagtgattggtttggaaactgtctaatatgttcctggtcgctccacatcgtactactttctcagaaactacctatgtacccctgatctatctccttcacactcatttgcgcgcactgcaaggatgaaccctaacatctatcagcactagctcattaactattcacgcttgagaaccctatggttgctgctcagaatgagctttatatgctct

SEQ ID NO: 34091 - DNA, 1009 bp, Heterodera glycines
agaggaaaagccgagcgtcggcggcggtgccctcgattggatggacccggtgacggggtagccaatagccaagcggcaattaataaacattaagagtcgcaaattggcaattaattgaaaataattaaaaaggcacaaaaatggtaattgcagttaaatttcacgcagagattacattcggccacaacagcagcagcaacagaaaatcgtcgattgctttaccatcgaagtgccaatgccgccgggggatgcgccgaattcggaaaagtgcgcgacggacgccgggagcagtgaaaggcgcgaattacagagaaaagtgaacatggaaaaagcaaattaattccaaaaaacagattaaacaatattttaataacaaaaaaaacaagaattataaaaggcaattaaaataatttaaagtaattagaaagtctcaaaaattgtttaaaaattaaatcgattgaaagtggtctcgtcggattgtgcacactttgagtaaccgaagtcgcgacgcggacgatgaggcggagcagacggacgacggggcgaacaattgcctatttgggcatcaggtggaaaatgacctaaggagggaccgtttgagagaagtttgttgaagatacgcttcacaataatggccatctgcacgctgtgtctgtcctccattttgtccaacattttgactttcaacttcacttacatttgcatggcgggcgaaaagccggccaatttctccaatatgacaggcatttgccatttgttaattggctttttaattggatcccgagcactttgttcagaaccttccgaatgggtcgttttcggctacaacccccacttgcattattcgagtgcggcacgcagtgcccttttcatggttgttgccgtcggctctcttctcaccgttttccctctcaccattttgctgaaccaaattggggtcaagggcaagcattgactgctccctatgaaactgcatgaccaatgcttttttacatcaaaggctcgtctt

SEQ ID NO: 34092 - DNA, 985 bp, Heterodera glycines
  misc_feature (829)..(829): n is a, c, g, or t
  misc_feature (866)..(867): n is a, c, g, or t
  misc_feature (937)..(937): n is a, c, g, or t
  misc_feature (964)..(964): n is a, c, g, or t
ttattatttttaagtttacaataactctaatcccaaatattatcaatcaaaaaattttagtgtgctgttctcgcggccatgttttgcgttcgccgcccacgtcgtcgtcctcaatgctcagatccgatcttgcgcagttatcgtcgtggaaaggtgaaaatgttttcaaaaaaacgtaatttaaacttaattgttttctttccaaattacatttttttttgttctatgagtcaaaatttttaaattatttgtttataaatatttttgtcctttacaggagcacgtggtgctcgaattggggagtccgatggcgatccgagataatgacgaggacggggcaaacaaagaaattatcgatcaggaattggagggtgagtgaaaatgccattataaatttttgctttcaattattattattattattcagtcactctcgaaggcaatgagaaagagtgttaggccaaggcgcacagagtgcaaattttgatatgatgaatttaaaatattaaatttaattatttttggttttaaattttcatttttaaaatcatttctaagctcaaataaattaataaaccttaagaaatttgctcaaaagaaaagaaaaatcttaaaaggtgtttttatcaaattgattaacaaagggagcggtttcatttggatcgttcccgattttcccccgatcatttttccttctttaaaaacccactaagtattcgttgaaatccagcctccagctcttctccaagatccaggagacagcgaattcgcccttctgtgctcagaagttttgcggactcctccgccagcgcaatgcaatcgagcaacngcgctttttttgctccgtacttgctcctcggcaaggnncgaggctggaaaaacatttttgaaagacacaaaaataaattttgataatttataaataatttatacgaantttgaaaatctttttatataaacattntcataccaaagtcaacgggac

SEQ ID NO: 34093 - DNA, 585 bp, Heterodera glycines
cgatttggctgtttgccctccccccccccctcccattctctctccctctctgtccctttctctctctcctatcctctctccctctcctcttctattctcttcccatttgccctatgggcacaaataaattcaaaattaatttgtgatcattttgattgggctgatcattattgcattattccatttttgcatattccctccccccgcacgtttgccttttttttcgaccagaactcaatcccttactaccattttgtcattgagaccctcggacagaacaagaatacatagtccatatgatggtccaaaggttgatgcagatcataacatagagaagaaaaagagagaaattataacgttaacaattttgaatcggaggaggaacctgaccgtgattgtgcttagttgacgccccactagtcacagcaaaagttggtaccaccgtaggggtcagatacgcagaataaagaagaaagagacattaggtcaacgaaaaataagctgcagtcgatttagaatatagtgtgagagagagaaagagccagactatagaaagaaaatgccgcttacagatcagcggacaaa

SEQ ID NO: 34094 - DNA, 986 bp, Heterodera glycines
  misc_feature (947)..(947): n is a, c, g, or t
aaaaaatcgattttttcaagtgtccgtttaggggtactctttcaattatcggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctccctttttgatagtgaaagcatcagagagccttatttaactttttattaacattntggtgcgtttcagagcacgttctaaaaaatatttatgaa

SEQ ID NO: 34095 - DNA, 124 bp, Heterodera glycines
caactggagcgtacaggaagggtatggcaatcagggccagggcaacagcggcaatgccaaccttgactggcgcgccacctacggcgaactcgtcgcgggatacgcttacgatcgcagccaacag

SEQ ID NO: 34096 - DNA, 1484 bp, Heterodera glycines
  misc_feature (1422)..(1422): n is a, c, g, or t
tagagtcggttaggtaaaaaattaggaaaaaactgacattttgaaggcattttgttgaaatgtttacccatttttatgctcttatcttttaatatagcttggtgaactgatggttcacattgttcagacattgcggaacaccaaacagtccgacaacggcggcaaaacgcaacaaatggtagaagcgacagtagcggaaaacgggcagcaacaaactcaaaaaaagcactccgactccgctggaagcagcagtatgttgtgaattgtttgcttgcttttacccacacggaaatccgtctctgttggcattgccattctcaatgggtttatacgattaatattccgatgtccttttgaagcatcttcggttgtgccctgtcccgctgagttggcattgtgccgtcaggcggtgttggtcaattcggatcagcagcaacaacaacagttgcacgactatgagcagcgtccggtcatcgttggctatgatttcaacgccggcattcaatgggaggcgttgttggattcctttttgaccaccggcttccaggccagccacatgggcatcgccatccaggtacattttcagcaacaatcatctccataaaacatattgctgtggcaaagagagccgtggattcaattccatgccaggagcaatgtatcaattctatcactaatccaccgcagccgacactgtagcgccggctcaaacagtgcgcagcccaacaacagtcacgaagcaatctccagaatggacgtggtttgtgcacaagggaccaaccatttttgagggtggaaaaatgatggaaatggtgccatcctccgacgctcttttaaaatgcctaaataaaatggtttaagcaacaattcatttggcttttaattcagttaagtgagcggatccgtgacttccattacaacgaggaccaaacgcacgcacagctcaatcgaaaattgcaattacgcgaccaactttattacgcaatttcaccgattttcccaagtacaatcgaattatttttgataaatgatgcgccaaatgctccgttctgttgttcagtgtgcggactttacattgtcggctcgtcactgaacggattcgggacgaagcggtcggacttggacctttgtctgatgataaccaatcgcgatgtgagtttaggcatgaataaagggcagaaaagcaaaggaaatgtccagagaaattgggccccaattctcttttaaattcattttgtcgtccgcagattgaccaacgctctgatgcggttgttgtcctgtcgtcggtgatgcggacattggagagcaatcaaattgtggccgagcagaatctgatcctggccaaagtgccgattctacgcatcaaatttatcggcactttccacgacataacggttgacctgaacgcaacaactcggtggncattcggacacgcatttgatgtgtactacagtccttgtgagttgtcttcattaacggctttt

SEQ ID NO: 34097 - DNA, 1037 bp, Heterodera glycines
ttccaaacattggggactcaacccaccaactttcaatgacattccaatctctggaactcaactcaccagcatttcaatctctgggactcaaccctccagcattctaaacaattgactcaaatctccggcattctaaacattgggactcaacccaccaacatttcaatgacattccaatctctggaactcaactcaccagcatttcaatctctgggactcaaccctccagcattctaaacaattgactcaaatctccggctttctaaacattgggactcaacccaccaactttcaatgacattccaatctctggaactcaactcaccagcatttcaatctctgggactcaaccctccagcattctaaacaattgactcaaatctccggcattctaaacattgggactcaacccaccaactttcaatgacattccaatctctggaactcaactcaccagcatttcaatctctgggactcaaccctccagcattctaaacaattgactcaaatctccggcattctaaacattgggactcaacccaccaacatttcaatgacattccaatcactgaaaatcatcccatcagcatttcaatctctgagactcaattctcaggctttccaaacattgggactcaacccaccaactttcaatgacattccaatctctggaactcaactcaccagcatttcaatcgccaggactcaatccaccagcattccaatcactgggactcaacccaccagcaattcaatctctgggactcaattctcaagctttccaatctctgggactcaaatctcctgcattccaaacattgggactcaacccaccaacatttcaatcactgggactcaacccaacagcattctaatcactgggactcaatttcagcaaatccttcagcatttttcttttttgggtgtcttaggacgttgcaccagacggggggacggttcggaagcggctcacttactaacatttcctattaacaatttcttttcgctcggccgcttcacggcctcgcacccttttt

SEQ ID NO: 34098 - DNA, 1181 bp, Heterodera glycines
atcattaggatatgattgtaatgatcggaaattgacaaaaaaaattttagaaaatttcggttttacggtctctaatcaatatatcctatagctgagcgggaccgggactggtactgaaaaaaacctacaaatgaatgcctagccccggatttgaccgggaccgagactagtcccggtgtttcccagccaaaaagtcacgggttttaacccgaaaaattccctgtaccaattttttttttacaattaccgattaccgctctactctaatataacgaacaaataattttcagattttcattggttacaccggaaaaaaacgtgggcaaaatctgccgaaacagaaatgtgttgccataaaattgtatggcaataataaaagacatttttataatggcacaaatgttttgagaaaattaaaaccatttgattcaaaaaatgagcacattgtcaacatgatggactagtaaaattcaaaatttaattagcattaaaaaataatacctaattaaatttgcaatttttagtggccaaattatgccaaatcaaattttttcgccggggtttttgactattttggagctgggcgaaatgagcttggaccaagaattgcaacgtggtaaaccaaaaaaatcaaagaatcaactgatcacaatggtaaaagatatcgtgagcactttggatgttttgcacaaaggttattaactaattagtttattaattaattattaattaattgtcaataatagagttaacgattctaaattaaaattatttaattaatgtgaataatatgaaaaactgttcaaagacaaaaaaaaatattgtaattacttgaacaaaataattaattattttaaatttaatacatgttcgatcctttccttactgattttatcgaaataattttaatttgttttttaagttgcaatgcatttggacttcaagccgttaaatttgctgttatttaaaaaactcagtcttttttcttccacagatgtttcaataaaattgacggattttgatggtaattaaggattaattaattaattcagcttttgattaaaatagtgtaacatcattgaattaaataattcatgtttatgaactctttttaaggaattcaaatataaattttattttagtaattaattaataaattaaggttgtatcttttatgatga

SEQ ID NO: 34099 - DNA, 810 bp, Heterodera glycines
tttctatcatgaaactaaaaaaagttattccagaagttctcggaaaaattcgaattttcagtaaaaaattctgaactcggttctgaaaagatattttggaaaagtaaaataatacaaaaatccgcaattttttgctctattttataaattttattttagctttttatcacttttttgaaaaaagttatagaaataaaagtgattttggggttcgggaccaaaggggggagcacatggtttttgaatgaaaaaattttttcaccaaaatattccaaaaatatgattttaggggttatttgggccgctgatcacgaatacgtgatcagattttacttttgacatcgttaaggcctcagaatccctgtgtgattggggattctgaggcatcattttgagggggggggcgaagttcgaagccgggcggtgtacattatttttctaccatttttttcgtgtttttcaatttttattcatttaaaatattttttgagttaataaataaaaaattatatttaaattaatttttttttaatgaataaattttataagtttaaatgaattatttttttaattgatagaatttcatgtattttttaaattaaatttgttaaaaaatattttcattttaatttaatgaatttactaattactgttgtacctcttccaatcactgttgtacctcttctaatcattgttgtacctcttaatcacttttgtacctcaaaatttaaataacgggcgctaagcgcccgtccaaggccgcgaagcggcctaacaagctaaaaaacgggcgcgaagcgcccgtatgag

SEQ ID NO: 34100 - DNA, 813 bp, Heterodera glycines
ataaataattatttaaatataagaagatttgtaagtttacaaataattaaaaacttaaaaatttgtttaatcatttcggcttgcctgtctaaaataaaaaatataatttttatttaaaataattattttattttattaaattaaaattaaaagaaactattatcagattcggattataattttaacgaaaaataaatcatatatttaaaactaattattttaatttattttattttattttctttaaaaaataattaaaaataaaatttagctttgatttgggcccggcacattttatcgcattctcaacagagttctatttttggcccaattattatcgctttgaaagtttggcagcccaatggcattggctgattcgagatttggaagtaaaaacttgaaaacttactttttttttttaaaactaagattttttaagaaagctaacttgaacagacatcaggtgccatggatcatcacaatgggccatcgtccaatgtattgttcgggtaaatagagacaaaaaaagaaaaattaataaaaaatcaaaataatttttcagatttttctggcgatgattgcacaagatatgactcaattgtaagaatgggaaataaatatataaatgaaaattatggcaataatattcataaaattaatcatttttaattttcaaagtaataatttttggctaatgttggaaaatattaatcatttaataattatagattaaccgatcacaaaagttaattctttttcataattaataaccattttttatagatgttaattaaaactttgatgcaaaaatct

SEQ ID NO: 34101 - DNA, 784 bp, Heterodera glycines
  misc_feature (758)..(758): n is a, c, g, or t
ataaaaccaaaaaatacacccctaagaatcgacctaaaaaattttcaaaaaaatacacccctaagaatcgagcaaaaattttctcaaaatatactcctatgaaatgaaaaaaaattttctcaaaaatttactttcttggcaaaaatttttaattttaaaaatttttttaggtaactattttgggttttttggtcttaaaaatcccagtcctactcatttgcaactgcaaatagtgaataaaaattatttttgctcaattttggctgaaaattatgtcactattcgtcactattttggacttttttcactattttgtcactattttggcactttttcgtcactattttagttaactatttcgggatttttcgtcactaaaagttgctgccctagtgatcatcgttgatttgcggctgcgctttttcccgattgtagcgctccagaatcctcaaaattcgtctgtccgcttcacggtaacgctttgctttctgcggcggagcatttccagcgaggaaatgttcgaagtccacgtcaattattttctggcgctcacgcaaaatgttgatgaatttccaaattgggggatgtccatgtccgatcgcatgttgcaacgtgcgatgatacgcctcggcgaagttgtttgtgcggtccgtgccgttcattgtgcgctcatacacactccattcttcggaacgaaacaatggacgagtgcgtgtgccgttgttgcgaagacgtccggcgtagttgattataaaccntttaaattactaatgaaattgaaaaa

SEQ ID NO: 34102 - DNA, 889 bp, Heterodera glycines
ttcatcaaccattgcatattgcgtacatagaaacatttattataataataatattacatatgtatgtactagagttgtacgggaccggcaatttcgagataaaccggaaccggtacttttcggggtgaaaggccgggacttagatactggtacccacttgtacgttttttcagtaccaggttccggtcccgtacttctctagtatgtattatcaaaaaaaaagttcttacagaataacaattatctgtagggaagatacaaattcatttgttttttttttcaatttttaaattttttccccgccatttcgtctttttcattttgtccattttcggtgttccgattgtgagcagtcatttggcgaattctggaaaattaatgaataatctaattaaattgtttttgttaataatttcgttttgaaaattaccgcgcgtctcccatggaagcggagcgtcgaacaatgagtccactgaatgggtttgaggcgcaaaatgatggttttggacgcggtgaattgatcactgcagcccggctcagatcatctgaaaaggggggaaataatttatttttatttgcttttactatgtttttcgtttaaaaaaatatttaattatgatatttttaaatatatttaaatgaaaaaattatgactttcttctatgacaaattgactacttgaaaaaaaagacgctgctggattggaggcacaccctcaaaaacggcgacacgcactttcaacattgaaatagtttcatattcagcgagttcataggggcgcaaattccctgcgtaactgatacgcacaataaaaggttccattttttaatttgcttgtttgaaaaacgttaaaaatcatttatttataaaacttttagttaaatcattg

SEQ ID NO: 34103 - DNA, 983 bp, Heterodera glycines
  misc_feature (887)..(887): n is a, c, g, or t
attattactatctttatgtattatatcatttattttcttttatttaaattacagattgtaattttaatttcatttttaaatttttgcttctaaagtaaaatacgtaaaatatatattttactagcgggtgcgtgaactgtcggttctgtgctagtaaattaacatacaaaatgaaaagtgcacttttaatagaatacttataaataaaagtaaatacaacttaattatattatatcatgattcatgaaataatacaataaatgatgaatctttcatttttctttaaacctatctaccaaaaatatgaaaaaacagttaaatttcatttagacaattgcaaaaatatttatcacaatcatagcgtttttgtccctaatttatgtagcgaacatcatgattatagcaacaacggcaaacaatattaaaatataataatttttgtttatttatagacgtattgcaatgtaaaaaatttgtataaatgaataactattaaaattattatacttatattcacttataatgttgacaaacaactgactgatatttttgacagacacttcttttcacgaataacaaagaatatatattcaatcgaaaagtttgtataataatattatatcataaaatttaattccaaaacaataaattaataagtcatagccgctacttttattaatgagacatcaagtctgtacagcaggattttgcatatttcgtcaatttatcagcaattagatgaattaaaaattctattatattactcatagtaaaaaaaagtaaatatgaaaggaatatgtcaaaatttcacaaaagattatatagtttatgtttttaaatttattttgattttttttgtaaagtaagagccaggaaatgttaattanaagaccaaaataattaaggtacttttttcataaatataaatttttgtgtataaattgtcaaaagaaatgcatttgagtcaaaagttcatttatcta

SEQ ID NO: 34104 - DNA, 808 bp, Heterodera glycines
cgttaaggttatgtttataatcactaactcttcttgaaatttcaaccgaaaaaatttaagagttacagtcaaaatcgggaagtttgaaaaaaaattctagggggttgtgaattttttgaaaatttgaaaaacccattggaaggtaaaagtttttcactttttttttataaaatttttgatcaaatttttaccttttttaatttttggcttcgcgccaaaacgtgggcgccaaaacgaccctggcgccaaaacgtgggcgccaaaacgtgggcgccaaatcgtcggcgccaaaacgtgggcgccaaaacgacccagtcccggtgtaagtgtaccaatgcatttattcaacaacaacaaaaaaaagcaaaaataaaaaaaattcaattaattctgctgatctggcaatggattctggagcggatggggaggccccccttcctcctcttcttcattcgcccagccaatattggccccgccgccgccaccgtcgggcacttcgacgccgccaccgttggtcacttcgtcgccgccaccgttgggcacttcgacgccgccaccgttggtcacttcgtcgccgccaccgttgggcacttcgacgccgccaccgttgggcacttcgtcgccgccaccgttgggcacttcgtcgccgccaaaattgggtccgccgccgccggcgacatcacgccgcgtccacagccaccaggccgtaaacccggccacacctgctcccagtgcagccgccgcgaacaaaagaggtgttcgatgagccattgtttctgagcattgaataaatgagttttttaaaaac

SEQ ID NO: 34105 - DNA, 902 bp, Heterodera glycines
  misc_feature (730)..(730): n is a, c, g, or t
ctgcgcgaggcgcacgccattttccaacacgagcgatgccagcccatccgcgagacggacttggaggactgagccacagatcggaaggatgaagacaaaacactcaaacgatttgacgacaattaattaattaatgactatttttgatattttttcccttttcatttcgttttttaaattattatcgcttatgtttatgatttgtttgtgtttaatgtgctaaaaatgcatttttctctgaattggatgaattgcaacgacaaactttctcaggacaatcaattcccagtcattcttttgtttatgcgtctgtctttttttattactccatttaatgtttctttttttgaaatcacgctgacaacaaataaatttaatcatttgtttttgtaattgatgctttattaaaaccaataaaattttaacaaatatcctttaattgcctctaataaatttcaataatttttttagtcttactatcataataattttcaggtataaatgagtgagctgatatttctctatttctttctcttccccgctttctccgtctctgtccatctctctctctcccttctttttcatcttttctctgcctcctgcagcaaccaatacataaaaaggatactgtagaatgagatatcgatttttatacgcctttcacactttcacttccgccgattttaaggagtgtatttcgcgtatctacacatgtgtttgcgtgtattanaactagtggacaaaacagaaagttgaagaacagttgtataaaagtgtacatgaatgtattgttatctaattagcaatttaattatattattaaaacgtataaagcacaacccatttgttttacattggccgaaaattttgatatttgtctttttaaaggctttatatcgaca

SEQ ID NO: 34106 - DNA, 1271 bp, Heterodera glycines
  misc_feature (22)..(22): n is a, c, g, or t
  misc_feature (49)..(49): n is a, c, g, or t
  misc_feature (136)..(136): n is a, c, g, or t
  misc_feature (164)..(164): n is a, c, g, or t
ccaaaaattcgcacaatccatncctttaaaaggccatttcaaattgtcnaagttctctccccccgtcccacccataaacataaaatatttcgtggtcgtgtcgaaatggcaattaaattggacactcacagagacnagagagagaagcagacagacgagagacnacagagagagagagagagagagaaagagagagagagaagacatcgcattgtggtactactgtaagtgtgtgtcaaaaaggaatactgtatatattcaaaaaataactgtcactttttccaaataatagcaaaatcttaatctctcgttctcatagctttgtctccccttttacctgtcctggagaaattgagcccgtctcatgaaacctaaaaaaagaaattcattcacaatcactaattgttgtttttttggcaccgattgagaattttcgacactgctccatgggaaactttgagttcgcgactgattttgcagggtctgtaaggcacaaaattaagaatggattccgtcaattggccaactttatgcccctgcgtgccatctccacaatttgaacgcgcttttcgtgtggcaatggccgtccattgataaacactccgcccaattgattcactcgcccctcaaaatgccctttttgtgaaagcaataccgacaattggcactttacttggcccaaaaagttctcaaaagtgattcgggtggcggtgccgttttgtgcgtgtgcttccgttgttacggcaccgtcgtccactggcatttgtcctctcttcagctgttgttggctttgggtgtcaaattggtggtaaatttcggcggaatcgcattccaatggcatttgcgtaaagtgtctgttttaaacgaacttttgaaaattaaaaaaagccaataaatattaattaatttggttagcaacaaaatgcctaaggggttcagtttcaaattaaaaaggaaaagcagcaaaagaaaggaggaaaagccgagcattgattgagtgatcactcactaattaaccgaattaattaatgcaaatgaatcaattattaatttgctgatgaatttgtgcaattgcaacttgttgagcacttcggtgcccctctgctcctttcgttgccgtttcatcagttttattcatttagtgggctgacattgcgcgaagctccgcccaccgatgggacgaaaacgaagtgaagcgaaggaccaatgggaggagggggagggacaaagacaaaagggagaaacttttttaggggggggggggggggggg

SEQ ID NO: 34107 - DNA, 915 bp, Heterodera glycines
  misc_feature (868)..(868): n is a, c, g, or t
  misc_feature (871)..(871): n is a, c, g, or t
  misc_feature (880)..(881): n is a, c, g, or t
atttttatggcccctctctctgtgaacaaaaatgacggattgtttctgattgccaaagccttcgcagttttgctgacgtggattttggatggcatccctaaaatccgttaattttgtgcgaattgttcaaacgcacccaaagattccattcgattggccaaatgaattgtgtcaccaaaaaggcaatatctgacgacaaatttaaacacaatttatgtaaagaaagaaacaccttggcatctgaaaaaatgattggtaaagcactcttaagataagggaaatggaaaagctttacttttactccgacgacgccggcgacgacggggccggaatggacgccaattcggatggaaatggccaattcgttggtggggttggtcacctgcaaaaagcacagaacggagtacagcaggagaggggccacccctgacaaatcgcgactccatcagaaaaccaatggcaacattcagaattttctccgcgtgattttgggactctttcggcacccctccgacgatcatataagcatcgcctgttaatgaaaagaagcgtttgcttattgtatctttctgttttattcctttgtcactaatttaccaattgtctccactttgtacacgtcgtgaaggccgacaattcgatcaaatcgttggtataggtcattaagcagtttgatcacatccttaattagccaattaaggcaaaagagccgacaaatgaagcattgggcaaacaaacgtaaggcgtgcagaaggagcaaatgttcgtaaaagtgacgatctgaaggaacactttgaaaattaacccatgtgacagcttaaaatgtgccgaatattcgtccccattcccggcccaactgctttcattntcnatttcgaanntatagcattatttacaaattacatctgtgaacag

SEQ ID NO: 34108 - DNA, 881 bp, Heterodera glycines
  misc_feature (33)..(33): n is a, c, g, or t
  misc_feature (36)..(36): n is a, c, g, or t
  misc_feature (47)..(47): n is a, c, g, or t
gatttgccgttgatttgcgcttccttctttttnttnttgtttgcttntagacatttctctgtgccatcgcttctgccagctacaccgttcacttcaattttcacgtttccagaacatcaattgttgagccatttgaattgttggtgaacgaacggaccaacgaaaagttgacactgatgaaggaaggaggagccaattttggccgccgcacttgttggtggacgatgaagcggtgcccaattgttggggagggtgcggcggttcaattggaagacgacggaggaattaattgggacgacaaattgaacaatgtccaatttaatttgtgggctcccaaaaattgcattgggttagcggcaatttcgaatttgtcaaaaactaaaaaatgtgatcaattttaggccattgtcttcgccaccagcagcggaagaagaagcgagcgggtcaatgcgaacaaaaaaggcgtctgagtgcgcggaagtgaattaattatatttgagaaatgctcaatcatctcaccaattgcaaatgaaatttgattgctctcatttttttgatatttggaatttttttagaatttaatttactagtttttccgaagtttaaaacatactgcagttccgcgcgccgcaaaattaaaagtggacttgcgggattaatcccgtgtgatactgtcccgcaaaatttttttttaaatcccgcagcgggatccgcaaaccccaaaccctagcatttttcagcacactcgaccaagaaaaacagagatgttaattttttttacacagaatttttcccactaataaattacaaacagttaatttatttaaaaatacattttattgtaaattagtcttatgaaaaatacagaaaaatcgacgatc

SEQ ID NO: 34109 - DNA, 901 bp, Heterodera glycines
aacattgtttgctgttaatgatgaccaaattggctcttgcctagctcatcaaagcccaactcatcaaaattaaatgcaccataaaactcactcgaaacgaattggggcccagcgagtggttgcggtcgtttggcatctgaaaatggagggatgaaaaaatgccgttgtgcagttttcttgtcggttgcccacctttcgcctgctgctccttggtgaaaaggttcttgtccaccatttgaagtgttccatagtcaggatggctggctaaatgggaggaaaaaatcagtatacattatgtaaatctcaaaagaaaatcaacactgacatggcacttttttccctttctccgagggctttgactttgacggcggcttcacagcgacggacggtgccggacctgacaaacaaacaaaaattagatattgacttatatccaaaatttcaatttcgcctctcgcctttcttgccagtgccgcgctcaattttgagcggggctgctcctccaaaaaattgagtatcaaaattccgcaatgtcccatagtccatggtagcttctgaaaaaggaaggaaattctcggacataaaatgcggcacaatgttttcaccggaagaagaaacatctgaagaatgcgcatttgccgtcgtcgccgctttggatgccattgacgcctgcgtttttgacggcggttgtgtttttgacgacgccttttcggggttttccggctaaaagtgaatggtgaaaatgagttttgattatggaggggagtcagaaacaaacatgcttttcctccttttgcttcttctaagcaccgcagcattggatgagcacgacgaacactatactgaggacaattaaaaaaggcgaaagggcagaaaaaggaagggggagggggaaaaaaaa

SEQ ID NO: 34110 - DNA, 765 bp, Heterodera glycines
ctgatcaatgtttggtggtcgatttgcgcttttacctctccgaaaatgtgaggaccaccaagcaaatgctggttccgctgctgctccatctgatcaatctttgcctcagctccgctgtcacgacaattgcgttttaccgccccttcgccaacaatttttgttacgatttcttaggccaattcattttcaccgctgtgtccgcctccaattttttgatcgaactcacaatgattctgttgggagaaatatccctttgtgttttgcaaaattttgcttttagttttcatccgtttttgcgccgaagatttgggaaagcaattgaaaaaatgcggaacgcacacaaatgttggcgaagtgttggccatgcgaacaatcgaattgggacgacgacgggggaaagggacagcggagaacagcaaatggtcattttggtgaatttgcacggggaaaagctgaggactgagccgatagccaaacggaacacttcgaagtgatgagaaaggcgtgggaagagatggactagggttgctccccgtccccgaactccccggtccccgatattttgggcctattccccgccccgacccccgacatgtcgctccccgaggtccccggcccccgactttttgccccccgactccccgacactaattcggggatcccgagcattgttaaaatttaaaaagttaattcaacaacgaagaggggaaaggttgaaaatttatgaaattttgaacaattttcttaatattaattattaatatt

SEQ ID NO: 34111 - DNA, 927 bp, Heterodera glycines
  misc_feature (35)..(35): n is a, c, g, or t
tctagagtcatgggaaagaatattatggaactttntggttccatctcagttgtcaacgccgcgactgcatcgttattatatcagtcgatagaattttcgaatcgcttttaaatcgtctcttttgcgtcccttaatcttcactctgaaccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcg

SEQ ID NO: 34112 - DNA, 842 bp, Heterodera glycines
ttcgctgcgcaattaatggtcaatttaaataggatagaaaaataatgaaaatcaattaccgattcaatttttaggggccctaaactctcacttttcaattactgtgttgcttagggaggggatactgtaccactgtcctttgcccccccccccccccaccattttacggcgttgagttggccgttcccaccagcgggcgttacacattagcattccgtgcacaattcaaattgtgcaccggaggggcgctttttgccctcctttccctctgcattgctgtgagacgctgattttatcggcgtcattctcaccgcaatgttcagcggccactgtgttggccgctgctaatgtgcgaagggggagtggccggagggcctttcaaagcagcaccccctccacatttgcacatcctggccttcccccatctcatttatgcaacatttctcctgcgaagcgacgccaccatttttcagcgctctttgcccatcccatttaatttatgcattttgcggttttatgatttaaaatatttttaaatatgttttacattttttaatatttatgcactaaaaatagtataatttaaaactgatcagaaaagtgcctgatcaaacactaaaacgatttattttgggttatggcccagtttgaaaatttccctcaaatttctgatcactttgcgcccattgctaataattcaatttctatttgcccattgatttaaatgcccttccttaaatgggctatggcctaaaatgtgttaattaatgcattcattttacccaattaatttcatgcatttttgatcagaaacaattgcatttccccatttctgatcacta

SEQ ID NO: 34113 - DNA, 848 bp, Heterodera glycines
ggggggggggggattagcggggaccgtctcgagaaatgtgtggtttgcacattaaacgaaacacgaaaatttctcaaaagatgatcagatttgcgtcagaatgaaaatatgaagtggaaatataaagagggaaaggaaagaaagaaaaaagagagagagagtgagagagaaagaaaggaggaattgagaaaagggaaagaaaagagataaacgtggagagaaagaaaaagaacagaaagaggagagagagagagagagagagagaagagagacgaagaaaatgaaatggagcgatttgaggattaattaataattggggaccaaaattcagtgaatttgactctattatactcaatttttggcacttcgcggactcttccctatttttttttgtacaaaagttaaacccacgacaaactgtgccaccggcaaaatggtcgagggagggtgaacaatgaatgatcagtgagtgtgatcagtggcactcggagtcatttgccaaatgccatcgatgacgaactgtaaaaagaaaaacattagttatgtgtgtttagtgaatttaaattcaaagtaaatttgaagaattcaaggacagaagaacttccgtcacttccaaccagggctgcacgcaactggatttgcaattacggaaatccgtaatccgtaattacggcgattttctcagttacggaaatccgtaatccgtaattacgggggtccaaaaaccccgtaatttcccgtaatccgcaatccgtaatccgtaatctttaaaaatcaatttttgtcagaatccaatttttcctgtaaaaatttttaatttttcatttcgggcgggggaatgggggggg

SEQ ID NO: 34114 - DNA, 1570 bp, Heterodera glycines
  misc_feature (791)..(791): n is a, c, g, or t
tcaatgggcaccaaaaaaaaaacaaattcattcatgcaaaaccacaacaatcacacatgtatgatggtccgattttcgtaaatattcatcggtttgctcactttccttctgattttcgtccccccgggcgttgccattgccacggtctaatcgcgaaaacaaaggcaccgaaaagcaacggcaaaacgaagtaacgccattttggctcgccggtgagaaagcgcgcgctgatcggcacccttcggttggccgcgggatcagacggattgtccggctttccgcccaaaagaatgcgaaaaaggcccggctcctcctttctcgcctcggcactgtctttctcgaggtccatctgtgatggatcagaaatggaattgccatcttttgataaagacaatcgaataccgatattttactaatcaattaaatttattctatcattttccctttaataaattacctttttttcgcctccatgttcataaataaatgccattgctgctgagaaatttggcaaaattaaactgaaaactttaaaatataaaaagagagaggaatttcctttgggctgctgtgcttttcaatgaatgccgaatgaatgagtgccttagttttgtgtttatttatttattcctttttttctaatggcggggaatgttttcgtaaacaccgcaaaaaaagagaaaaaggaacagcttaaagagcaaaaaaaaagaggaagaaatgacgaattgcgaacgtttaaagtcggtataaaattgcaatttcaaaagtgatcagaaaaaatgatcaantttttttgggtaatagccaaaactagttcatttttggataaaatttgttaacctgactaaaattccagagtttgcaccgccgaaacagtcagatgatcggaagggggggggggtcatttcagtacggaaaattattttaataatctaattaattatttaattgataattaatttttttttagccataatataatgtttaattatcttatttatttttctatatttgccaaaataattattaagagaataataaattcataaccacattttatacattcaatcaattgcactttatttttatttataattatttctttaattttaattaaaataaatcataatacatgataaaaaaacttttaagaatttttttcatattctttgtggcgtttgtaaaaaatctttgattgtctcaattactgattttatgaaataattacatattaaatttgtaaaaaaaaattattattattattattacgaaattatcaattaaaataatttttctattttttttaaaaaccataaacttttgatccggggcatttttcggtattaattttaaactttcgaactctgattttcatgccaagacgacgctgttcaacagaagcaattggacactaacaataatttgattgttttttgttttcttacaaaatcaaaaataatgaagaaaattaaaatgaaacatttaattaggtaattaaaataataatttattatttcccttcgttttgctcttttttcctttctccgtttggcttttgcttcgtatt

SEQ ID NO: 34115 - DNA, 918 bp, Heterodera glycines
gatggtactgtaaaaaagggattccatgatgacgatactgtataaaaattgtttaataatagcaatttgtcaaaaaaaaaaaacctttttttttggtggtggaatgttttgcacgttttggttgacgaactccaaggaaagcaagtgccttgtccaactccttcctcctttttgtgacagttcgaatctgcaaaaatccgaaaagtgaattttcaaattaaaaaaaaaaaattgcgttcactctgtcattaagaaggcccaaatccggagcagatgctgatgttgttgtttgacctgcaccaactgcatgttggagattgcttacattctgtaatacaaaacaaaattgtttaaacatttagtttctttttctgggaaaattaattttaactgaatttaagcattttaaaaactaacaaatttttagttttttttttagcgggagaatgggtctgtgtcgggtgccctatatcacaccagcaccgaagaaataaacaaaattaaaaagaaaaaactcgcacaaaagaaagttaggattttaaaaaaaattaatttttttttgggcgggggggggggggggggttaacgaactgctccaatttgtgtcgacctgctcttgctgctgcttaataagtgcattttccgccttcactttgctcagttcgtcctccgccattcgtttggcattgatcgcttcctcaatttgtgtcttttgttcctcaatcttttccgtcttccgcctcaaccgttcgtccagtttcattgccctgtgtctgtatttgtccgcattttctttgctcctcttcaactgttcgtccatgttgttgttgtcgtcgtcgtcccatcgctgctttggtttggccaactcggcacgcaattgttcactttcggcttttttgctctgtaaaaaaatattgt

SEQ ID NO: 34116 - DNA, 77 bp, Heterodera glycines
tttttataaaaattttcaaattctgagtctcctattattttatttttttttcaaattttgaagggcggggggggggg

SEQ ID NO: 34117 - DNA, 1481 bp, Heterodera glycines
  misc_feature (1406)..(1406): n is a, c, g, or t
  misc_feature (1467)..(1467): n is a, c, g, or t
aaaaatatgcataataaattttcccaaattaaagggtggtaatgtctctaaattttttcaaatttgttaaatattaagtaaaatctcaaaaaaatggctaaatgtggtattaaaaatcattttagaagaaaaaaaacatgataaagcaaaaatttactcattttttgcgaaaaaccaacccaaaaagcgaaattttgctttttttgcttatttttgacataaattaaccattttttgagaaaatttatttattcaatatttttcgtgaaaattttgctaaaaaattatttttttggaaaattttccggtttttgaggtcaaaaaggccaatttgtctgttgggggccgttctattagaggtttttttgaaaaatgcccaaatatgcacataaaatatgcacgaaatgccaaaatatgcacaaatatgcaaaacatgcatatggaaagtcatcctagaagcttcaaaacacgctaaaaacatgtttttcgtgcgtttcaggcctcccacagtccaggaaaaaaatatgcatgtgcatataattggactccctagtgatgggtgctgaaaatgatatacattgggatacgacgtaaagccgatttacgattgccgatatttcagggttggaaattcagatttccaaaatttttgggcagtcggacttccgcttgccaaaaatttcgatgaacaagggaaaacttcgacaatttattgggatttggcatgcttccaattgtatttatttgttagatttgtactaatttagagtatccgaatcttagaaaataattttattttttaaagataaaatttttagagagcaaataaacaaggcatacacagcaaagattaactaagtaacttaaatagtaaaaaatttttgaatgatgtaatttgagattttattttgtcattgtctcttttattttcgagagacttaattggcctgggacgagaatggcggaacacattgacttaatagcccttctcggccataactttctccgctgtctctcccccaccctcgctccgctgccgccgccgccagcgattggctgtgtcgctgacgtggaccaatgggcttgtgccccggcagagtaacgccggcgtgcgtttccgcggtgtgcacttcgcgacgctgcaccacatccaagccacacttttcgttctgattgctcaaatcactttgtgtgattgcgattggaaaagactcgctcttgacaaccaaaaaaacattacaatattatcaattttcagatttacaatctcttagggatgctcagttctttccccttattattgtccttggtcggcctcatcgccgtccacgccgaagtcttcttcaaggaggagttttctgatgacagttggactgatcgatgggtcacgtcgaaggtgattctgngcattagtgcttcgttttggtttttagtttggacattcagagcaggatgactacgggaagntcgagctgcccgcc

SEQ ID NO: 34118 - DNA, 1457 bp, Heterodera glycines
  misc_feature (847)..(847): n is a, c, g, or t
  misc_feature (911)..(911): n is a, c, g, or t
cgtctgcatatgaaaaattttcttgtaaaaatttcggcttacaaattagtgttctgccgttattacaataataatacaaaaaaataatgatattaaggaaacataaaacaataaaatttcaaaataccgatatccaatatagaataatatctgttgctctaaaccgtagtgttagtgttgtcttcattagttaatttatcatagcatctcagctaaaatctccacttttagcatgcgaacagaagtaacaattgccaattgaagaagatgatggaggacctttgtctctgccgaacataaattttctgaatcgccagctcaagctatcaatgaataaaaataaatttattatttagtgaagatctcaaatatgtttttgttagcctatttatttacaggagaagtaagtatatgaatatcaacaataaaaaatatatttattttaagatttataatagtgcaactaaagatattaaatgaaaaatacaaattgaattagaggaatttctaccaaacattacaatattttttcatacataatacttttcagtaaaaattatagttatatgttcaacaagtatttagctgttttttaaccgattcaaaactataaaaaagaatttttgaattttaataaatttatttcaatcaatattaccgaaaactttttattagaaaaattatatttaaaaaataaaggattatacgtaattaagttgccaattacagaaaatgatggcgttgtacaacacgtgagaataccaaaaaaacggtataacaaagaccaaaagatagaagataacaaacgattatagaatagacaaatctatcatcagtatttttcatnaagtgttatagtagtatataaaaaataatctaaaatattttgaataatttatttactaacatantaatgtcaaaacaagcaataatattcataataataaataataaaacatcttaaataatccccttgcttttatatattttaattctatgcaaacttttatatttttattttaccatatttgtccaaaatgataactatctttatataaaataaaaaatactttaaaatagatttataaaattgaatgtaaataatgtcagatatcgacaagaagaaagactaataaattaataaacatttttttaaaaaacatttatttacagagcaaattcataaagattcaatattgttttttaattatatattgaaataaaagtaaaaataaatattaattgtttattcgttcaaaataagctcgtcttaaaaaaccacaatttgatggataatacaaaataaaattaatttaataacaaaattaattcgttttacaatgctgatttaattaaagctttgtttttcgctttcatgtaaacttataatcatgctttttatgttatttttattaacgaagaattaaatatatgactaataaatagttaaatattcc

SEQ ID NO: 34119 - DNA, 657 bp, Heterodera glycines
aattgcgcggaagtgaattaattatattgagaatgatcgatctcaccgtttggaatttgatttgatttgatgctcatttattttctctcagacatctctcatcattgtcttttgttgtttttttcgttcgaattcataaatatatttattatttattaactgtttgttttttttttaatttttttctggatctcttgacaaaaaaaggcacttgaaactcagtggtcaacaatacgtttatttaattatcgctgaaaactgaaaggcaaaaaaaacaatagggtttattttttgaaatttctagttcaattcttagggggtgtatttttggtggccgatcatttcgtcactgagacataatttttaaaaatttttagttattctctctctctctcattccactctatcaatgtcttactctctttcctttctctatctctctgtttctctctcctcttctctctttcctatttttttctttctctcctcattcctctctctctctcattttttcctttctctctctctttctctcatttttcctttctctttctctctttcctccttaaaattggaagtgatgcgccgggggagtgtcaataaataaaaggctgtaaattttgaaaaaatcgagtaaaattccctaaagatggacca

SEQ ID NO: 34120 - DNA, 1406 bp, Heterodera glycines
  misc_feature (1079)..(1079): n is a, c, g, or t
  misc_feature (1357)..(1357): n is a, c, g, or t
  misc_feature (1363)..(1363): n is a, c, g, or t
  misc_feature (1392)..(1392): n is a, c, g, or t
catttgggaacgtcatttttaggtagaaaaatgcagaattaagagaaagaagacacaatttgtaaattattaaggagaggaagatacaatttttaaaagtgaacgaacttgtcgtttttaggtagaaaagtgcataattaaggagtgaacatgcatgcagaattaagcaatggaagttacaatttgtaaattattaagcatttgggaacgtcatttttaggtagaaaagtgcagaattaagagaaagaagacacaatttgtaaattattaaggagtggaagttgcaatttgtataaacttaaaaacgaatttgtcgtttttaggtagaaaagtgcattattaaggtaacatacatgtgtttaccaataaacgtaagacggttgactgcattcgtagcgaccaccaccatcattgtcgtcaatttcttcgacttagtcaactcgaccaaggcgtttgacaggaatgaagtcgtcctcgatttcggtaaacaatttgccaagccatcgctctttgttggtgtagtcgtcatccacaatttcgagtagttccattggatagtatctgtcttcgccacatccagaatatttctccacaatacacggcacgtatggcaggtgaagcttaatacggtggcgagcgtagaaatgggcagcaatgttaatgttgtacggttgtctgagtctgccgtatgctggggtcaaagccgctccatggtccgatattccgtcgacaaaaaatgttttctgtatttcattccggtcctggtatgtcgtccgaaccttttttccgaccagctccttcagtgccttcactcggtcctcaggatgattgagcttgtcgcggagtgatttcggggaacagccgagaatttgggcacaaaattcgatgacaaggaccattgtagcagaacaaatgagacatagctgacaaattgccggggcttttatactccccggaaaattaggccacgcccacttttgaaagctatttaagccgagattttctcacacaatcaaatcagtcttgcaaaatcatcatcaacaacaatggcagatcaatttgtacaacatgaaactgcnggaggagcaacaagtgaaagctaagaagccaaacgttgatgagcgatttctttggaaaatcacgagaggccaatttgtgcttgcgattcggctgtgctcaggttaatcaaaaatttttgacgaccaaattaattgacagctttcagaggactggaaacatttatttcacaacaaagacaaggcatgtcggctggaagatggacgagtggcgattggactcgagatgtgtgaagaatgtgcccgaatcattgcctgtgtcagtgacatgattgctgatncaaagnaaagccaaaaaccaccgaaataatcatcnaatttttcgcatta

SEQ ID NO: 34121 - DNA, 825 bp, Heterodera glycines
  misc_feature (757)..(757): n is a, c, g, or t
  misc_feature (770)..(770): n is a, c, g, or t
aaatggacattttgaattttgtttgcacagaaaagaaataattttattaatggcgatttctgtttgatcaaagcaacttgcgtgattctgaacagctgcaaataccaaaattttgaaccatttggaaaggaatcagctgatttacaaaatctatttgaagaattcgtcaacacataacacaccaaaatttttaaattttcaatgatttcacgttgaataattgcttataaaaaggaaagtaagtcattagaaatgtcgacactgctacataaaattagtttctaaacacatccaaaatgttgtgccgttttccatgcttcgtctgtgctcttttattccttctgctcaccaaattggatggtgtttcgccaacatgcgtctcatgttcagccgacagtttaaaaactctgtccgtagtggacgcgaaagcttcggggatggcacaggcaattagcacgtcaacgccaatcggcacagttggcaccagtggggtcggctgcacaactttgaagctgacttgtggcgaaggccaaattgtgagactcagctcggaactttgtttagggatagtgtaccgacgttgggattgggatttcgagaaacggtacgaagagtggagccacaaaaattgtatggcatttttacagtgatgagagttttggttaattttcgtaccgtatgaaactccttgttgatcaatgaactattatatttgacttatagctattaatttgccttataggtttccatccatgtncacttgggcttgngtggctctgactacggtaactatgactccggtttcatcgccctttgactgcatgc

SEQ ID NO: 34122 - DNA, 116 bp, Heterodera glycines
gggattaagcaactgttaattggcaaaaaatgaggatgatgatggatcagccgccgttggggagggcattaaaatccgactctgatcggagccgcacatttgtgattgatcaggcg

SEQ ID NO: 34123 - DNA, 203 bp, Heterodera glycines
tcactgttttgtggtggcgatggagtggaccctcccccccccgcccctccgtccatcgtccacttcacctcaatgggtggggtgggcacaagggccgatcgcgggggcgtgttcggaatggctggatcaaattcaattcgtacgtgtcgccacccctccccccttttccattgcccatttttgcgcacttccgccttcgcccc

SEQ ID NO: 34124 - DNA, 497 bp, Heterodera glycines
aaattcctaaattttattaaaaaattgacaaaaaaattgcttaatcgcagaattaatttttttttgaagtcaacaaaaacgcgcgcagttttgcaaaagggcgaaggaaaattgttttttttttaaattaattctgcggcacagaagaggaaaagtaccaaaatttcaggacgaaagcgattctgaccctaaaaacccatcttcgaaatgctataaaagtattaaaaatgattaaattaaaattcttgaaaatttctaatatgcttcattcattcatcattaaaatccctgttggtcccgccgccgacgccggctcgaatttggctttttcggcttttcagttccgagttttctccaaaactttcgagtcattctcaactctataatttctctccataataaaatccacaataaattgagataaatcaaatcaatcccatctcatatttaattgctacactggtggaaaaaagtcttaaccaaaccaccgaaatttg

SEQ ID NO: 34125 - DNA, 1296 bp, Heterodera glycines
tgttgttgttcagcaactccaagtgctggacctgacggacaacagcctacagtacctaccgtacacgctgaccgtactgtgcaaggccaaaacactgtccgccctttggctctccttcaaccaaccgccgctgcccaatctgaccaccacgcatgagccggtgatgaatatcaaggtaaaaattaaattaaatatagcatttttaatcgaaaaatttatgggaaaaagtcttataattttttttgtttgaaaaaattttcatctttttttgggtagggttatatggtaaaacattgttttagacaagaaatacgatttggtgcttaaaaattttggtttacgcggagcaggtctttttgacaattctacgcatttttcttaataaattgcattaaaatttccaaaaaatttttcaatctcttaccttattttttttaattttgaccccaaaatggcaaaattagtcttttttttggcgaatgctgaaatttttatttgtttttgtcccatttatccaaaacaattcctcacaaatattcaaaaaagccgtcaacgaaattttgtcccgacgaaattttgggttgcaccctatttttccgggctaacattttagataaagggaaatagactgacaatgagcgtctggttcgggaagggggggggggtaattgatcagattattctctatgggctgattttataaaatgcctgactgggcggcgtcgatttcatagacgaagaagcaggcaccgagagtgcgatgctcatgatgatgatgatgatatactgtaaaccggaaaaaactacaacggtggtaccaagtgatcagcacattagaggaacagccactaggtacatacgcaaccgtgatcagcgaattgaacatatttaaacaactcattgtccatcacaccgaaaactatcagaaaggagaagcggattaggggaatgagattacgatggatcatacgaatgatccgagctgatcaggaaaatgatctctaatcacataactttttgaagtcttatgatggtcaaacctctttaagctttgatcaactctgatcggaatagctcataaagtatatttttttagcaaaaatatactgagtattggtccgaagcacctggtgaatcggtacaaattacggacgatttttctgtccatttgtactgcgtgacggacgacgagatttgtgttcaacgcgaactttggattgagcgaaagggcatgccgaggagaaaggcaaataaaatttacaaattttaaaatattttttaattaaaatttttttc

SEQ ID NO: 34126 - DNA, 648 bp, Heterodera glycines
  misc_feature (612)..(612): n is a, c, g, or t
  misc_feature (614)..(614): n is a, c, g, or t
aaataaaataaaaaatggctaatatgtaaaattgggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacattngngcaggacaagaaaagaatgaagttgatgcctcat

SEQ ID NO: 34127 - DNA, 1446 bp, Heterodera glycines
  misc_feature (1254)..(1254): n is a, c, g, or t
  misc_feature (1318)..(1318): n is a, c, g, or t
  misc_feature (1394)..(1394): n is a, c, g, or t
  misc_feature (1411)..(1411): n is a, c, g, or t
  misc_feature (1413)..(1413): n is a, c, g, or t
  misc_feature (1437)..(1437): n is a, c, g, or t
aaaagaaaattcaaaatccttcaaccccaccgggcgtgtatttgaaatgttgtggcacatcccgcgtcacaacgccacaatcctcgcatacgaaagtgcccaatgccaactcgggatgaacctggtgcgtacgcaccacttgtcccgaaatccggataagtttgccgattttgtcgctggtcagatgccgaacttggtgcctggttttaacccctactatggccaagtagtattgcttgcgacgcaaatgttcgtgttggtcggcagcatcacaacgctcgacgaccaattcgcaaatggcatggcacagaaacggatacaaccttagaaaatgaattcatggatttagctaaaacaaaagcacgtaaatcggagttgacctgtaaaattgcagttcaattgtggcagcaagcaccgcgctgtaagcggaaatgtgtgcaaattcaacttcgagagtgtttcgttcgggccccctcaactcgtcaatctgctgaatatacacattcccaccatcggtttcaaaacttaaaagacattttaaatttttatattttcgctagattatcctaccttttgataaatcgtgtgaatgcatcttccgttcttcgaccttcatcatccgaaatcttatttatcactggctgagcatccatttgtaatcaaataacggaattttacaaaaatcaaatgaatgacaaagttgattatcagcaaaacgtcagatttttagagaccagaacacctaatacatattgtatttcaaataaattattaaccgctatttggcttaatgatttttaaaaaatgccaaggcataaaaatttaaattcttttcgttagcattagagacggataggaccggtaccggtttttactggatccggaagccagtccagcgatttttggaaaaatttggattgaccggttttttggattacagattttgagagaccgggttcggaaaccggttgcttctgaaaaaatcagtcaagtccggcattttgaaatctcggtctctggttagcattacctcctccttctcttatcggcaacataccgtgattttctttctttcttgccgatctttctatttgacaaatataatttacctatttatgagttttttagtgtcatgattttaattttcattttataaattttagctaaagaaacttttaacaaagtaccatcatttgcattgatttgcaacgaccaaatgccaccaaagtaattattttatatgttctatcttanaaaaatcataatgtttctattgaagggggtttaaacgaaagagagaagaaggatcggaagtggncgaatcagttgatcttgaccggattgatgatgacgaaaacagtcgtcttacactcactccttcccgccataataanagtaattttttgtttcngntcatgctttttgaatttcccacanatttcattg

SEQ ID NO: 34128 - DNA, 976 bp, Heterodera glycines
ttttactttaatttaagctattattatgagccacccaatttggcaaagatcggtctttttatacgcattaaagaagattcagtcgattgcttggagtgtaagcaaaaaaaacgttattaatttttcatcttcatcattttttggtttaaaaatatatttgaatacttttttatactttgaaagacttttttatcaatacagaattttttgaaatttcctaaaatccgcaatcctgcgcaggatcctgcagattttaaatgcaggatttgcaggattaatcctgccggatcctgtcctataaaaaattttgaattccaatcctgcaacaggatccgcaaatttgaaatttccggtctctagttttaagttataaacggatagaacgccaaatatgtatttattaaattttatttaaattttttgttgattttttccgttcgtacttttttgttttcgtacatgctcaattttgttttatgccttttgtacgtacatacgtacgagaatccattggagatttgtttaaagaaagcttccgaatttctttatgtgattattttgaatttgtctaggctcgtagccagaaaaaaatttcagagaacggaatcgatgaaaattttgggtcccgtagcgggttccgcaaaaattaaattacgaggctttacatatgtacatactgctaacaataagcacagtgagtctacagaaaattctgatcatgatcactgtggggcagagaacaaaaacccttttccctctttctctctcttttctcaagggaaaaatgagttgaattgagtgcgtgcgtgtttggcggaggatggtgcagcaacgcggttggcgaagcattgaagtcccctttctccttcactttttcaccaaatgctctctttctctctctcaccttttcaaccaatgctctcttttctctctctcttttattggattttctatcttttcttcctctacatcttgg

SEQ ID NO: 34129 - DNA, 1446 bp, Heterodera glycines
  misc_feature (1406)..(1406): n is a, c, g, or t
gaaaatgagccaatttgttgggagttaattactaaaacagcgaaaaaaaagtaaaattaacttattagctaatcattcattgatttataataatgaaagaaagcgatattcgcttagacaaaatacaaattaaatgctaacgaaaaagccactcaacagcaaaaaaaaggcattccattgaatgagaggtaattaaaggaacaaccggctggggagaagcaggaaaagtggtgtaagaagaagagaagggctaataacacagaaaaaatgtaataaaataagaaagataatttataaggacagggaaaaggagaagcgaatcgaaagacaacgaaagaaaagagaacagaagggatcagcagaagaagaaaaggagcagagaatgggaattgtaaaatgatcaaatatccttcaaaagtaaactggcaaaaatactaagtcaaccattcatttttgacctttacgtacggaaattaaggacactatggtcaaaataagatttaggggatctaaaaaaacgcaattatgaatttttgaaaataaaatttcgtcttcaaataaataaaaattcctatttttcgtgcgatgactatttactgttgaactataatatattagaattaattttatttaaaaatcactaaaatatttaatttctgaccaaaatatgtcaataaagaaagagagaaaattaaatcttcaattaccctcaaagtgcttattaatgacagaacaacaattgattcggagcctttgggttatacgatttgaaaaaaaaccaaaattcaaattttgtataaaaatcattcgctcggggggaaaaacgcattgaattgagcacaaggacatcatcaaatctaagggggggggggggaagaatgaatgaattggcgaatgattcgtttgatttggcgcatgagaaaatcaattagcgaagaaaaagcataaaatgtataaaaagggagaagaaaatagcgaaaagggcgacagggacagaagaaaataagcgaaatcgaattgagattaaaaataaaattttacaaagaaataatttcaatttctttttttgttgccaaaatctgccaattttcattcattgttaaaagggcaatttcgcctttgtttaaaaatgcaaaaagattgatgatatattttggtgagcattaaaaatgatgggtcgtccgtttgtttatgtgccataaaggaaaatgtgtggattagaattcgaattcaaacggattcaaattcgaccttgtacaaatgcattttccattaaaattaccatttgtttctgttttgaaatgattttcatccgtgaactcctcctgttcattgatgcttttttaaataacgaatccgccccaattagggttttttgaacgatcggtggttttttataggaccgnaattattcataaaaaaattataaaaagattattttattat

SEQ ID NO: 34130 - DNA, 69 bp, Heterodera glycines
aatagaacaattagaaaattcagctgagttttaagcaagttgtctttggacaaataaagaagcaaaatg

SEQ ID NO: 34131 - DNA, 662 bp, Heterodera glycines
aataaatacctgttaacttttcaaaagtggccattgattgattccaacgaaaaggaagaaaagcaaaaaagtctatagaacagcaataaataagagcaccataaatcactcaatttaagcagtgattataaaaactttatatatttaaaattcataaacaaatgaaaagtttttcacactttccgtgtgtaaaaatacggcaatatcgataacaaaaacaaaacaaagaaaaacaaatgaataattgtgatgagagcctaacaaaaagacaaaaacaacggaaaaaacaaagtgtggttttgtcattttaattgttcgtcttaaaggagaggaaaatattccagaaaatgccgaagaattggaggaacacaacgcgaaagtgaagagggataaccgtcagattgacaatttggacgaagggccaaaactgaaaagggaaagaaaattcattagaatttgggataaaaacagcaatcaatcgcctaatcagggaaaatcacaaggaaattggataaaaatgactatattaatagacatttacatcggtgacgcaaatttttttttgtttggaagataaggaaaagtaaattttgaaagaatcgacaaaaaacatgcaaatcacacaactcatattctcaagctgaactatgggaagagattaa

SEQ ID NO: 34132 - DNA, 240 bp, Heterodera glycines
taatttttgtgtcttttgccattctcaccaaatcgttcactcgtgccaaaatggccttccgttcgctttgggtgatgtatcttttggaagtgattttggattctgacttttttttctatttgtcccttttcttcgcacctttcagctaatcgagcgggccaaatgatcattctgaggggggggggggggggggggagagagaaattggggagaaggaaattaattattttattaaaaaat

SEQ ID NO: 34133 - DNA, 743 bp, Heterodera glycines
taagcccggtcatcgtatccatgctatctgagccacatggggaaacccttgaaaaacaacaattgttgtgggaaacggtacagaaaaatgttggaattttgaacgaggaacagagtgaagaattaagagaattgtgtgaaagttttggagaaatttttgcggcaagggacgaatatttgacccaaacatatctggtccagcacaaaatcgaaacgggtgacgcaccgccgatcaaaatcaaaatgaggcatgtgccatatgcataccgcgagaaaattgcggcaatgcttcaagactatctgggaagaggagtcatccaatcgtccatttctccatgggccagtcccatcgtattagtgccaaaacgtgatggtacattacgtttttgtgtcgattatcgagctgtgaactcggttacgcgtaaagatagcttccccttaccaaacattgacaacatactgttaatgctaggaggaaaaaagtttttcagtactctcgattttatgtcagggtattggcagattaaaatggaagacaattcggtggaaataacggcgtttacaactgagtacggcctttacgagttcaaagttatgccattcgggctaacaaacgcggtcgcgactttccaaagattcatgacccgtcttttcgagggcatgatcaacgattttgtcttcatttacatggatgacattgtgatcctcttcagaatcgtttgaagaacgatacccaaacacttg

SEQ ID NO: 34134 - DNA, 1054 bp, Heterodera glycines
ttgtagtctttttttccccaataaccttttcaagccccatttttcgcaccgtgaatgttatttttatggagttctgaaccgttttgagtagattagactagaaaaaattgaaaattttgaaatcatgtttcccactcccttctcccaggggtattattttgtaaagtctttttttcaaaataaacttttcaaaccccattttttcgcaccgtgaatgttatttttattgaattctgaaccggtttgagtagattagactagaaaaaattgaaaattttgaaatcatgtttcccactcccttctcccaggggtattattttgtagtcttttttccccaataaacttgtcaaaccccatttttcgcaccgtgaatgttatttttattgaattctgaaccgttttgagtagattagactaaaaaaatatgagtgatcaaactttcactaaaaagttaagcctaaactttttcccaaagttaaaaagcaattaaaattttattcacctccattattgatagaaaaagcatcagagtgcctaaactaacatgtaaataaaatttggtgcgtttcagaaccctttctgaaaaaatatttatgaattaattttgcaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgccccccccctcccacgcccttcagagcacgacaaatatttcaacaaaaattttgaaaaattgactagagcaatcgaacgctaacggacgacctaatggaaaaaaatccccgaaggagagaaatgattaaatccattccttcgggggaccgtgccgggtgc

SEQ ID NO: 34135 - DNA, 856 bp, Heterodera glycines
agtgaatgaaagagagctttgtttgtgtggacgaatgccatttacggacaataaaattatttcttaaaatgtcgacaacccttaaaattaaaaacgtgcgattaatggtaaaagggggagaatatgctatcttgaaagcaatatttgtatttaataatataccatctgaaattgatggacctataatttatgcatcgcacagtctcgccgaaatttcgcaatatgattttgattcttcttcgagtaaatataaattatacaacatgttttattattttggaaattctaaccaaattgctgaatgagaatagattgaattatgaacagaaattgtcaattaatgaaatgattttgcaattagcaattgatacagccaataattacaaaacaaatgaaacattggataaaataatccaaccaaaatttgaagaatatttagaggaaatgttcaaaaaagcggaagaaagtgcaaaaaaagaaagaccatggaacgccaataaaataaattatgacaaacatttgataattttgtatacaaaattcgatgatcatttgatatgggtgagacttaacattcaagcaaaactttaaaaattaaaaatttaggatgaagattctgaattttcggaattttgtcaaaggattagcgacaaatttggagaaattatttaaaatggctaaagaatattcaaattattaccgtcaaatgaaagagaaaggattcatggcctcttatgggttatacgaaattgagaaaatgaaatagcatttgacgcaaaactatgaggcgcaacttggcattttgaatttaatgcaaaagaattggcaatgtgacaaaattgcggataaattaaat

SEQ ID NO: 34136 - DNA, 985 bp, Heterodera glycines
  misc_feature (897)..(897): n is a, c, g, or t
  misc_feature (929)..(929): n is a, c, g, or t
gctcttagggtaatgggaaaaaattttgaagacgttttccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagataaccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagataaccatttttctgagaattaattcacaatttccgcagctcttagggtaatggaaaaaattttgaagaggctctccggaacggattagcatcggggttacgagatagaaaattgtcctaaaaagagataaccatttttctgagaattaattcacaatttccgcagctcttagggtaatggaaaaaattttgaagaggctctccggaacggattagcatcggggttacgagatagaaaattgtcctaaaaagagataaccatttttctgagaattaattcacaatttctgcagctcttagggtaatggaaaaaattttgaagaggctctccggaacggattagcatcggggttacgagatagaaaattgtcctaaaaagagatagccatttttctgagaattattcacaatttctgcagctcttanggtaatggaaaaaattttgaagagctctccgnaacgattagcatcgggggtacgagatagaaaattgtctaaaagagatagccatttt

SEQ ID NO: 34137 - DNA, 1402 bp, Heterodera glycines
gcacaatgtttgtactctccctaatttcattttcaatacacaaacaaacaaaaccttcctttcttttaacatttcacatttttagcatttaaaaaattgaaatatattttcgagactgatttttcagggttcgagactttgaattcgagaatttctcatgcactgaatttttggcaaaaaaaacatataatttcagaaatagaccctaaaatgtctaaattctaccatgtccagtgtttgggtagaaatttaaaattctagaatgtacggataaaaggataagggttacggccacagaaaacactatgatttacgggctaaataacccgtaaaacccgtaatccgtaaagcatcgtaccagtcgaaaaaaaatacgggttacggtctacgtgtccataaaacccgtacacgggtccggcccgtattcaatctctaattttgggacattttcaaaaaattttacttttatttaatttaaatttttttatttctctagcattatgtatcaaaaaaattcggtcaaaaattgaaaaaaaaattcaattacaaaatttaattaaattatatggcagcgccggaagagcgtgcgcgccgcggggcctacttactgctgactaatgacccccccctccaattttttaatcgatgcttagtttaaataaaacactcccaaaaaatttttttttggcgcggggggggcggcggttccatttgctaacaacacaaaatataaagtaaataaatgtacaattaagaaacatgagaacactggcaagcagtgcactgaacattgaacaggaagcggcacctgccaaaatttatgttttcgttttttttataattttttcactctttccaaatgggattttgaaagaaaaaaaactaggcttattccgcttcaaaaatttttttatttgttaatttttatctcatttaaatatttttgtttgagtttaatccaacccgccctctgaacttttcattccttattccattgagattttttgtaattttatttctaagtttgaaataagaaatattatatgatctattctacttatatttccataattttctcttatttttattatcgctaaaatttgttttttatttaagttctttcacaacaaaataaagcattttattttaattttcaatggcattttcctctaaaattttttcaattttttgtctcttccatttttaagcctattccgcttcttccaaaaacaatgtttccattttgtaaaaaaaatattacaaaaaacggggggtgggaaaattggaaaaagtaccaacacatacataacacatcagcagttttattgaattgggcgcttctgttattccatcaatcacttcagaataattaaaaacatttccgtcgcttactcacaaccga

SEQ ID NO: 34138 - DNA, 1585 bp, Heterodera glycines
attctgattccatttttatttgccagtagcctgacattcattggagagtcgagaaaattttctttcctcccagtgcaagaatagtgtgatcaatgttcggaagaggaaatgcgtctttgattgtcaccgaatttaaacctctataatcaacgcaaaaacgcaaagtaccatcacgctttggaacaagaacaattggacttgcccaaggtgagctggatggacgaatgagaccacgtcccatataatcttggaccatttcagtcacttttccgcggtatgcgtatgggattgggcgcatttgacttcggattggttctgcgtcttttgtatcgatcgcatgttggaccaaattagtctgtgttaactcccaatcactgacagcaaaaatgtcttcaaactccgtgatcagaatttgcaatttttgcttttcttctccacgtaagttgtccgtttatttgtgccagcttgctggaattcttttgaattcgcacaatttaattggatttcacttttagatttggacgaattttggtcttcatcatttttgcctgtcaatgtgaacaacattgaatcattcaattcacgcggattcgcaaaatgctcaaattgtccaacaatctcatccttttccaatgtaatcggaagtgcagagaaattggtgatcggtgcgataaattttccgttatttggatttacgacagccggttcaattctcatcaccttttttctgtcatttgatggaaaaattgccaattctttgtctttcttcgttgaacttgtcatttcaacaagtgtagtggctaacggcattaaagtcgttttgaaaatcacgtgaaccgagttttgggtgttcacgttttgcttgaagtctaccatcgtttttgacaactcgtaaaaaattttgaaccctaactccgaaagtgagttggttccgaatagtaaatcgtagccaaacgatgtttgagctacgtgaagacgcacttgcactgtcctttcctgccttttaacaggcaaagttacaacaccgtaacatttgacctcttttccatttatgtctatgacacgtgcaatttgtcgatcgggcttcaaaaattctttgttcaatgttgaactattcaaaattttgttgaaaaattccactgaaatcagtgaaatctgggcgccgccatcaagcattgcgtctgccttttgctctaaaattgagacctttaccaacataatttttccaacagcactgccgttcttttccgcgtttccacatctgcggacacctgccatcaactcatcaaaagcacacgttgactttgcatcagttgaatcgagttgttgcttcatcgctcttcggatattttcataccggaagggattattggcaacggcggaattgtatgcgcgttctgccctacccgaacatttcgattttaatgtgcttaagcgcttttcgttgggccaatcttcgctaactgcgtccaactggcgaaaaaaggcattcacttcgtccgctccggcatttcctctcagctctgacatatggtgtagcgtcaaagagtacgagaaattgtcaagacttttaatggtctgcgcc

SEQ ID NO: 34139 - DNA, 740 bp, Heterodera glycines
gcacctttatccgattgatcgcctcccaaggcaatggatcacccgttggacaactgaggcctccgaactgagcaccgttcagtctgatcataaagcaccgcttgaccacaacaatgtccaagttcaccacgtaactgccgcgagccaaacgcacgcctttgtttttgatcaattgggacagctaaatgattaaatgacaatttttaataatatttatttgtcttttaattattcaacagggccctgcattttagtgacgaaaaagtcaaaataatgtggccccaaagcaacaaaatttgaatttttggtttcttatatgtgccataattgttttcgattaatctgcaaaatttcaaaaataagttacccctggtaatgccacttcaaaatcgctgtccgtcccaattttgaagctgacttccgttttggtgacaccgtctaaatgacatcgattaaccagcaactaattaattactctctttgattcgattacccattttggctctcaaaaggtccacagttacgttttttatgttggaatcagtcaatgctttgatgctgatcagctgctctttggtgttagtgaattttgcagaaaaagtgaggtccacatattttggcggaaaaagatcgaatcggtcgacgtgtggcattttcggaggcctaacggaatctgacgattggataaactaaaaggaacaaaatttgatcaaaggtaaattgaccaaaaacgggtaata

SEQ ID NO: 34140 - DNA, 446 bp, Heterodera glycines
tttcaataaaatagaagaaaacgttcaaactaaatgattgatagacaagggatgtgtttgggtaggggcgaaaccgcaaatttactgttttccttattaatcttacaattaattgtgaaatttcttagaatttttcccaacatagcccttcggcacttcaagactcgtgaatttgttaggccttgtttatgcaagtaacaaatttttatttattttttgctcacaagtcacacacactttaacaaccataatacatctaataataataataattggggtttggttctattctctttttgttttggtctaaaatatttatttcgctgctgtcgccgccgccgccaattttatcagtccgtccgtgctgtgcgatttgggccgctccaacggaaggcccatgcacgcgcccagatcagctgggagagacagccgagtgcccgactgac

SEQ ID NO: 34141 - DNA, 266 bp, Heterodera glycines
ctgcggacatctacatttttgaattgaaaaaattcgttatactctttctttttctccatattgaccatcatactcatactccccccaccctttctcctccttcattttttttttcctttccttctccaaccctctcctccctctcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 34142 - DNA, 53 bp, Heterodera glycines
ctgatcccgggcatcgccgtcgggcgggcggagagcaaaccgctggtggtcag

SEQ ID NO: 34143 - DNA, 688 bp, Heterodera glycines
tgaggttcaacagccggccgcgaagcggccgaatgatcccataaaattatgaaatgggcgcgaagcgctcgtcctgaggccgcgaagcggtcgaatgatcccataaaattatgaaaatggcgcgaagcgcccgtcctgaggccgcgaagcggccgaattaaaccttaaatataaaaaaagggcgcggagcgccctttgaggccgcgaggcggccgaattaaaccttaaatataaaaaaggcgcggatcaccttttgaggccgcgaagcggccgaaagtcctctacaatattatgaatgcgtcctcacgatgcctgtagaccaaaatcccttatcacatccataaattcatttcaaaatcgcgcatgcactagcaacgaagtcctttgcgcgaagcgctcatgtcagcgtgtccttcctaaataccaaagtatactgcccacaacatcccccactgtgcaacacgctagtttatattaccatagagaaaaagggggactcgtcttaaaaactaatttgagtcgaacggctgtcgggaggggtctgaaagtagtggaagggtcttacaactttttgaggcgcatctgggaaaaatatgggttttccgctccggtggccaactgagtcccggcggctaatttctcacttttgcttgcgtttgaaggccctgtaactttttttctaaaactc

SEQ ID NO: 34144 - DNA, 979 bp, Heterodera glycines
catttacgaaatgccattgtcggcgatttaaatgagtcaataaagtgcggcctttgattgtattttagccatttgcgttgttccgcgtgtcgcaccaattccaaatcggagggaagcgaactctgaaaaggcacttagactcattaattggtcattagtgctaattgactatgccttattgaagtggcatgccttcctgatgattttctccgcctgtaaatcactttaatacggtaaatagcagaatggactcgcctcgtccacgcgatttgtggcgattagccaacgtggactctccggaagatgatggatcagaaacagggcaaggagatggaaaacggtggtgatcagctatcatttgcaatccttagcttcccctcgcccactcgatgtccagagagacaatcggtcagtaatggacaattcgtcaggaaataaattacaaaaattattttttgaattttaaattaattttcatattgttttacataaaattgcgttttattaagtttgttgacgaattgtccgggagccgcccaccccacctgaattgaggtccacgaccgccaaatgtaagcaactaatgccaggaaggcgtagccgcaagcccacggcgcttgcaaaaggctgccgacaacggaacgatactgcatccctggggagaaagaagcattggcatggtgcaaaagggcattttggcatggcaaaaccagtgatttccatgcaataaacgtaagcggccaaatcggccgcctcattgcaagcggcgagaagaaatcggacgaccaaaaacacttcgaactcgcgcgagaaggacagcagaaagccgaagatggtggacagaatggagaagccgtaaatggccggcttacggccgtaacggtcggagataaagccgcccatcagacagccgaccaaatagcccagggaataggacagatgcacgtgggctgatcagaaacagcaaaacatgatcaca

SEQ ID NO: 34145 - DNA, 1001 bp, Heterodera glycines
aataaaatggccatggcgcaccgcacttcgtttcatgtttgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctgggatatctataaaatataaaaattatttgaaaaataaaatgggcatggcgcaccgcactctcgttcatgttcgagagcggttggtgcatagaaaatttctcaaaaaaaaaaataagcatttttctcgcatatctattaaatataaaaatta

SEQ ID NO: 34146 - DNA, 1169 bp, Heterodera glycines
  misc_feature (26)..(27): n is a, c, g, or t
  misc_feature (1086)..(1086): n is a, c, g, or t
acaatcaatttcttgttctaaaatcnntcattttccttcctcaataacaaaaacattttcatttcccaataactcatcattttcaactccattactaaaatcgctctgaaaaacacggtccaaattcatcgctcaaacaataaaggcgtcttttaatctgtataataaagttaattaataatatcaatttataaaagcaaaggtaaaatattgcattaaacaaatagtgacaaaaaagttaaagtttatcaatttaaaattaactgatgaataatggaaatgatgtgacaaataaataatcaaaccgacctgttcagcgtaatttgaaacctcattattaaatgcctcaattatgaaatacaatttgaagaaaataatttcattacaaatacatattctcttacaatgtcacaaatctattacaatacaaaacaaaaaaaaaatgcttttcacatccttttgtcagtcaatacaaacaactaagttgccttcaattttttataatgaataaaaatcgcaataacaaaatcagatataacaaaaactcaacaaaccaaaaaattatcttttttctttctttttcagtttgtcaaaaactcaattttaaagcaatatacatacatattttctaaacaaaaaaaaaaatgaacgtgagcgagtaaacgaaaaatttactctttttttactgttttaaaagaaatacaattattggatattgactctttataataaaaatctatataaactgacctcacaacgtaaatagaaaatccgctgattaaaagtaactccttttgtaataaattgcgataaatccatccaatagaaaaatatccattgaaaatagcatgattgaacacccattaaattacaaaacaaaactttttccatttcaatgctctaaccaaattcaagtatcaaaaacttttacaattcaatatctaaggtcatttccattgctttgcataatcaaaaacaaattagcacttacataaacttattcataactaatcaattacatattcaataattacaatagaaataattcatttatattcattagattaacaaaaatacataaattanaaagagaaaaaggaagacattatttatatgtaatatattgctttttgcaaaaactgacaaaacaaaaatgaaaaaaagcaaaa

SEQ ID NO: 34147 - DNA, 915 bp, Heterodera glycines
atgtctgggactcaatctccggcattccatccccccggactcaacccaccaactttcaatggcattccaatctctggggctcaacccaccagcatttcaatctctgagactcaacccaccagcatttcaatctctgggactcaacacaccagcatttcaatctctgggactcaaatctccggcattccagacactgggactcaacccaccagcattttaatttcattccaatctctgggactcaacccaccagcatttcaaactttgagactcaattctcaggctttccaatcgctggaactcaacccaccaacatttcaatctctgggactcaaatctccggcattccaaacactgggactcaacccaccaactttcaatggccttccaatctctgggactcaacccaccaactttcaatggccttccaatctctgggactcaacccaccagcatttcaatctctgggactcaacccaccagcatttcaatctcggtgactcaaatctccggcattccagacactgggactcaacccaccagcatttcaatctctgggactcaattctcaggctttccaatcactggaactcaaatctctggcattccaaacaatgggactcaaatctccggcattccaatctctgggactaaaatctccggcattccaaacaatgggactaaacccaccaactttcaatgacattccaatctctgggactcaacccaccagcatttcaatctctgagactcaattctcaggctttccaatcgctgggactcaacccaccagcatttcaatctctgggactcaaatctcctgcattccagacactgggactcaacccaccaactttcaatggcattccaatctctgggactcaacccaccagcatttcaatctctgagactcaa

SEQ ID NO: 34148 - DNA, 707 bp, Heterodera glycines
taattaatttttttttaaattggtccaaaattgccgcggagtcccaaattccgcgcatcgcgcaaaaaaaaaaacagcggccgcgcatttaatttgccgcggccgcgaccgcggatcgcgcaaaaagaaaatgccgcgaatcgcacatcgcggcgcggtcccagccctgccatggacggttaaaaaaaagtgcaaaatcattggcgtaaaaaacaaaatgccaacatattcaaatgaaaaacaatgtgtccttactgtgaagaagaaaatttggaaaatcccggtcccggccccggtcccggcttttttggacaaaccaccgggacagggagtcccggaaaaacgggagtcccggtcccgggatcccgtcccggtccattttccaagtcccggtcccgatcccggtcccggccatttgggccgggactaacgggactaaatttcatcagtgaaaataactcagatttgaaaatatttaataattattttggcgaaatgtctttaattcgaaattttcaagatagaactttggatttcttgaaaatttgggcaattcaaactgttaaaaagtccatacgaaattgagtaacattttcacaacttttttttaccaaaaaacatttctaaatttgatgaaaaactcaacaaatttccttaataaatttattaaaattcaaatttttcctcagcgtcgccgtgttaaaaaa

SEQ ID NO: 34149 - DNA, 1156 bp, Heterodera glycines
gagagagagagagagagaggataaagtatagatcggagagggaaggaatgataaagaagcgattagagaggaaggaaggtaaagataatgcagggtagaagagggggaggggggggaaatatatgtaaatcaaaaataattacagaaaaaaatgccacgaaagaggagctgaatgaggatggcataatggcacagatgaaagaaatgtttaagcagatgaatctcggaaatttgaacgatttaatgggaggaatgggtgaagaagaagaggaagaaatgagagaaggtgaagaacaattggaagaagaggaggaggaagagaaagaagaggaaaaggcagctgagaaagaaggagagggcgaagaagaaaaggaagagggagaggaggaggagaaagagcaggagaaggaagagggagagggacagtgcagcaaaagtaatgaagaaggaggacaatgtatggcaaaagaaggcgaagagaacgcagaaaagtcagagacgaagatgaaagaggacagagatgaattgtgaggaaagaaaagagcgagagagggaagagagagataggggaaagacagagagagagagaggcaaataggagagagacagacggagggaaaaagggtggaagagaaaaggaattatagagagagagagagagagaaaaagggagagagggagggagaaagaaagttaaatatgggaaaaagagaaacaaatggagcgaaagaaggaagaggagaggaagagaagaaagaatgcgcatgtgatattatgatgcaacaatgagtgccttttggcccacttttggcttttgcccccccccttttccccgtgccgtttattttccctttgccttttcctccgattgtccaattagtgagttgtttaaatttgttgaccatttcgttttaatttatgcttcgcccccactttttgttctaatttcggtccgaattggctcattttccttcgcttgggtcgctttttggtgcgaatggccaaataattcattttctgccgcaccgctcgacgcagtgaagcccaaaaaagggaccatgaatgataaatacataagccccgcttaaaaccctgaggaaaaaaaaaatttcgaattgacaccccaaaaattgctaaatttttccaaaaatatttt

SEQ ID NO: 34150 - DNA, 536 bp, Heterodera glycines
tagcctgtactttaattctgcgttggatttttgctccctccctggtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggaggccgaatccttcgggaatagcttccctatagcctgtactttaattctgctttggatttttgctccccataattgtttgagtaccccaaacggacacttgaaaaaatcgatttttttgttttcggggcagtccccccgaaccgatgcgcccagatttatggggagaccggatcctcccggaatagcttcccctatagcctgtactttaattctgcggtgggatttttgctccccataa

SEQ ID NO: 34151 - DNA, 588 bp, Heterodera glycines
aatccaacattgcccccgagggcatgaataaggggcgtggtggggggcttaattaattaaactaaatcatgataaaatgaaaattcagtcgcaattgaaatccaacattgcccccgagggcatgaataaggggtggggtggggggcttaattaattaaactaaatcatgataaaatgaaaattcagtcgcaattgaaatccaacattgcccccgagggcatgaataaggggtggggtggggggcttaattaattaaactaaatcatgataaaatgaaaattcaatcgcaattgaaatccaacattgcccccgagggcatgaatattagagcacggacagcaggaccggaccttgtcagcatttttcaagactcccgctgatcctgatccgggtatatttttgaaaaattgacctggatcaggagtcctgaaaaagaggatttttaatctcgaaatccaccaatccgagtcaaatcttctctaatcctgaaagtccggattctattgaaaatattgagtaaatttttgtttttaaaatgttggacttaatatttgaaaaactaatttttgtgcttttggaaattaagat

SEQ ID NO: 34152 - DNA, 888 bp, Heterodera glycines
atattgttagattatatgtagagaaaagcatttctttaaaaagtaaaagacgacaaacagatggacgaaaaaattcataattctttaaaatggcaaaatccaaaaaaaaattaaatgaaatttaatcaaatcgacgcaagaaattcttttcgcggacacttaaaattaaaattattagcgatatgtaaaaaatatattatatatccggcagtgaattttaacgaatattggctggcgactgactcattagccaaaatttaacaaaaatattttcaaattaacaattttttatttgtttttttgtgtcctcccattgatttatgtaataaatttggccacacaaaatccccaggggtttctttctttttctttcttttctgtgatggcttttcacttattcaaaaaagaaaaaaacacatccaatttttcgccgatttctgagtttggcagcagcgaattccgcccaaatgccttccgccggaaagatttggcattttgcaaattccccgggggattggacacacgcaaattgggggggggggaggcggacaacggcactgaacaacaaaaagcggccaaaatttaaaccccaaaaatggcaatggcgagcatcagattgtgctgcattcgcacttcgtttttgacgagaaaggtaaaaaagggtcgtccattttaattagggatatgctcgagagttttgattccatggatattatggccaaaactcaaaaactcggtccatgttctggcatggaccctacggcaaatgccattttatagggaaaaccatttggcatgagtcgagaaacttctccgctttttttcatttatcagtctcgaactccctcttgctatcacaaattttaatcgcttaaaaactctgccgga

SEQ ID NO: 34153 - DNA, 538 bp, Heterodera glycines
aatgggggtggatgatcagtataattatagccaatgggggtggatgatcagtagaattatggccaattggggtggatgatcagtataattataaccaatgggggtggattatcagtagaattatggccaattggggtgtgatgatcagtataattataaccaatgggggtggatgatcagtagaattatggccaattggggtggatgatcagtataattataaccaatgggggtggatgatcagtagaattataaccaatgggggtggatgatcagtataattataaccaatgggggtggatgatcagtagaattatggccaatgggggtggatgatcagtagaattatgatcaattggggtggatgatcagtataattataaccaatgttggtggatgatcagtataattattgccaatgtcggtggatgatcagtataattataaccaatgggggtggatgatcagtagaattatggaccatgatggtggatgatcagtataattataaccaatgagggtggatgatcaggataat

SEQ ID NO: 34154 - DNA, 1053 bp, Heterodera glycines
  misc_feature (757)..(757): n is a, c, g, or t
ttttaaacatgttttcactgaaaattactcgatttatttatcaaattttgaaaaattttaggggcaactcatccctcattcttagctttataatattcgcgtttcgcgacaaaatgcgaaactcgaaagtaccaaaaaaagcgaaatatgcgaaagcgaaacgcgaaagcccatatccctggtgtctatcgttgttattagttttttttttttttgcatttcttttaattgcttttttgtagttgcacaatattttgagtaaaattcgttaaaaaatcgtaaaaaaaatttttttgagtgagcggctcaaatatccatttttgcttggcggcgcaagtgtcgagacgcaaatgtccgctgcgcaaatttcgcggcgcaacaatattgcgtggtgctatgtcgttacttaaaaaaccatcattatgatttgatgaaaaattatttgtaacttaactgaaaagcaaccaaatttttatttcttgatatgattcgataggcctatgagttaaggaacaaaattacaaaaatttaactttcttgttgaaggaaaggagaaatattgaaaacgatgaatattttttgctattatagtattatggagtgtgctattaatacttagaatgttatataaattttgcaccaaaattttattttccgataaaatttaaaacgcaatggatttaacagatttaaaaagtccgaatatcgacttgacagggcacctcgcgaattgttagaaaaaaatggggaatgaatntgggtattgttggatagaacaggatcgacttcaattctgattttttattattacgggggtgagacgaaaaattaaaaagttatggagccaccaaatttaatggataatataataaaaattaaccattttatttaaaaatacaaaattttatataattgaagggggactttctggttttcggaataacccactaatggtaaaaatccgaccgcaaaaaaaaaactggaaaattttcccaaaaatttctccccaaaaaaataaattatttttttttacttaggaagcccgggaattcc

SEQ ID NO: 34155 - DNA, 713 bp, Heterodera glycines
cccttccaccactttcagggcgctcccggccttcggccgggagattttgttttttgaaacgaaactccttgtcaatataacatatatagtaaactagcgggtgcgtgaaccgtcggctatttagctgggaaaaagcgcttcgcactttgggagcttcgctacctagactgttacgggggaagaggtacaaccacgggtgggaaggtacaattgtgatcagaagaggtacaactacggtttttttagctctggttgtggagatttggaatttttaaaaaattattagctctggttgtggagatttttaatttttaaaaaattatctgggacttttaggccgcttcgcggcctcgaacgggtgaccgtctgtgccacaagggacagtacgttgaggtagctcggccaccgtatcatgggccaacctggctggttggatttttacatctgacaggtcttgtgagggcccggagccttctttcgaagggcatccaggaccaacatgggaccgccgcatagatgcccacttattggacagcgatggagacgatcgagacatgtacatggtcgggttgagctggcacaatctttgccattctgggagtacacctttggcccaattaatgagtccccggtcgtctgtgtttcgcaccactacatcctttatagcggactcctccacggctgaccactgctgaaccctctgcgtccggact

SEQ ID NO: 34156 - DNA, 1564 bp, Heterodera glycines
  misc_feature (12)..(12): n is a, c, g, or t
  misc_feature (724)..(724): n is a, c, g, or t
ataaactaaaancattagaggttttcaaaacaattcacctcaagaaaatattttaaaacctaaaaaatagtttcacaaatttacagacctttaagactagaaattaaataatatccactcagacaatttatttgttacttacatttaatttagaattgaaaaattacataataataaattaataaaaaatattgaaatttgttaaagaaagttagatcaaataaattttattttggttttgaaaataaaaaaataaaataaataccaaaaagtattttacagatttgaatcattgactagaagcttacaaattaaaatgcaacaacagagcgctttaaaaataatgaatacaaagtaaaaaaatatgaccgacataattagttgaaaatattaaattaaaaaataaaataaaacagaatgtaaaataaatttcgtttttccgttgtcaatcaattgtgtgagagttgcatttgtagttttaaataaaattaataaagaaagaatgaaaaaatcttaaaaacataaaatgatttcgttactttaataaaaaccaaagatgacaattcaaacaaattgaaaataaatttgtagtgcgggctctctcaaagtgcctgggaggcagagagtttctcattgcactgatgaaaaagtgcaatagaagggtgtaaagggtgccctgtgtagctcagtggttagagcattccacggaaaggaagggacgtgngttcgaatcccaccgcaggctgaccttttacacctccgccatccaccgaattcctacatggcgctcctgggtggattgatgcatcggagtaatcgatctctgggtgagacgattctcctctctgtcttgtatgcctgggcggcaacaagttcagagaccatgagtgggatgtgtctgctgcattctgtggcttgacgtctgggactcaagttcacctctccactcttaaaaccaataagagaccggagaccggtcttcacaaaggctggggatgtagtgcgggctctctcaaagtgcctgggaggcagagagtttctcattgcactgattaattcaaatttccattaaaattttcaactcaatctccaactgttttgacaatgtctgctgtacaattcaaacagtcatttgacaaagtctgtgccaccacagccaacgcatttcgctttagcctccaatggtgttttgtgccgctggtcgttattcttggtaagactggcatatattggattttttcaaaaggtattccgcgaaatcctcaaattcagcaatggcaaccttgaatttcggatctcatctcacaatcagttgataaatatgaatagagcaaggaatttgaaagtttaaaatgccattccccggtattcccccaaccaaaaaagagaacccaggaaaaatggtaatatgtagtaggttttgtccccccccccctttttttcaaaaaaaataatttttttgaaattcatcaaaacgtctttcctggggttttcggggtcgctgatcacgaatatgacattccttacgaccaatttcgaaccccggacccgaattcgaacaaaa

SEQ ID NO: 34157 - DNA, 1127 bp, Heterodera glycines
atctcattcatatttaaaatactatacgtattatatatgtatattatttaaaatgtattatactcatattgagttgccgctcaagttcagcaagtcggttttttgagctcttcatacgcattttggtgttggttttgttcagtttgtttttgatttaccacttattcattcagactttgcaggaagatatgattattaatttttatatttttacttttagtaaaaaattttttctgaaggtcttcattattattttatcaaaatttatattttcaaagttaatttttcaaatttaatccaaattattttcataaatagttaagtagaattgcatgaatttataactttaaaaaaatataaaattaatattttaacttctcatgaagactatatttttttattataattttttattaatgatattttaattctttgttttatttctcagaaaagaagtatatatttttggcattcattactttgcagcatttggttttgaataattactttttatacagtaaaaatgtcttttttcagttttttaattaatcaaattttgctattaaatagatttgtatctttcaataagaccaggttgagtgaaaattggtacattttaacaaacatgctaggaaaaccctttgaagcagatacggctctcaaaagatgaggagaatgaattttgaaaagatgtatacgaaaagggaaattaaagaaatactttgaaatttatattatatttatacaatctttaattaataaagtttattaaagaaataattcgttagaattatttttttaaatttttaattcgtggtaaccccttaaataatgtatagctaaattatattttaacaaatatcaacaagattgtgctttaccaaattatattgatgaaacgaaacatcaacctattaaaaagataatttattattttcatttaaacttcttaactcccgtatagattaatttggatttttattgtgttaagtttgtttcgttataaaaacttattatatttttgccctttttttgttttcaaaataaattttaataagtaattaataattttataaattcttttattaactttttaaaataaacctatccttcccattgtttttaac

SEQ ID NO: 34158 - DNA, 1009 bp, Heterodera glycines
gctcagcgtggagagcaatttggcggacagtttctccaagttgcaataccttctcggcaacaatcccttccctccggaaaccttcgccaaccttttgctgctttattgcaagtccgtccggtttaatccatgcttttttttccattttaactttggcagattcgaatatttcgatttggccgccgatgttttggccgaaaacggtgccatttaaattggcatcattcattttaattcacctcaattccgctctctttcagctcatctcacttacaaattgctcaaccaagtgcgtccgtttcttttctttgtcctccaaattattcgttttgtcagtttcaattcgattatttggacgctctgatcactcagcaatcgtccgaaagcgaagcgtacgccaaattcgacgctttggcaatggaccgactgaacgaactccgaaagaagcaccaaaagctccaagtgccgttgtttgatgccgaaatgttcgttcgttaatttcattcatttcttggaaggaattgcgtgaggaggacaacggccgtgccctccaatgcgccgtcgattcggtggaggagacaatcgacgagtttttgcccgctttgatggcccaagccaaattgctatgggacaaagctcaatgggcccaaattgagcagctcttccgacactcggccgaattttgtcacgccaacgaaacgtggaaactgaacttggcgcacacgctgttcatgcaggagaagtacaaagaggcgaggtgagaggagagacggaagggcaacgaatggccaaatatttgagagagtgccttttcagcgattgttacgctccgttggtccacgcgagttttgaccgggtgactcttttttgtcgaatgtttggcattcttccacttttcggcacagcttttggacgtttcggcggtcgttttggccaattttgtgcgcctgttacatctttcacaagtcggcttctccctttttctttgcctttttcactttttctattt

SEQ ID NO: 34159 - DNA, 846 bp, Heterodera glycines
tcgtgtttcgagaattaccgcatcccccgactcattctagcggctcaaaaaacatattttcagcctttacccgccccctcctgaaagttttgaggttctatttttgtctttttgatagttttgctttttttatttttagccgtcgtacgtgcgcaaagagcggcacagcaaatacatgcaaagggacacgttgaaaccgggcgacggtcagcaaagtcaacctcaacagcagcagcaaaagcggcttttctgggacttggacgacaatttgcggtgttttttaactctaaatttattaattacctaccccccccccccccccccccctcgtaaggttgcgcattctttccgcctcccatatcaccgtcctcgacagtgccgaccgactgttcattcgcgttgcggtcgccgtgggtcgtcacattctggatgtgcgcgactcgaccatagtgtccccgtcgaatccgcgatggcacgaagtgtgtgccaaatttgccggcttattaaaaagccaaccttaagagcaccatcgaattcgacgtgtacctgaaggatctgcccgagtcggctcagctttgcttctcgctgatctctgtccattgttccgcttctccgtcgaatgccaacgcatcgcaaaacaattcaaagggaaaaggcggcaaaaattctgtttgttcattcaaagcgaacgtggaaaaccatgtgatttgcagaaagggagcggcgcttcaactgcaccttcgtcgacggaccatttgcacccaatcggatggaccaatttacgactgttcgactggcgcaaacattttgtacagcccaaacgcactttgtacctgcgaccatttg

SEQ ID NO: 34160 - DNA, 1161 bp, Heterodera glycines
ggctccctatcatttcgtcactgatcgtttcgtcactgttcagttcgtcactgatcatttcgtcactgagaaaatttttaaaattgtttggtagattgtcttttaaagtcatctcttctccaaaattgtttttatccaaatctgtcgtaaggccagccaaaattttttttacaataatgttttttttttttttttttgcaaaattttgtgataaaaattgcttgaaaatggagaacatttgttcaaaaggcagtgctgcgaagagacgatgtgcggggtagtgctaagactctctagtctcgctcgagaaaattctcgggtctttttggtctcgagcagcaaccaaatccaacgatcttgatatcattcgagaggccttcatatgctctattagcctgcaaaattctggtcataacttttttgaaccttaacaaaattttttgaaattttgaagctaatagaaaacacatagggctatcgaatgatataaacaattttggatttggttgataaataagaaagttatagccaaacacttgtactcgtacgaaaacgacccggacccgaccccttgtaccattatgctcttaatgtattatggcaaaaaaataaataaattttagaaataagcacctttttggaagtggaattaaatgagaagctaaattggtctcttttatttcagagaaaccctttcaaatctcataatcaacaaatttatttgtttctttttgctagcacgtttgtttttaaagaatttttgttgttttttaaggcaatgtgccaaactttttaaaaaaatttttctcagtgacgaaatgatcagtgacgaactgaacaataacggaacgatcagtgacgaaatgattggccaccgaaaaatcataaaacccatttttgaatcggttcataactcgaaaaatggacaaaatggggcaattatttagaccttcgttgctctaaaaatgaaaaagcaccgattaaagcctgtaaacggcatccggtcttcttaatttcataattaaacttcaataatccttggtaatagttaagatggtagccccccattttttggtggaaattttcaaaatttaaaattcgttcaaaacgagtttctaggcgttttcgaggtcgctgcaaacgattctggaatgcattccg

SEQ ID NO: 34161 - DNA, 913 bp, Heterodera glycines
  misc_feature (821)..(821): n is a, c, g, or t
  misc_feature (888)..(888): n is a, c, g, or t
tgagtaaccaagaagccgctgagctggtggccaaggaatttgtggaagaaggctcgagctggttcgtcgattttggtgacaaaccgttgcgtgaaaagatgttcccggccaattggaatatcaaaattatcttcaatttggagctgcggagggaagaaaagaagaattggaagtgttcaaagaagacataaaagatatggcaagggcaggactggaagtccattgggcaactcggaaaaatgcacgtttgccgcgagagtttgaggaattcgccgagatgcaggctgtggaatttaccaataagaaaaaattggagaactcgcagcggcgatcagaggaacaccgtccaatacgggaacaaatcccgagataggagagtcagcccagaagagtacaaccggatggaggcgagcataaccaaaagtctgacaggattgacaatgctggtcatgttattgatcacactgttgcaaccaatgatgatcaacggacaagtcattcggccggaacgaaacgacagatggattcctgtaaatcccttcggaagacccctacgaatggaggaactcgttggtttacggagccgacggtacctcggatgagcctcgacaagagggggcaaatcacgcccactttgccgacaacagcggcggatatgtccatttcgcatatccgggaatggtaaaaaaggcgcggatgcaaacaagtggtatgactcaaacttcggcagcaacgacgacagtgctacgagtaccagtgccagtacagtaatgactaccctaggaactccccgaacgacagtaaccacgagaacgacgacngaagcaaaaggagtcacccacgcaccacagtggaagactacaaatcgagaaatcaggacggactcangatggagacagtggactaaaactcc

SEQ ID NO: 34162 - DNA, 805 bp, Heterodera glycines
ccgatgcttaagcctttttatgtactttaatcatttcgaaaagcaattaaattgcgtaatttaaattcaattatcagctgttttgtatgtcaacgaaaatgattaaattggcgaaacgacaataaaaattgatgaaaaagtgctttacggggggaaaagcggtcaattgcaccgacgaattgagtaatttttatggggtttcatcacaattggataatgaccacctcattagaaaatcaaaggcagcagaatgagtcgatgaattcgggaatgagtcgagaatatttggtcaacgaatgccgagaaatgagttcaaattggggcgaaagctttttaaatcaatcttttgattgaaaagatcgatgctggcgagatttattcctccgttgaggaattaattaattaactaattattaatgacaaaagaaagaaaaaagtaaaacaattaatttattgctaaaaaagtaaatcacaagcacatttatccatgaaattgttgaaaacaatgacaggtaagttgacaaatattccttaacaattccatttttaattgcgcattttcgggaatttccccgtcgatggttcggggattcccgagcgattgccccccgaattgctcaaattgcgtaaatccggttgtttgcaaatcaaaagtgagttgcgttgcgatgggcgatttggaggacgacgaaaagctgagaagagaccgacagaaacggagacaaagcgaaaggaaatgaaaaagtaaaatgaaattaaatggacagtaaaattcgaaaattgaaacgaatttaaaaaattttct

SEQ ID NO: 34163 - DNA, 1409 bp, Heterodera glycines
caaacgcaaatggaattggtggtcatttgagtgcggaacgtttagacgaaatgaatgtgagaagaaaaaagtcgaaattgtccagggatggcggcaattgaaattcggctgtgcctgggacattgaagcacagaaatgcatgccgaatgaagaaacagtgaaagcattggcacggggagagaaggcaaagcagaggaagtgacggaaagtattttaaaaatgaaagcaaatgatttgatcgcttctgggattgatcgaagtgatgttgaccgaaacagtttgctacaaatgccaaatttaaatttttgaaaataaaaacaaaatattttcgatttctttgttggacttgttgaaatggtatgcttaagtcgatggatgccaatttcagtctgacggttcggtgtgagggtccttcaagcaaaagtgagaaatcctctcaatcaaaaagataaaatttatatgccttaagacatgcctattcattttggaatttcaagccttagaatattttttttaatttactgcatttcacagtagcattttattttgtccctgtcctctgaaaaagtcagggtaattaacttatgggctgaagtcaaatccgcgtgataatttttccatttaatccccttttctaatcattaatttgtacaaaaaaaaaagaattttaaaatgatttaattgggtttgcaattttttcaagctaattgctcattaatttgcacatttttaaatgaattcatcatctcaagcaaaagatggaactcattttcaaaattataaatggcatttcaaacgaagttttaacccattaaaccaatgaaagcgcacattagcaaagtgccgccatttctttcgcctttattaggccaaattcactgggctttgaaaaaaaagcattttttaattctgttaataaacttatgacgagaaaaaaaatcaaataaaaacgcatttattggaagcattttcaaaagttcgaatgcatttcgttggaatttgatagaaattattgtaataaatgaattggcctttggtgggaaataataaataacttaattattgacaaagtaattaagacttatttttcgtgcttttctctatcaaaaaaaaagctacagaaaaaattaaaatttaaataaaaatattaaaattgtcccacgcttaatttcgttggtatggtaaagaaattttgtccgctgtcattaattcactttattattaaagtgaaaataacacctgctgttccctcaaatgggaatgaattttttctcttttcgattttttataaaaatttttaaaatttcccgacttgggctttctttaacaaagccaaattcgatcgagatcataatatttatcgactaaagactgaggggattctcgagcacattaataagttattgtta

SEQ ID NO: 34164 - DNA, 929 bp, Heterodera glycines
atgggactgaggagtggggaactgacggacagagtgggtcggcaaagccgagacattcattccatttgagtgttatttcaggcatattgccaaggtcgaattgtcacttgggaggatttggtgccctcatcaccggggctgggtaagacattggagtgatcagatgctaattcgacggcgacattaaatttgagaatacaaagaaaatatttaatgagtccagccaaacaagcatggttaaatgagtggattaatttcgaacttgattaaaatttactatcttttaaattagactgtagcatttttacacatttaattttatctatttttaaatccttaatctggtgcccgcacaaacttccccctgcgttctgaaccaaggccgcggccagctcggggcgcggtctgagggagaccaatagccctcccgacccaaaccgggggggggggggtggtggtggttttaatgattaattattagagcccggaattttgaaagtaccgggacttttcgcaccataaaataattttttgaaaatttgaattttcgaatttttgttagaatacggatccggggatcgaatttagtcgaaattttttaattgatacatattttatcattttaaattaaaaatccgtacaaattgagcctataaatctcaaacttttggaaaagcacggcgaaaaagtgatgaaaagtagagatcggaattctcaaaagtgtcgggccgggccgggctgattttttcagaagcaaccgggttccgggcccggcctctcaaaacccggtcaacccgggatttcaaattgctgggttcgggttggtaaaaatttaattttacatatttttcaaaccaaaatttgacaaaaagtgggtcacgagttaaatttctgctctatttcacttcaggcgtcaataataattgacg

SEQ ID NO: 34165 - DNA, 670 bp, Heterodera glycines
gaggaaaagcctaaagggaggggggaaaggaagaggaaaagccaaaagggaggggggaaaggaagaggaaaagccaaaagggagggggggaaaggaagaggaaaagccaaaagggaggggggaaaggaagaggaaaagccaaaagggagggggggaaaggaagaggaaaagccaaaagggaggggggaaaggaagaggaaaagccaaaagggaggggggaaaggaagaggaaaagccaaaagggaggggggaaaggaagaggaaaagccaaaagggaggggggaaaggaagaggaaaagccaaaagggaggggggaaaggaagaggaaaagccaaaagggagggggggaagggaaaaggaaaagccaaaagggaggggggaaaggaaaaggaaaagccaaaagggaggggggaaaggaaaaggaaaaaccaaaaggggggggggaaaggaaaaagaaaaacccaaaggggggggggaaagggaaaaggaaaacccaaaggggagggggaaagggaaaaggaaaacccaaaagggagggggaaagggaaaaggaaaacccaaaagggaggggggaaaggaaaaggaaaacccaaaagggagggggaaagggaaaaggaaaaaccaaaagggaggggggaaaggaaaaggaaaacccaaaagggagggggga

SEQ ID NO: 34166 - DNA, 1295 bp, Heterodera glycines
aattttgttttcccttttttcagcttcatctccgccgattgttggctttgtgtgttcgatttgattacgccttcacaacttggccttggaattgcgatgatcagccaccgtttcgacttttatgtggacgaacacttcaaaactcgcaaatggacattggcatttattggaattcaaagcaaaaatggagagaatggcaccaaggaaatggaaattgtcaatttcggtcacaaagcattgccaattccgcaaattcaaatgccacgcaaagtcatcggattccaatggatcaacatctcgtaaattggccaatgtcaaaattttttgccaacatttccctttcagtttcatcgaccaaaatgccattgcttttctccgccattttcgtccacttttcaccgcctgtccaatcaatttgaccatcattacgcacaatgctcgcactttggagttcattttgcccaacatttggccattgttcgggaaaaacattcatggcatggatttgtccgccacatttttccgccatttgcgtaaatttgccccgtcgattctcaacgactgtccatcgcttcgctttgtcaatgcctattactatggtttcttcaccggattccctgccgatgacagtgccgcggcatcggatggacaagcgttggccaaatggcttttcactccacttcaaagcaatgtgccaaagatgctcgaatgcgggttggacatgggtgatgggaattggtcgtcgaatattgaacaattcaaagcggtgcattcatttatctttcatttttctttatcaattttcccatattttaggcatttgccaatgcttcttcccccgtcaattttattgtcgtcatgtgttttattcctacgtcttttgctgactccgttgtgccctttgatctgaccaacgaattgacacgcgaacaattggcattgaaaggaactaattttaacaactgttttctgctgatccgttctccaattgcgcgagatgcgaacaaatgggcagaatgggaaaaggaagcgattggatggaaatttattgatcaatgcaacaaaattgaaattcaaatttatgatgaggaacaaatcggagatgggtaagcgaatgcttttttcaaaaattcatatttattgcgtttctatttttaggcttctcgacgcaaatcccggcccaagtgatcagcagcagaagtgaatgaatgattgtgctaagaagtgatcgatcaatttggattatggagatatgaaaaatgaattttgatgctatttgacatgctcatataaat

SEQ ID NO: 34167 - DNA, 767 bp, Heterodera glycines
agtccccccgagccgatgcgcccagatttatgggggagaccttatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtggaggggggggg

SEQ ID NO: 34168 - DNA, 748 bp, Heterodera glycines
tttcggcatttgtcgaagagtgaacggttctgcgcgtataaggcaccgttttactcagctcagcgaactgagtctaatggtaccgcatacgcatggttttgtcgacttttcgacaaataccgaaagtgtcaatttatttttttttaaatgcagtggtcatcaaattgacacttttggcatttgccgaaaatttaacaaaaccgtgcgtatgcggtaccattagactcaggtcggcgagctgagtaaaacggtaccgaatacgcgcagaaccggtcactcttcggacaatgctcaaagtcggactcaattgacattactttcgccacgtttcgaactttttgttggacaaatatttcgatgacaaaagtatgatgacggtggaccacaaatcgcaaaggtaattttgaatgcggtaagtttttaaagttttctcggctccaaaaatggcccgaaaattaaaaaaaatcaaaatttataatttttttgttgatttttttgtttgtgtcagatttttttttattaaatttactgcaaacattgcaacatcaaacaatggtcatgctgtaatgatacgaacataaaaaccagttttgaaaattttgaattttcgattttttgttagaatccaagtcgggggttcggaattggacaaaacatgtatcattgtcgggatcagcgaccccgaaaaccccgtaagaaatttttttactgggccttacatttatatttttccattatagtcataaat

SEQ ID NO: 34169 - DNA, 974 bp, Heterodera glycines
  misc_feature (968)..(968): n is a, c, g, or t
aaatcatatattaatgggattttacaaaaaaaaaatatttatttatgtagatttttagtgaaaatgccaaaatatggaagtaaaatacggaaatgtggacaaaaacctgaaatatggaaaattaaaaactatcaatattcgaatgataccaattttgaagataactgacgaacaaaaaagttatggccattcccatttgaaattgtacgaaacgccattgtacgaactgctgtcgacccatttttggtgtcatgtgaaggaatggatggatgataaaatgatgaaaatgacggaaaaaagggacgaagcggaggggaaggggggacaaaggaaggaaaaggggcgacgaataatcgcctccggcactttcccgtggtgaataataaaaacaattttagcattctgagcagcaattcagagatgtgtcctgacttttaacaatcctttttgtattattttgtttaaatttgcaagaaaattggacagttttccaactcaagctaaatttcttgggcctagtttgatgcctaggctttgttttgtaaaatttataggcgtcattgaaaattcaaatatttaaaaaatttaaagtaatctggctttcacagggacccaaaattatatagtatttaaaaaaaattcatcaggaaagtaattataatgaaaatgcattagtaatttatccgtttaaaatttgtgcggtatatttttctttgttttccaagaattcgtttgtccatttttagggtcttcgtgaccagccaatggagtcgagttagttgctaattagttaataataaagtagaaatatctttacaatttttctattacgacccattggaattgtaattaagaaaaaattttatttaatcattatttaccaattcttttttgaattttattcaaattttttgttaaattttggttggattattcgttcgacaatttcatttgtttccattcatttngctgtt

SEQ ID NO: 34170 - DNA, 991 bp, Heterodera glycines
  misc_feature (13)..(13): n is a, c, g, or t
agtacaaagattnttgtaatttgaaattaccattttttcccttagcaataaaccctgtgaagagcttttgatgaaaaacaaaatttctgatgaaattgattaaataagaacagcaaaaaaaatggtgcgttaatttgcggcactaattaattaattaattgagcattcgacagtcggacgggcgacccatttttgccattttgttttttgttttgtttcaacgccttgaccccaattgtgccgttccttttttttcgggagcggggaaggcgagagtgggatcaaggtcagtctcgctgctgactgtccatccgatcagttggctgatcattgtcgtgtcgcggcggcacggcaccccttccgcccattctgtcaccgattttgcgccggccgtggcgtcgttctttttcatttataaatccttcccccgcgatcacttcccaagtgactcgaccaatttcaaattagcccccccccctttttttgctgatcacttgtcaaactgatcggacaaaatgcaaataagcccctttttctgatcacagcccaaattgatcggtgatggcttcctaaattgatcattgatcacttcctcaaatgatcgttgatcaattcctaaatttgtcgatgatcacttcctcaattgattaggcttactgatgaggtttgcccttatggggggggggggggggttctcctacaatatgtacatattccctcctccatgatcacgtcttcctaatgcattctccaccagaccactaaaaattgatccaaaaatagaaatgatcaaaattgggtcccacccattcattcattccttttttctcccgcgccgattacttcacaaaaattgatcggaccaacatcaatgttatttatctccttctgttgatcactttctttttcaaaattattgtactgatgggcggtcttttacttgtgcctattccacgcactcatccgactgatcaccgcgagaaagtcatct

SEQ ID NO: 34171 - DNA, 1008 bp, Heterodera glycines
tttttgagagaaattttgcatcgaacaaatgctctgcagcatgagtagaggggcggagagcaatggccattttattgttccgagaatttttaaatttcaagattaggccagaaaagtggctcctcttttttgagagaagttttgcatcgaacaaatgctctgcagcatgagtagaggggcggagagcaatggtcattttattgttccgagaatttttaaatttcacgattaggccagaaaagtggctcctcttttttgagagaaattttgcatcgaacaaatgctctgcagcatgagtagaggggcggagagcaatggccattttattgttccgagaatttttaaatttcaagattaggccagaaaagtggctcctcttttttgagagaaattttgcatcgaacaaatgctctgcagcatgagcagaggggcggagagcaatggccattttattgttccgagaatttttaaatttcaagattaggccagaaaagtggttcctcttttttgagagaaattttgcatcgaacaaatgctctgcagcatgagtagaggggcggagagcaatggccattttattgttccgagaatttttaaatttcaagattaggccagaaaagtggctcctcttttttgagagaaattttgcatcgaacaaatgctctgcagcatgagtagaggggcggagagcaatggccattttattgttccgagaatttttaaatttcaagataggccagaaaagtggctcctcttttttgagagaaattttgcatcgaacaaatgctctgcagcatgagtagaggggcggagagcaatgaccattttattgttccgagaatttttaaatttcaagattaggccagaaaagtggcttctctttttgagagaattttgcatcgaacaaatgctctgcagcatgagtagaggggcggagagcaatggccattttattggtccgagattttttaatttcaagattaggccagaaaagtggctcctcttttt

SEQ ID NO: 34172 - DNA, 818 bp, Heterodera glycines
aaaaaaaggcctaaatatgtgttaaaaaatgcaaaaatatgtgctaaaaattggaaaaaccaatggtatttttgcataaaaattccaaaaactcattctttatcatttttgcacgcacaattgcaaataaaaaacatttggaggtgtttgggggtaaaattagcggtgcatatcgatcgattcagtgccgacgattcagtgacgacgattcagtgtacgttgaaaaaccgacaattcagtgtcagaatacacccctgagaaatgaaaaatttcctcaaaaattttgttattttatacccctaaattgaaactttaacacctattttgaggtttttagaaccgaaaacctaaatattttggcagtttttagttttgaacacccaaaaatattaggcatattaaatatcagggctgccaaaaacatgcaaatgtatttttttcctgccttttccatgctataaataataggaaaaacacgttatttttttgtgtttgcgtagaaaaatcggtatttttatttgcatattttgcatatttcgagatttttgtgcatattttggctacttttcgtgcatatttttggcagcactgttaattatatctcaactttctgttcacattctgaaatttaaaaaaatttgggtccaaaaatatttgagacggaaccgtctcttttactactaagacggaaccggccccagatttatttagcatagagtataacaatacagatcaggcagaatttctaaccactcaatttatattgtatttttagtggctttttgaatgttttttgccaaattttctgacgctgaatt

SEQ ID NO: 34173 - DNA, 1021 bp, Heterodera glycines
  misc_feature (775)..(775): n is a, c, g, or t
  misc_feature (808)..(808): n is a, c, g, or t
  misc_feature (927)..(927): n is a, c, g, or t
  misc_feature (945)..(945): n is a, c, g, or t
  misc_feature (970)..(970): n is a, c, g, or t
agacgaaaagtgaaaaattcaagggccgatcttggcctacttatgctgtacgcagtcaaaggagaaggaaaacaagagctattcggatgtgcatgatgattttttaataatataatcactcccgttagcccttgggaaaggcaattttatgaatatattttttattcacaattggggcgcaaatgtgcggggcgcaaatgtaggggcgcaaatgtaggggcgcaaatgtaggggcgcaaatgtaggggcgcaaatgtaggggcgcaaatgtgcggggcgcaaatgtaggggcgcaaatgtagcacctccaattcaatcgaattttatcaaaaagtaaaaatttggtttgccttttaagcaaacatcatacataactcccaatggaattgaactgccaaatttaaatgcactaaaaaatggcacataaatgaactttgaaaatgtccgaactatgccattgtgagaaaatgccaaaaatggaaaacatttttaaaaaatgcccatgggcttaagcacaaaaacattttgccaacaatcactcattaatttgaagaacttctcatcggcaaattaacaaaacaatggccgaatagaattgggccaattaaaaagtatgtatttgttgagtggtcgtgggaaaaattttgaacataaaaagttcaatttttctttgtacaaaatgccaaaaaatatattatttaaattttcaaattctgtttttattgttttagctaatttaaagagataaaaattaaaaaattaaaaaaattaatanattaaaaaaattttgcaacaaaaagaataaatngaattaagttttgaaactgacaccgcattttcattttttggcattttgtgcagaaaaattatgaggccccctgagaacattgacgtgtgtatgtgtgtaatgagaacgaattgcgctgncacggaaagcgtacaatnaaatacaaaagttgaggaccaccgnaagtcaaaaaaaaaaaattggggcagaaaaaatcttaaatttcccccaaaa

SEQ ID NO: 34174 - DNA, 873 bp, Heterodera glycines
gactaaatttagcatcttctaatcaatttagggaacaaaattagagaattttgaaaatttagattttcgactttttgttcgaattcgggtctgtgattcgaaatttgtcagaatgaatgtcagattcatgttcagcgactccgaaaacccttagaatcatattttcagtgacttttaaaaggtaaatatttttttcaaaaaagggtcctaccatcggcggacggcagtattaccgaaatgagaattgtcaatgccccccccccattggaaatcgttgcaaattccgcaaaaaccgttgccaaagaaagtcgtcggattcgaagccatttcaataaggtgagagaagaattggttgttttcaaatgtaatcgagtccatcatttcattttcacagatacatggattatgataccatcgcttttctccagcgttttcgttcacttttcgccacttgtcaaatcaatttggccatcgaaacgacgagtgttcgcatttcggagttcattttacttcaagcaatgtgccgaagatgttggaatgccctttggacttggatgatggaattttggcgtcgaagattgaagccttcaaagcggtgcttatctaattgagttattaatggggctagcgaataacgcatctttggttttttatccccccccccaccaccagccgaaaagtcatcctttcatatttctttaccattttcccatattttaggcttttgccaatgcttcttcccccgtcaatttattatcgtcattttatttattcggccgtcttttgctgggtccgctgtgccatttgatcggatcaacgattttactcgtgaacaattgacgttgaaaacagcaaataattcctggcgttttt

SEQ ID NO: 34175 - DNA, 1018 bp, Heterodera glycines
agatgagcaaatatacctgcattctggcgccattttgtcattatggtgataaaagatcgtgtagtccggggaaaaatttcaggaattaatttttgatttttttaaacgtaaaagcccctagaataaattaagatgatcaaatatacctgcattctggcgccattttgtcattatggtaataaaagatcgtgtagtccggggaaaaatttcaggaattaatttttgacttttttaaacgtaaaagcccccagaataaattaagatgagcaaatatacctgcattctgtcgccattttgtcaatatggtgataaaagatcgtgtagtccggggagaaatttcaggaattaatttttgacttttttaaacgtaaaagcccccagaataaattaagatgagcaaatatacctgcattctggcgccattttgtcattatggtgataaaagatcgtgtagtccggggaaaaatttcaggaattaatttttgatttttttaaacataaaagcccccagaataaattaagatgagcaaatatacctgcattctggtgccattttgtcattatggtgataaaagatcgtgtagtccggggaaaaatttcaggaattaatttttgatttttttaaacgtaaaagcccccagaataaattaagatgagcaaatatacctgcattctggtgccattttgtcattatggtaataaaagatcgtgtagtccggggaaaaatttcaggaatttatttttgacttttttaaacgtaaaagcccccagaataaaataagatgagcaaatatacctgcattctggcgccattttgtcattatggtgataaaagatcgtgtagtccggggaaaaatttcttgaatttatttttgacttttttaaacgtaaaagcccccagaataaattaagatgagcaaatatacctgcattctggtgccatcatgtcattatggtgataaaagatcgtgtagtccggcgaaaaatttcatgaatttatttttgacttttttaaacg

SEQ ID NO: 34176 - DNA, 1206 bp, Heterodera glycines
attcctctgactcatcatttcgttctccacttttactttttgaataaatatttgtctttactattttgttgtgccaaacgcacgacacaacacatattaattacacataaaacataaaaataaaagctatgcttctcaaattaaaatatagcaaatcattcccgaagaaaattaattaaagccaaaaatcagcaaaaatttctaagataaaactaatgcctttatatttgaaaaatccacatatatacaatatattattatacaaattaagatgagaaaaaaggcgacaattaatccaaaaaattaacaattgatttgaaaataaataataaactcaaaataatcagttgaaagagcagttcaatagaatcaggcttgagaacataatgaaatataatatttttatatttgagaattttacatattacaacaatgacttattatgagaaatattaataatcaggacaacaattcaaaaatcatatgcttactcatttttcttgcgatggagcaatactgcatgagtaaattaattatataaataaaataatacctcaaaaaaccccatctagatatgttattatttaattttaaattttgtaaatgattaaacttttaatcataactaaaattaactaaataaaattaaaattttgaaaaatataaatattcattaaaatattatattgacgaaattgataaccaactaaaaacaaaagaacagaaaaataaaaatgacttcaaccttaattaattctagggttcggaccccgcccccgtcacccccgcccccgccgggggcgggacaggttttttggcctcacccccgtccccgcccccgtgactctgacccccgccatcccccgcccccgcgaccttcacccccgcgggggcgcgggggtgaaaatacacccctaagaatgacatattaatggataaaaggcaaaaaaattatacaattttgatttttttaaccattttgacaaattttttatgaattaaagttaattttattattggtcattgatgtgtagtttggtgtagtggttagtgaatcaaccttgacattactttctgtcgtgagttcgattcaggttgacggtttcttttttaatttatttttttaattttaaaattcgcctggcgctgcctatcggcatcgcagggcccaaaaattcgtaaatcttattaaaaaaattctctaaa

SEQ ID NO: 34177 - DNA, 993 bp, Heterodera glycines
atcagcagccgaatggatcggtccaacgaaatttaatgtcttttttttcgtttttgccatagaaaacttcttaattctcgatattacaatacactgactactactgcttgttgatggtgattttccctcatttgaacacttttccagaggcatataattaattaaatttgtatttttcaaaaaattattttgaatgtcatttttgtgatcactttgatcaatgttgaccttgaaatgctccggaaaaccgcttttttcataaattattctcaaaaatgacggagtaagacaccatcagcatttctaccattctctacaccgtaattacccaataaagtaattaattgtccacgccaatttccttctctctaaattattattattattatttttgttgatcagtttagcattgtcacaccaccacaaattgccgctgtttgttgccatttaaaaaacaaaaaatatgcacttcatttcacttatcaaaatatattatgccttggccatgttaaatgcatatcacactaataataagtttgacctttgccagcaaaaccggtttatcaaaattagttaacttaaattagattttttgtttttcgaaactttccaaaagtttaaaaatcttttaaattcgaccggttttgtacgaccaccactttagtgacgtatttccccatttatttatcactttttcgaaataaattactaggatgatttaggcaacacatacgccccaattatgcatgaattgttggcattgaacacactgaagatcacgggcggccattttggctatgccaaattttttggtttaattcgtaatcccggcaaatcaccgcgggttcctttccggcggtggtctgtccgcggtatgctctcgagaggaatcctttgaaaaatataatttgataataaaagtatcataaatttgaccgttatcttccattaatgttctttccgttttaaccctacctacataaatatttttaa

SEQ ID NO: 34178 - DNA, 1051 bp, Heterodera glycines
ccagaatttaaaaatacagtttgctatggcttcgcatcactcgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatagactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttccacgggtgctcagtgtaaatatagactggccattcaaattctgctttccagccttatggaaagatattatggaaactttggtccatctcagttgtcaacgccgcgactgcatcgttattatatcagtcgatagaattttcgaatcgcttttaaatcgtctcttt

SEQ ID NO: 34179 - DNA, 1026 bp, Heterodera glycines
cctcactttttcgctcactgtctatgtgtctgctgcccccgtccgccttccactatttcgccggcacgcttttgtgtctgggcagtgtttagttgcgcgctttgcacacactatttcttcgggatttttttgcctacccattttctatctctaattccctctctctctcgttcgttgaaattttttaaaacgaaattctgcgcggcaaaaatttcattcaaaaattttttgggggcgacggccggcgggggaattaaattgcacctgacatttgtaaatagtttctgggaatgcattggggagacaacattcccattcatttattatttaatggcattcattccttgacaatgactaacccatccgccgccggcgttatttaacccatcccttaaacgattacaaaaaaaacaaacaaaaagaaattacaaaatgccaattcccctcgggggaaaagggactcaaatttacatggtgatgctattgtaatttattttaaattaggtagataattaaatgtatttcaaatttttaaatagttaatcccttcaagaaataatttttaaaaattaagaaaattgatttcctttattccttcctttttttaatttcaatttaaattccctcggggaaaaacggactcaaatttaaattgtgatgccgctggaatttattattaaaatgagtagattatattaaatttaactttaaataattttcaaacatttaatccttataagaaaagaattcattaattttaaattttttaattaaaaatatagtgtcctttattccttttcaatatttcaattccccgagggattgaatttaattggcaaaatgaagatgccaaagggttttttaaatttattcattcgagaaattaaagctgagaaattaattttaaaaaagttttttgccctcacgatttttaaataattcagagaacttaagatcgatttttcaatttttgaaaaatttatttgaaatacaaaaatcccttatgcgctcgactaatctttgaat

SEQ ID NO: 34180 - DNA, 1114 bp, Heterodera glycines
  misc_feature (38)..(38): n is a, c, g, or t
gtgtcgggttaattgttgttgttccattggcacaatgnatgaatagagaggtgccaaagctgctgatgggtcctctttttctagaatttgagggtaaatgcaacaaattttgccaaattctcaagaagtgatccttggagaccaaaaaattttaaaaaacgcgaaaatgtgagaatttttggaaactatttttgagatcctcaagagtctcgtcacttcatttaccagcatataatttgtcatcgacttcctcctcttcctcatcatttgatgcaaaactgacggagcgctgctgacgaaaataatcataattgtggacgcacaattctgacattttggttatttttcttttcttaaaaatagagcccttaagaatttttgcaaaacgattctcgttttagtgccaacttttgaaacaaaatttgacaaaagataatgaaaaaattccataaaataaatagggaaggcgaatgcttttccctgacaaaaaaaaatattttactcaaaggcatttccaaatccaattttggtcaatttgtgcacatcaatcccgcgtcattcctgtctctcatgccactgcagacgatgtctaatgacatttaatttagcgcagttaaggcgcggttctctttgcgttgattgacatgaaattcattagccgattaccgtagtaaaccaaaaaaagaatttaattaaaggaggagttactttttttttaatttaacaatatatatgtattgaaaatgtatgcattttcatttaaaaagaaagcatcaaaaaattatgcatggacaattttccttccatttggccattcatttgcacttaacttccacattccttcaatttttgtgacaaatgaaacgaaaaattaaacaaaaatttattgaatgaagtgtatttaaataagagttataaattgtttagtctttttttaaacttttctttcaatattttccacttttttccttttatatatttttggccctattggaattttaaaatttggtatcattcgaaagcttttgagaaccggtttaaaaataaagtttaaaccagggctcccagattaaaatattcaaaagcctcatttgacatgcaaaaaatcctcatt

SEQ ID NO: 34181 - DNA, 910 bp, Heterodera glycines
ttaaaatgtaaaataatctaattgaattgttactacaaatttcaaatcaaatatttcaaaaatccaagcaaaccagccaaaatttgtgcgttttttgaaaaatggcaaaaaatgccaaaaacgaaaacaaaaaatgtgccgtgccgtcgtccgcccactcacccggcaacagatgggaggagtaatccacaaaggtggcattccagtgccgatctcgccgcttggtgtccatcatttggatgtggtactccgtcttgccaatgtgcaccgcgttcggcatgttggccggacacaccgaactctgcggggtgggcgaaaaggtgttgctccgctcgccggtctctgacaaatgggcacaaattttgggattttttttttaatttccatcgaaaaaagggacaaatttttcgcttatacattttaaaaaattcgccaaaagaattttatctaaaatttttgtatttcaattttaaattgcgcgaaaaatttttgaattttgaaatcaaaaaatttaatgcgctattaaatgcaccccaaaaaggggtccactgcgtttcggcgctcccgtttcggcgccagcatgtttttggctataacttttttctttgtaaaccaaatccaacattgttggtgtcgttcgaaagcttaatctatttagaagctttttctaagctattgctttgcgattagacaattatcaaaacagttatgcatgaaaattgcgaaaaagtcgaaattttcaagttttttcttaataaaattttttacaggcttgaaaaacttttcgtttttgataaggctaatagagcatgttaaaagctttcgaatgataccaagattgttggatttggatgctaaagaaaaaagcttaagtggaaaaacgagctgcgccgaaacgcgtgggtccctt

SEQ ID NO: 34182 - DNA, 962 bp, Heterodera glycines
  misc_feature (820)..(821): n is a, c, g, or t
  misc_feature (868)..(868): n is a, c, g, or t
  misc_feature (878)..(879): n is a, c, g, or t
  misc_feature (884)..(884): n is a, c, g, or t
  misc_feature (911)..(911): n is a, c, g, or t
ctcgatgactgtgtgcgactcgagccatggtgaaaagcgagaactccacctcgacaaggcgttgaatgaaggagtaagcaatttgaatagtgtttgaagaagcgaaattggctggcctctcaaaatcgcaaaatttttggcttcattcgccaagttttggcctcattttgcactaaacgtttgaaaaaattatgagaggagaggtccattggtgcccacttgctcctcagtcaaattatggcggcagaaaattttgtcattttctcctaaaaattttcagaattgccattacaaaatacaaaatatcccctcccattccctaaatttgaaaaagacctcttcggaccccgaggggtgccgttaggccttaaaaattgaaaatgttgcgtgtatggaaagcattcggcattaaattttgaatttgtcgggagttgggagaagcaattattcttgaagcgtcttaagtactcatttttatgtaggtgctcgatgagaacggaaaattgaagcacggtggtcgtcggctgtccttgtttcaagggataggcaaaaaagtagcaaagtgctctgggggaacggacgttgaccgtggaaaaaagacaatctatttcgattcgaatcaaaccgatgtgtccatgttcggcaaggtgaagtttagactgtttaaaatacttaaaaacaatgcaatgttcgattttgtgaaattttagcgttcccattatttgcctccgctctaccaacccgatgcaagaccaccagtgatttatggaaatgatttttaattttttaacaagggagcaaccaagtcgaaagccagaannatccggagggaaggaagccgcacaccttttttgctcttcagcccganattttccggnntctanggtttcgacttgggtctaccccacccnccgggcgacgaccttttttgctttcctccaattttctgcacattttcaaaa

SEQ ID NO: 34183 - DNA, 900 bp, Heterodera glycines
ccgtgccgaactcacaaagttatgggagtgaaatggtgaaatatttgttttcaccacaaggcattttttctgaaaaccggattcaaaaatctggggtttggtataaccgttttagaaatagcgcagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccatacctacttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgcagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttggatttatttgacaaatccaagac

SEQ ID NO: 34184 - DNA, 1162 bp, Heterodera glycines
gatttaagtctctcccaatttttaaattttcattcgctcagaggcgtggcgcagaaacatcgaaaatcgactcgtttcgaccaaattcaacttcatttcgttcattgggcatgcccaaaacggaagtgttgtcgagctgctaggcaagaagcaaatgaatgtaagtgcgacggatcgtatccctcgaatatcaagagctcaggtgacagacaatatcattagcaagtaattataggaaattatatttcatttggattatagatctctgatgccctctattcaatgggtaacattgacgcgtataaagcggcgatagaggcagcaaataatctcgtacgtggtaccgtcgagtccaaataacatcggcagctagtatcgcacccactagagctggtgcggtcggaggtggaaagttccgcagatcgtcatggtcccccgcatagtattaagtttcacagctcctccgtcctcatctcgtactggtaccccgagtggtgatggtacagagactcgtactaatttttgccaactcgtactgccccaactcgtaatggtaccccgacccgtgataagtttcccaactcgtactgccccaactcgtactggtaacccgactcgtactaagtttcccaactcgtactggtaccccgactcgtactaagtttcccaactcgtactgccccaactcgtactggtaccccgaatcgtactaagtttcccaactcgtactggtaccccgactcgtactaagtttcccaactcgtactgccccaactcgtactggtaccccgaatcgtactaagtttcccaactcgtactgccccaactcgtactggtaccccgaatcgtactaagtttcccaactcgtactggtaccccgaatcgtactaagtttcccaactcgtactggtaccccaactcgtactaatttttcccaactcgtactgccccaactcgtaatggtaccccgactcgtactaagtttcccaactcgtactggtaccccgactcgtactggtaccccgaatcgtactatgcctccctactcgtactggtaccccgaatcgtactaagtttcccaactcgtactggtaccccgactggtactaattcttcccaaatcgtactgccccaattcttaatgccaccccgacccgtacta

SEQ ID NO: 34185 - DNA, 876 bp, Heterodera glycines
agtgattgtaatgctggtgggtggagtagcagtgattgtaatgctggtgggatgagtaccagtgattgaaatgctggtgtgagtagcagcgattgtaatgatgatgggttgagtaccagtgattgtaatgatggtggtttgagtaccagtgattgtaatgatggtgggttgagtaccagtgattgtaatgctggtgggttgagtaccagtgattgtaatgatggtggattgagtcccagtgattgaaatgctggagaattgagtaccagtgattgtaatgctgttgggtttagtaccagtgattgtaatgctgttgggttgagtaccagtgattgaaatgttggtggattgagtaccagtgattgaaatgctggtgggttgagtaccagtgattgaaatgctggtgggttgagtaccagtgattgaaatgcagaattgagtcccagtgattgaaatgctgttgggttgagtcccagtgattgaaatgctggtgggctgagtcccagtgattgaaatgctgttgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgcggagaattgagtgccagtgattgaaatgctggtgggttgagtaccagtgattgaaatgctggtgggtttagtcccagtgattggaatgctgttgggttgagtcccagtgattgaaatgttggtggattgagtcccagtgattgaaatgctggtgggttgagtcccagtgattgaaatgctgttgggttgagtcccagtgattgaaatg

SEQ ID NO: 34186 - DNA, 949 bp, Heterodera glycines
taattggccgagtgttgttagctttatgcctttttgtctgttccaattaaccctaattagggaactcactaatttgctcctcctctttcattgctttcggcgggcacaccctccccgccctcacatcgtcccaatagcgtttgttcaacaatttggcggggtgtggcctcggctccacgctccgctttcggccccctccgttcaaattcaaatggcccttcgtaatggcatttgccatcactctttttggggtgtcaaaagcttttctgccaatttctgccgaatatttttgttgcttatcgttcggattttcgctggacaattgttgagttttcatttgggaataatttctgtttgaattttgggaaggccttaaaatgccaagtccttttaaataatcttcgaaaacaaaagggatacattttcttcctattgaaaaatgaagcgacgaaaaatttcggccggcgttggttttatattttgggatggaatgccaagcccatgtgctgtgggagggatggggggagggaataaacaacatttaataattactaaataaaattactttgcttaaattacaatgcaacaaaaaattgttatgcaggactaaacatcgtattctaaccgaagcaatgcggtaacgaaagttttggtggtaattttttgaaattattaaaatgaataaatgaaaatattaaagatgatgacacttttgtttgtcaaacctacacttgtgatggtggaaaatgtaagaatcttttatttgtgcttcgttaattgacctaaatataaagcattaaataaaagtaattcacactaatgacgtcatctcaaatcacgaattattattaccataaaaatacaatttttcattttgattagatttctttttatctccgggttgacgaattgtgctttcagtgccctttactttccgcgaatgggccaa

SEQ ID NO: 34187 - DNA, 1209 bp, Heterodera glycines
  misc_feature (73)..(73): n is a, c, g, or t
attttctcccggccgaaggccgggagcgccctgaaagcgttggaagggtcttacaactttttgaggagcatcncgggaaaaatataggttttccggtccaagggccaactgagtaccagggactgatttctcattttttcgtgcgtttgacggcccctaactttttctgtaaaactcgaatcaaaaactttccgctggtaggaacctaagttgaagtgttgtctaaaagtcaaaaaaaattccaggcctctacctatagtaggaagggctgcagaaaataggagaaattcagtatcaactttgtccacttcagtcccaggtgaataccgcgtcagcgtttgatctgagcgagggggctccagcggacttattgtagagctttgaaagctcgattttttaaattttaaaatttcgaaaattttcaaaatttttcgagttaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaaattttggcctgagcgggacatttgagtcccgggcctataactcggcaggagttaagtttatcgaaaaaacgccttagggcaaaattgtagagcttttaaaatgctatcgaatagtgtattatatggccggaaattttcaaaaattttcgagctaggccccctagaaattttcggaaattttttttgggttgaaaatgagggtgaaaaatttttttctgggtatttttaaggtgctgagtacgaatatgatgtctattttaagtttcagaatttttggaattttttaaaaattcgaaaatatttggcaattttttggccctcgggattttggcctaatatttgaaaattcataacaaatcgaagggtcgataaattttacaggaataaagccttaaaaatagagaaaaatcaggagaattttatgggatttaaatgaaatttatatcttcaaatgaaaaaaagttattcaagaatttctggaaattttcgatttttcagaaaaaaattcagaactcggttctgaaaagtcattctgtaaaagtaaaatactacaaaaatccgcaattttttgctctattaaataaaatttattttacatttttatcacttttttaa

SEQ ID NO: 34188 - DNA, 919 bp, Heterodera glycines
tcgtacaatggagtttcgtacaataggaatttttataaaggcttagaataagcataagcttttggattaagcttaggcctgagcctaggcctaacctatgcttaggcttgcttgggcttaggcctaagtttaatcttaggctttattttgtaaatttgttaaaacaatttttggacggttttaagcttttgaatccggagcaagaccgtgaagtaccatctatctttatttataatgaaagtggcattcttgaacccgagcgtttgtctcagaaatctatgacgaattaacatttaaaaattagcggaatttattaaaatcgtaaaatttttactgttatttgattatttatggttataaaatttaattaatattttgagtcacattaaatataaataagaaactatgtgaaggaaactaaatttatttatttaatataattttctgtactgaaatgaccccatccctctgaaagtctctcactgatatttttgtcacttcgcccacactgatgcaaatgggaccagagcgtttgggcccccgtttttgggcgaccgcgaccgggccaacaaaaaatggccacaacatctaatgtgattataggcattggtaattgccatgtgagcaaatcttggcggaagactacaacgaaatgaatacctattattccaatcatcagttatacaactaagacaaagcaacacagctttttaaattttgacagcaaatttgccgaaaaaaataaacaaaacgatatttcgatcactttttcccgatcacattttgcttatcactctattcttcacatctcaaatggagctcgacaatgattgctgctgctgcttttgatcaatgccgacgtcatcatacatgatcaaggggtggtctattaccaccccccccccccccatcgttcgtc

SEQ ID NO: 34189 - DNA, 1259 bp, Heterodera glycines
  misc_feature (36)..(37): n is a, c, g, or t
  misc_feature (42)..(42): n is a, c, g, or t
  misc_feature (75)..(75): n is a, c, g, or t
  misc_feature (104)..(104): n is a, c, g, or t
tcagggagttgtatgtaaatagtgagtttcacactnnttacnaatagttgtgagctaattagaattcccctaatntaatttcgaattctccatataaattaatntaattcttgacactttttcgtatatttttacaatttccaataactattttctacaaaattttaatgattattttaagcccaatcagtagaaaccgaatttttaagttttacctattttttcttgcatttcttattgcattcaaagtttctttatttattttaaattctgaagaaaaaaagacaaattttgtcacgaactcgaaatgaattgatttacaatttttgtgggaaaaacgatagaaatgatattttctgggatttttatgcataattaacttgagagtgcacatatggcatttttctagttttcatcccctatttcagcattttaagcacataatttattacatattaaggatctttagcacataaaaagtgagccttatttatttggtcattttattggtattctatgtattttgttcactcttctatgaagtttttcaaaaaaaatcttaaacattttttttcgcattgtttggtatatatttggtggcttctatttttcttatatatttatgtgttttacttattttacattttttgcgatttttttttacatataattcccagtttttataataaaatacattatttcaattatagcacaccgtcgggaaaaagagaattggtgggacttttgcgtgccgggccgcgctgttgccacgcgggaatgcgcctgaacagtccaattgagcgtaatgtcgttcccttttcgctggggatccgacgttgggtcagcaaagtcgccaacaatcatttcatgtgtggctcacttggcgcatgtcctcgtcgaaagaaggttgcaaaccgccaattcgatgatggggatgattatatgtaaacagcggaatcggacggagtatgttattagttacaaaaaattaaaattggtaaaaagattttgaccgtccatcctttgtataaaagtcgatagttttttaaaaaatgagttttttttaattaaggaaaattttttaattaaaaaatatctaacaaatttcgctacttttaaaacataacttactgaatttcaaacactttcttagtcaataatgcataatttgtttgtttctgagaaaaaaataataattttcctaacaaaaaagtggtatggcccatttaagaaaccgataccattttatctcatgacct

SEQ ID NO: 34190 - DNA, 956 bp, Heterodera glycines
tgtgatgcttcttctaccttttctacgatgcttttcagccattcttcacggctttcacacagtatgtccccgtccttcttgtattttcgttctttgaagcgtggcaaagtgatgttcattatgttgaaagtgttgccggtaaaatctcgctcatcagtgtttccggcagtgccggtgatcgacgttatgtcggcctttttgctcagaaagaagccgagattatttttgtgggaaatgtgcagggacggcggggtgagctccacgtcctgcaatgactgaacacactgatgcagtccgttgctgtactgcgagttcttctcaatgatgccgctgttcatgttgtccaccggcattattctcagcggtgccgccatttgtaacattttaccaatgccgccgctgccgtcgttggcgttctgctcgggaaataaatggatgaacaattcagctttttgactaattcgggtttcgatcacttttatttgttttattgcccagacgtttcaacagcaaaattgattttcacttagataaacacttaagcgtgccggaaaagcttttactgtgaaaacttagggcgagtcggcggctttgaacgggtgctgctggcttttccgaagctaatgttctaccagctgaactaccgagagtctgccctcgccagctacccaattttctcaaacatcaattttcgattaacacattaatttttatctcggggaagtgtctcttcatcatgtatcaaaaagccaaatttttgattgaaattatttgacacaaattaaatttttgctgagaaaacaatagaggaaatgaatgggtggggagcagggctgggcgcaattggattttcaattacggaaatccgcaattcccaattacgggggtccaaaaaccccgcaatttccgtaatccccatttttcaaaaatctttttttaattttaaattttttttt

SEQ ID NO: 34191 - DNA, 189 bp, Heterodera glycines
gggggtggggacatttgttggggagaaatggacgtaggagagtagggcggaagcaggcggacagctgcttctgtcctccgacgatggcacaccgtccccccccccatccccccatcacaacgacaccaaataccctcgagcaagaaatgagcagagggtgacatgaccacggcaccccccgggattcat

SEQ ID NO: 34192 - DNA, 1018 bp, Heterodera glycines
  misc_feature (21)..(21): n is a, c, g, or t
gattatggccaatcgaggcgnatttgttggccagcccttcctagagagagagagagagattagagtgaaaatgtgtggggaaggatatgccattttgcgattgtttgggatgagcaaagagagtggagagagggggggagagagagacacccgtccaaaagagaagatgcatcgattgatcagaagcggaggggaggacagcgagcgaatcagtgggtgggtgagtgatcggactgaagcaaaacagcagcgtaagaaaagtgccaaagccaagcgggcgatcgatggcacctcgccaccagcaggaagaagcgccaattctgtccggcattcggccgcaaaagcttgcattcggtgtttgacctgccgactcggcgctgccgcgcggaatgcctttccgtcatcacctgttgtccatcaatctgtccgttcagctgctgaagttcatttgctcatcatccccgggaatgccattatttgcataattggcgccaggtccaaacggcaaactcggctgaaaagttgagtgatcagcaactgatcaacaaataaatgaactggctttttcaaacacagagatttgccctcgaaaatcggactttgtcctcaaaatgccaagaaatagtctccaaaatgaatatgagaattacccaaaaaatgggagattggtccaaaaagcatagactcggggtgctttcgtttgttttggcactttgctgctgatttggctttttcgagtcgcttttacctgctgtactgcgatggttggcacacgttgcgattggggcggagtgttattggcggacgaattctgagcagcggcggacgaatggtaaaagggcgagccgaaatgggcaccctgaaaaagagaaatgataaatgattgtttaacagataattgagttacacataagctaatcagctgctgattactcaagaaacgattattcaaggaaccaattggttatttaatgaataaataaatcacaactgatcgatgtttgtaaagcaatatcag

SEQ ID NO: 34193 - DNA, 900 bp, Heterodera glycines
  misc_feature (80)..(80): n is a, c, g, or t
  misc_feature (114)..(114): n is a, c, g, or t
  misc_feature (139)..(139): n is a, c, g, or t
agaaggtgctcatccccagtttcgtcatccaaaggttttcttccccaccctttttcattaaatataatcactgttattgngattcagtttaattttgtgggcaaagttctgganccaaaagggcacgacttgcaaaatnatcgccaaatcatacaaatgtcacgtgtacattttggggcggggcagcactcgcgaccgaaccaaaggagcaggtaattctcactcaattttgtttttcttttcttttcatttcttactttcttttgttctcataatggctatttctatcgcttggtcttctcaaaccaaatttcccaggaaatgctcagcagcggcgacccacagtacgctcactacggtgggcctttacacgtcaaagtggagacgactgctccgcctgccgtcgcttatcagcgcgttgctggcgttctcgccgtccttgctgaactgctgcaaccagtgaatgaaaaaggatggcaatgagaaagtacattcagattaaggtcaaagacacacacattgagggcatcacaacggagcccaacccgaatttgaacgcattggaagggggcggggacagcgacgggggaggcgactcgaacggagccgaaggcaatggcgaagaagccggaggaccaagtaaagcttgatagttgtactgaaactgccctccttcttgacaagaattatttgtcctaacgaagaagttgtctagttgttaccaggggtattcagggttgacggccacaaaaatggcacccattttgaccgtgtttgaatttctaaccagaattccattaaaaatcacccattttcgaatttcggaaccaaaaagagagtggggtctatagagagttgtaatggacataaattggcttgccatttttttttgggggggga

SEQ ID NO: 34194 - DNA, 642 bp, Heterodera glycines
ccaaaaactcgatctttaggggtgtatttttttcgaaacttcgggtaaattgcccgaagccgaagcacgaagttcgaagctcaaaaaacccgaagtttttgaagccgaatgtatattatccgattgaagtttgggcatcaaagttttaggacaaattataatagtgaggtgcggggcattgtacgcaaaaatacaatttttttcattatttcgtaaaattcatttaaaaccaatgtttggcacaacagcaaatgttcttgaaaggaatggaaattagatgcccaaattcgtctcatttcaacgtgttttttgttgaaacattttttttttattttacaaaagtcaaaaaaaaatttttgtttttgctatgcctttcgaaaggctgtatgacatttcgcctactggacatttcacctactaagccaacatttggcgttccgcctactaagccaaaatcagagatttcgcttattgacattttgcctactgaacatctcgcctacggacacttcgcctactggacatttcgcctactaagccaacattggacgtttcgcctactaagccaaaatcagatattttgcctattgacattttgcctactgacacttcgcctactggacatttcgcctactaagccaa

SEQ ID NO: 34195 - DNA, 750 bp, Heterodera glycines
tttttataaaaaatttcaaaaaaagtgctaaaaatttggaaaataaatatagacttgtaggagtaaaaaattgcggttttttgggtgtatattaattacttttcagaaaatgtattttcagaattgagatctgaatttattctgaaatttgtaatttttccataatttcaggaatagcttttttaacttattaaaagatgtttttcttataatttgttatataaattataaaagaatggtattttaattttaaaaaaataaatataaattatttaatttcatcaaaaatttatttaatttaaataaaataatttattaattattaatagcacaaaacaatgtaaattaattaaaatcattgaaaaactagcgaaaataaatcccccccccccccccccgcgggtccttcggcccccgcccccccccccccgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttt

SEQ ID NO: 34196 - DNA, 858 bp, Heterodera glycines
  misc_feature (839)..(839): n is a, c, g, or t
aatggtgcctttgttccaaatttgttggttggcacggagaaattcgatgacggaatggtcaatgtacctgaaaaaagaatgtttttttattaattgtttttgaatttcagttacttaatctgaaggtaattaaagcgaattttgtcgggcaacggacggtcaggcaatggaaatggcacagaattgccattgctcaatttaacgacacatagttttgcttctgttcccatcctttcaattctgattggtccccaaattggcaattcgcttttgccatcgaaatgtttgtccaccaaaacatcgaaacgaggcgaaagaagtgccattttgaggccagttgggcgcggtcaaaatgagggaaaatgtccatcaaaatgtcgttgcaaatccaactgaaattgtcaaaatatattgaagtgttcttaaaaatgaattcacaaattcttaaacgaataaattctcacattttcttcaaaattcgcttattcattttcatggccacgcggagacaatcagtttgtcccattcaaaatatctagacaaaggacccacagacaacgtaatgtttatttttttgaatttctatgttgcaattaaattgagaaattgccggaggcgacaaaaagagttgaaacatttacactttgttgaaaaaatgaatttttaagctcgcaacacccataattttaaatgcaatcagccgcttgcaattctgatctcccaattttggtatttagcatttattcagagcaataatacgagatgagcaatacaataatacaattataacgcggacaaacatccaatacaatacaattataacctccgacaaacatccnaatacatacaattataccc

SEQ ID NO: 34197 - DNA, 435 bp, Heterodera glycines
agtggcccaccagcagcaggggaaagggagggaggggaatacacccacgtatataaaggaaaatagggagagaaatggagggagagagagagagggggacaggcggtgagaggggcgagggattactgccctgggcagtacaaatatgcagccgaagagagcacagtgcacactgcccctccaccacctccagcaattctcatccatcacacccaaatccccccgccgaggggagggggggggggacaaagcggacagagaaagagtttaagaagaagaagcattgggagcactaagcagcagttggatgatgatgatgaaaagggaagaggaaggagaagcagaaaggcatcccctccctttgcttcctttcccccgaatcattcgtacccctcaagaagaggggggggggggggggtaagtataatctttttt

SEQ ID NO: 34198 - DNA, 869 bp, Heterodera glycines
cattttgtttcttttcctcttcctcctcctcttccccatcattttcccccaaagttgactcctcccctcgtcttcctttctctcctccttttccattttcttccgtttcctccttctcttcagtccgcttttcctcttccccatccgttgtgtcgttgttttgttcaaatttctgcttcaaaaattggtcgacaattgctttgatcagcaaaagtgtaaggcaaacggcggcgatcagaagaaatggcaaaagcaaaaaatggacaattctttgatcagttgcgattagaagtgactgaaaatttggggatgaaatttgcaattgttccaattataaatattatcccacttcttatagactccccgtccaatttgacccctaaaaagatttattcaccacctcatgtttggccattttttcgtcgatcgttgcgctgagaagcgactgaaaatatgcaaaatttatgactttgtcattaaagagtttaaagttgtaagcaattaaataatttttaaattcgaaatttcatttttgtaaatttttgaaaaaaagacatttttttattaatgcctccaaaaaattgtgacttaattactacataattagtacctgaatttcttttgcatttgccaatttggccatcgcctgcggaaaaattggaatttaaatttaaaagaatttaaatcatttttcacctgctgttgctccaatttgacataaattctgtccattttctctgtcacaatttccgtaagttcagtcgccgtttttgcaattaactgaaaattgttttttgaattgattacttttgtacttatcaaatatttacaaaaaaattgtcgaaatattcttgtaaaaatttacggaa

SEQ ID NO: 34199 - DNA, 739 bp, Heterodera glycines
  misc_feature (663)..(663): n is a, c, g, or t
  misc_feature (668)..(668): n is a, c, g, or t
  misc_feature (671)..(675): n is a, c, g, or t
  misc_feature (677)..(680): n is a, c, g, or t
  misc_feature (683)..(685): n is a, c, g, or t
  misc_feature (688)..(688): n is a, c, g, or t
gggatttggatatatcatagcaaaaacaaaacgaaattagagggatttgcatagcaaaaacaaatgaaattaaagggatttggatatatcatagcaaaaacaaaacgaaattagaggggggggggggatttggatatatcatagcaaaaacaaaacgaaattagagggatttgcatagcaaaaacaaatgaaattaaagggatttggatatatcatagcaaaaataaaacgaaattagagggatttgcatagcaaaaacaaatgaaattaaagggatttggatatatcatagcaaaaacaaaacgaaattagagggggggggggggggatttggatatatcatagcaaaaacaaaacgaaattagagggatttgcatagcatgtccgcatgttgtttttgggttttggttttttcgtggctttgccgtgccgtgttttgggggggggggggggtttgggtttttcgttgccggggccttgcgggttttgtggggtttgcgtggctgttcccgctgggttttgtggggtttggttttttctttgcgttgtttccccggtttttggggggtttgccttgctgcttctgctgtctttgtggggttttggttttttctttgccggttcgcgtcgctttttgggggggggggggggggcttaaagatntcatngcnnnnncnnnncgnnnttngaggcatttaaaggcaaaaacaaatgaaattaaagggatttggatatatca

SEQ ID NO: 34200 - DNA, 1312 bp, Heterodera glycines
tacaatgatgttgaacagcgtgacggtctgtgttgctcgtccggacgggcaattggtctacagagcatttcaaataattttatactatcgtttaaaaatattttaattttaaattttttattaaataattaattaattaataaaaaataaaatcttttcactctgtttatttgacatgaatattatttgaatattgtgatatggattatatttttgtttagtgcagcacaaaaacatacaaattatttaacatatatcaatgtgaattggtcaattaaaaattgccaagtatggtagccttttgcctattatggattttgaaaattacggtagccattttctgtgaattaatattaatatacatcacacatattaaattcgtcaatttggtgtaaaacaaatcaattaggtgcaatgaaaataatttttcgagttacggtaaccgtatgcattagtcatccacaaattcatttttttcacgcatttcaaatgtgctgcaaatgccccaatcacgcagaagtgtcactataaagtgctggtgctaattaacaatttgaaaaataaaaaacaaagtataaaagtgcccaaaatatgccaatcattaatttcaaaaaattttttagatcggccctttgtaaatataaaaattaaattttccgcagttaattaaccttaatataaaaaaagaaaaataaatatctccagaaccactcataaattttagtgccattttattatggcacaaaataaccaaataatcttacagattgttgttgttgttgtgccaatagcattggatgcagaagttttgctggcgctggcactcgctgccgcccgtgcggcggcggaaatagtcgcggtaccactcaccgagtgcttgacgctcgctgatgttgaactttacgctactgatgaccgaggaactattgactctgcaactttggacaaatcaaaagactataaccgactaaacgtctaggcgccgaaaaaccacgatattgcaccgagaaagagtgacgtttgcgcgatcttcaagctctgagggccactaccatgtaaaagttgtggtcatgaaaccgacattggaatttttgaaagaaaaataaaatacaaaattcaatatttgaatattgatactcgagagtctcgaccctcgtgatgtctttttctctatgattatgtgccacgccatacaaatgttcccctctcaatctctcaataaaacacacactcgccatgtctttggttctctgtccatcaatataaatttggatatctcacattaccttttgtttctctgtttacataaact

SEQ ID NO: 34201 - DNA, 1064 bp, Heterodera glycines
  misc_feature (98)..(98): n is a, c, g, or t
  misc_feature (153)..(153): n is a, c, g, or t
gtcgatatttacactgagcacccgttgaaagcgggtgatgcgaagccatagcaaactgtatttttaaattctggccgcatttctaccaaaaacgtgtntagaccgcagtaactcggctcagagtgaagattaagggacgcaaaagagacgatntaaaagcgattcgaaaattctatcgactgatataataacgatgcagtcgcggcgttgacaactgagatggaaccaaaagttccataatatctttccataaggctggaaaggcagaatttgaatggccagtctatatttacactgagcacccgttgaagagggtgatgcgaatccatagcaaactgtatttttaaattctggcagcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatgaccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagatgatttaaaagcgattcgaaaattctatcaaaaaaaaggataacgatgcagtcgcggtgtgacaactgagatggaa

SEQ ID NO: 34202 - DNA, 628 bp, Heterodera glycines
  misc_feature (351)..(351): n is a, c, g, or t
  misc_feature (353)..(353): n is a, c, g, or t
  misc_feature (356)..(357): n is a, c, g, or t
  misc_feature (366)..(366): n is a, c, g, or t
  misc_feature (371)..(372): n is a, c, g, or t
  misc_feature (378)..(378): n is a, c, g, or t
  misc_feature (381)..(381): n is a, c, g, or t
  misc_feature (384)..(384): n is a, c, g, or t
  misc_feature (388)..(388): n is a, c, g, or t
  misc_feature (398)..(398): n is a, c, g, or t
  misc_feature (401)..(403): n is a, c, g, or t
  misc_feature (412)..(412): n is a, c, g, or t
  misc_feature (414)..(414): n is a, c, g, or t
  misc_feature (432)..(432): n is a, c, g, or t
  misc_feature (441)..(441): n is a, c, g, or t
  misc_feature (449)..(449): n is a, c, g, or t
  misc_feature (454)..(455): n is a, c, g, or t
  misc_feature (459)..(459): n is a, c, g, or t
  misc_feature (482)..(482): n is a, c, g, or t
  misc_feature (490)..(490): n is a, c, g, or t
  misc_feature (492)..(492): n is a, c, g, or t
  misc_feature (494)..(494): n is a, c, g, or t
  misc_feature (501)..(501): n is a, c, g, or t
  misc_feature (503)..(504): n is a, c, g, or t
  misc_feature (506)..(506): n is a, c, g, or t
  misc_feature (510)..(510): n is a, c, g, or t
  misc_feature (519)..(519): n is a, c, g, or t
  misc_feature (521)..(521): n is a, c, g, or t
  misc_feature (524)..(525): n is a, c, g, or t
  misc_feature (530)..(531): n is a, c, g, or t
  misc_feature (534)..(534): n is a, c, g, or t
  misc_feature (537)..(537): n is a, c, g, or t
  misc_feature (541)..(541): n is a, c, g, or t
  misc_feature (543)..(544): n is a, c, g, or t
  misc_feature (551)..(551): n is a, c, g, or t
  misc_feature (555)..(556): n is a, c, g, or t
  misc_feature (565)..(565): n is a, c, g, or t
  misc_feature (567)..(567): n is a, c, g, or t
  misc_feature (585)..(585): n is a, c, g, or t
  misc_feature (592)..(592): n is a, c, g, or t
  misc_feature (594)..(594): n is a, c, g, or t
  misc_feature (602)..(602): n is a, c, g, or t
  misc_feature (607)..(608): n is a, c, g, or t
  misc_feature (612)..(612): n is a, c, g, or t
aaaaaaatggtgtaagtaaaaatagtaattaagttgaaaaagattgtgaaataattttaaagtttgtaatttcttatataatagggtttatatatttaattatgaatgataaaattattagagtgaagaaaatggtatgtgatataaggttagaaaaaatggtgtaagtaaaaatagtaattatgataaaaaagtttttaaaataattttagaggattgaattgattatataatagtttttatatattggattatgaaagttaaaattattagagtggtgaaaatagtatgtgatgtaagtttaggaaaaaatggtgtaagtaaaaatagtaattaagtttaaaaagattntnaannaattttagnggatnnaattgnttntanaatngggtttatanatnnnattatgagngntaaaattatgagagtggngaaaattgnatgtgatntaagnntagnaaaaaatggtgtaagtaaaaatngtaattangntnaaaaagntnntnaaanaattttagngnttnnaattnnttntanaatngnntttatanattnnattatgagngntaaaattattagagtggngaaaatngnatgtgatntaagnntagnaaaaaatggtgtaagt

SEQ ID NO: 34203 - DNA, 1073 bp, Heterodera glycines
taaacacgtttttggtaaaatcgcgggccagaatttaaaaaatacagtttgctatggcttcgccatcacccgcttcaacgggtgctcagtgtaaatatcgactggccattcaaattctgcttttccagccttatggaaagatattatggaacttttggttccatctcagttgtcaacaccgcgactgcatcgttattatatcagtcgatagaattttcgaatcgcttttaaatcatctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcaccccgcttcaacgggtgctcagtgtaaatatcgactggccattcaaattctgcttttctaagcttatggaaagatattatggaaacttttagttcatctcagttgtcaacgccgcgactgcttcgttattatatccgtcgattaaattttccaatcgcttttaaa

SEQ ID NO: 34204 - DNA, 57 bp, Heterodera glycines
aatgccccgattttgtctggcagatcgcccgaccggacatctaccgacgttaatttt

SEQ ID NO: 34205 - DNA, 352 bp, Heterodera glycines
ccataaagtgaatgaatgaagtgatgaatatagtaaataatttgaagtgttaagagtgggagaggggggggggtaaaaaagggagggagagataaagaggaaagagagaatgagaagagagtgagagagagagggggaagttaagagggcaatgaataaaatatgaaggtaatggctgataaatgacaatttgagggataaaacaatggaaggagagagggagggggggggggaagggcgggaatgggaaaatttatggatgataatgttggcttggaggagcacggactgatgagtgatgaggatggatgaagcgagggagagatgagtgggggggggagcatcctgcgca

SEQ ID NO: 34206 - DNA, 1072 bp, Heterodera glycines
ccatgaaaatatcaatcatcgacctagtattctttggaatgctttttgcatttcttggaaatggtgcatctacttttcccttgaattcggctgtgatggaggtcgagaaggacgaagcggacaattcgactacggtggaggccgaagacaattcgactacggcggatgatgtgacagaggatgcggacaattcgactacggtggaggccgaagacaattcgactacggcggatgatgtgacagaggatgcggacaattcgactacggtggaggttgtgacagaggatgcggacaattcgactacggtggaggctgtgacagaggatgcggacaattcgactacggcggatgatgtgacagaggatgcggacagttcgactactttggaggatgtgacagaggatgcggacaattcgactacggtggaggctgtgacagaagatgcggacaattcgactacggcgaaggatgtgacagaggactcggacaattcgactacggtggagactgtgacagaggatgcggacaattcgactacggcggaggatgtgacagaggatgcggacaattcgactacggcggtgcttgattgtgcgacggagaatgcggacaattcgactaaggaggaaatccaagaggccacgatggaggctaagacagaggacgcggataattcgactacggttgaaattgggaacccagatgacgagtgataattgtcattttcttgatactttgacgagaattttgaatttgtgataaactgtggaaattaacagttacaaatcccttatttgtcagttaatttgttttttttttgaaaatctttggcctaaattacggattcttacggcaatttttttaattatggaaatctgcattccgtcattatggaggtccaaaatttgtgattttttgaaagtcaattttgcgaaagggtccggtcatgtaaactctgatacatcgactaattaaaaataaaattttatttgaaaaatcaaagtgatgcttttaatttttaaaaagttcttttacgaatcaagatataaagcatctctgcaccactttaggt

SEQ ID NO: 34207 - DNA, 140 bp, Heterodera glycines
ttagaagaggtacatggtgattagaagaggtacaatggtgattagaagaggaacaatggcgattagaagaggtacaacagtgattacaagaggtacaatggtgattagaagaggtacaatggtgattagaagaggtacaa

SEQ ID NO: 34208 - DNA, 381 bp, Heterodera glycines
ccatcatgttctcattcatgacattctcgccggatggtattaatgaaaaatgataaaatatgtcgtttcaaaaaacgagaaatgaaaaatcataattttttatttttcgggctaaaaataaataaaaacatttgtcgtggtgcggactcgaacctccgcacttttcccattgactgtcttataaataccactgagccacataagcaaatttcgcttgaaatttggagatctaaattgaaacgatgtatgaatgattgagacagacacatgaaaaataccttttaagataaatgaaattttatatgaaaatgtgttgatataacacttaccgacttgcataatttaaaaatttagaaaaatttttgtttaaggaatgggggg

SEQ ID NO: 34209 - DNA, 1632 bp, Heterodera glycines
  misc_feature (55)..(55): n is a, c, g, or t
  misc_feature (1602)..(1602): n is a, c, g, or t
gcagcagacactttgctgctgtgttcgcccccacgtcgctccttccttggcgaanaagtgcccttgggggacaggctgggatcagactgcggacaaggctaatgggtgacgactacaaaaaagagaggaaaaaacagtagtatgcatacaccaaatacaaaaaataaatgaaataaaatttttgtaaaatcgaaaaaaatacagtaataaaaaaagaaagggtacaaaattgtttttatcatgtcaaacataatggctactgttggtattgatgatgatgatggttttggacctgctgaattcccttctcctcatccgcctttctcgtcgcttcgcttggcaccggtgaattttgcctttgctgttcccgttgctgctccactttgtcttcttctgcgccttcattttcctggccttcgtcttctttttccttttcctggccatgctcatctccatttttgccttcttccatcatcaatttttgttgttccacctttttactctcattttcttcccttttcacttttgtccatttcttttgcctatgcccaactactttttgctttgtctcgtccaatttctcctctacacattcttcttccgtaatctcatcctcctcctcctcatcaaggtattcgtctttgctgtttgtctcctcattattcgttttcaattgcaacggtggcggcggcggtggaatcgcctgtgcataaaactacagaaatcaaattttacaatcaggatttactgtaaatgttgaatattataacagggaaagtgcttgttttaccaagccacaaagctgaacccaaaaataaattttggtgaactagtattttgaatttggtacaaattacgacaaatagctcaattatcaaggtacccctctgaaaattatcaattgaagataataatcgcccactacctgtgaaggactgtatggacgatcagcatcatcgtcgttgacgccatcgccgtcttcatcatcatcatcattgtcgtcgtcgtcctcatcatcaatttccatcgggacatcagcgtcaatgattgtttcatcgcttacaacgtgaaggcatggcatcgacggttcaactgattgttgttgttgaacattttcttggtccgtcgtaccagtgttatcaggctggtaaagagatacaagaaaattgtcaaaaaatacaaaaaatattaaatatttttgtaacagttcctgaattacctgcaacatcatctttttctcctccggcggtgcaagttctggcggaggtggtggtggcggtatatcaatgccggaagatgccattccgacaaggccatatgcgcgtttgaagcccaaatttggtggtgccggcgccgtcgtcgcaacagaagcagcagatggcaccaattgcttgaaaacagacacatttggcggtggtgacggtggcggcggcggtggtacaacaacggcggcagcagaggacaccggcctgacattcaacacgggcaccgttgccttgaactttggtagtggcggaaggacggagggcgacgaaacaggcaatgcttcagcactgatgcgcttcagacgtgggtcgcaaggcggcgataggacagaattgnggcgagcatcgacaggaattgtggcacatc

SEQ ID NO: 34210 - DNA, 1272 bp, Heterodera glycines
  misc_feature (15)..(15): n is a, c, g, or t
ctatcaattggcganaaatagtaggaaacgaaccgctttgttctatttaaaaaaaattttaatttagacaaatataaattagtgccccataaaaatgaaaaaaagagtagtttttcacttttgagctcctcctttccttctttctttttcttttttctttctctttctctctctcctgttttctctctctcgctctctctcactatctttttctctctctcccagtctctcactttctctctctcgctctctcccagtctctctcttctcttttctctctctctcttttctttctctctctcactttccctctcccaatctctctctctctaatctctttttctctatctctctcctttctctctctttccttctctctcctcttttctcgctctctcccagtctctctctctcctcttttctctctctctctctcgctctctcccagtctctctctctcctcttttctctctctctctctcgctctctcccagtctctctcttcttttctcactctcactctgtctcccagtctctctctctttttctcttttctctcactctctccttctctctatcctcttttctctctctcttctttctgtctccctcacagtctctcactttctctctctcgctatctctcactctctctctcctcttttctctctctctttttttctgtctttctctccttctctctatcctcttttctcactcaatctttctctctacctcttctctctctctttcttttctctctactctttctctctctctctctcactccctcttctctctctccatttttctctatctacctatcttttctctctctcttctttctctctctctctctctcgctctctcccagtctctctctctcttcttttctctcaccctctccttctctctatcctcttttctctctctctttttttctctttatctctctcccagtctttcgctctctctctcctctctttcgctctctaccagtctctctcttctcttttctctctctcttcttttctccctctctacccttctctctctccatttttctctctctatcttcttttatctctccccactttctctttctttttttctctctctgtatcgctctcgctctttttccttacatattccataaaagcatattttgtaaaattcgttttatttcattgattaatgttaaaaattaagcaaaaagttatatttaatttaaaagctaaaaaagtgaaaacaatttaataaacattaaatatg

SEQ ID NO: 34211 - DNA, 1336 bp, Heterodera glycines
  misc_feature (932)..(933): n is a, c, g, or t
  misc_feature (1258)..(1258): n is a, c, g, or t
gtcgctgatcacgaatccgacatctattctaccaattccgaattccggaccctaattcgaacaaaaagtcgaaacttcaaatttttcgaatttccaattttagtctaaattagtttaaatgatcttttatcgaagcaataatgacttttacttcgtttctgtttgtttaaacaccaagtattgaactaaaatacgaaaatagaaaatttgaattttcgtctttttgttcgaatcaggtccggaattcggaattcgccaaaaaggaggccggttttgtgctcagcacaaaaaaatatttgtaagagttatgttcacgcaaaatccataaacttttaacaaaaatgcaaaaaaaatatatttttttgacgcgattacatttttggcgacgtactcaaaaaaatttcaaaaatttttcactaataaatcagttgaaaaataatcccccccgtctccatttatccccccgtatctaataatcctcccctttctgaggaggatgaacaataatccccccggggcgataattagagcaaatacgatatataagtttttagaagattactcggaaactgacttcagtcgaatgcattcaatgctcaatgaaatgataatttcgcaattgggaattcgtgcagttgaggaacccgcaattttttgtggcgatccattatacccacaccgtattgaacacattgcgtaagtttgctgttttaccaaggaggacttttcggatactcaaaacttggcaaaattaaatatttttccgcaccccccccccccatagggctgtgcgaaaaatgattctttccgggaaatggaaatcgtgaaccaggacacgaaaaccccagggaattcccgagtcgggaaccgagaaatttttaaactaatcttatatgtattaaatatagaaatttttaaataaagactatcgnnctcatcaaaattgaaagcaaaaattaaatttttgtaagaatttctctatttttgcaagattaaatgtattaaatgtaactagcaaatttattatgtgcatggattagggtggccgatggtgccgataggtagcgccgggcaaaattttgggatagtttgttaacagatttccaccaaaaatgagtcaggaaccggggattcggcacagccctaacctccccgcccccgcatttcagctttacacctcgcatacttcgtattcattacaaaacgaatgaatgtcggaatttggtattgaaaatgatgcgccgtatgattgccgaanaacgggaagaatgccgtcattacagttgtggtaatatggaaaaatttaaacaaacaaattatagctaggggccagctt

SEQ ID NO: 34212 - DNA, 889 bp, Heterodera glycines
tgatcgctgatgatgggccaaatgcaactgctggtcaagcgctgtgaaaatgtttgcacacgccgagaaaagatggaaagccaaagcaattgagttgttatgatgaatcagaacctccaagtttcgaattgatcaccaatttcaaagagatgtggccatattttagtaaaattaaaattgcatttatttccatttcccattgtttaggcatttctcaaatgccaaattgggggacgattcagtggaaggataaaaagacggacaaattgagcaaagtcaactttatgcttgacggagattccattgggtgagtggcatcagcttttgctttttaacaatcaaatttaaattgcacttcattcaggccattgtcgccaccaaagacggaccaaatgaatgaaaaaagtcaaccggaaatgaaccccgggctcagcagacagaggaaaaaagtgaatgaattgttgagaaatgaaaaatgatcgatcattatgaatggaaattgatctgatgattgcttctttcgtttgaaaatagagttcgaagttgtatgcactaaaaaatccaaatatgcattaaaaatcccccaaatatgccctaaaaactaaagaccggacaactggggtcggagggatcccgagtcgggatcccgactgaatcccgatcccgaccagtcccgaacattttggaacaacgatcgggacggatcaagggtcgggatcccgaccgaatcccgatcccgatcaatcccgaagatttttttgggatcccgcgggattatcgggatttgctcaaacccaattttttaggacattttgtgccaagttttgttcaaatgtttatccaagggaggtaattgatcaattcgattgaagaaaaaaagagatgtgaa

SEQ ID NO: 34213 - DNA, 1079 bp, Heterodera glycines
cccccaaaccggccccctcgaaaaaataggtttttttgttttttggggccagtcccccccgaacccgatgcgcccagatttatgggggagaccgaatccttcgggaatagtttcccctatagcccgtactttaaatctgcggtggatttttgctccccataaatgtttgagtaccccaaacggacacttgaaaaaatcgatttttttgtttttcgggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggcagtcaccccgaaccgatgcgcccagatttatggggag

SEQ ID NO: 34214 - DNA, 1194 bp, Heterodera glycines
agtttttttttttgtgtatttaagctggttttgaaccaagaatgctagttttgaaacttttttgttcggattcgggtccggggttcggaattcagaacgatgttcttatagaattttacttatacactagaatttaaatccattcgataaataatttatttaggtcagggtccgctcgccgcagccaactcgccgcaattttcacctcgcggagccaactcgtcacggcgctatctcgccgccgtccatctcgccgcggtcaactcgccaagtatgggtgcgggtgaaacgacaaaatatgggtttggagatttgtccaaggttgggttatatcaataccaataaattaattttaataataaataaaataattattgaatttataatttatttttccaccggcctataaattaactattataaatatatttctttttaatatttatcaaaaagcaattcttacaagagtaataaaaacccaaacaaacaatctgtaaaccaatcattcaatcaattgcaacttactttaattaaaaacattcatcaattgcattattattattattatttttgttattttatatattattaaaaaaggaaaaaataaatactttaagcttttttgcctgcctattcatgggttagccagtgtaaatctctgagaatggcgatcttacttttgagtcttcttgatttgactttatatcaaatataagtataaagtcacaggattcgttgacgaattcattttaaaatttaatagaaatttgttaaaatataaaaaaaaatatattttttttttttgcttattttggtatatgtggttgttaaattaaaaaaaaattgtttcaagttaaataaaattcaaagataggatttaatattatgaaaatcatttttgaggctgaaaaatgtccatcctcggccatatccattcacaatcttaatcgttcaatttgccagcgaaattttttgcattcgaaaaatatggcggcgaaaaaaccaaaacttatgtcgccaaattaaaaaaaaaaattttttttcgcctgtccgtgtttttattcaaaccacgtccatcaaaaaatcacttccgctttaccaatgaatggcatttatccacatttgcggcgcatcatccatattttttatttaaattaataaatataatttctcataatataaaattaatcattt

SEQ ID NO: 34215 - DNA, 602 bp, Heterodera glycines
cgctaatttgtaagatcaaattacatatatacaacaaatgattgtcaacaaaaatgaactgtcaaatgtatctcttttcagcgcctcctttccattggcacatcaaatgcccgcactcattaaataattacccccactccccgccgccctcccccttcccaagtccgccacttccgcgtctcgcctcaggtaaagaaaaaaattgcttggaaaagcagtacatgggcgtggatggagattatgccgtgctgttgttgcggagatgatccccaatcccaccccgcgttcaaattgacatacatatcacaatgacgcgtccaccatttccggcacggccccattttcaaacattttgcctcggctgaggcttgccgaagttgacaaagtgggagagacggacggatggataattaatgatgtctatagaacaaaacaccaatggaaaggaggcgctgaaaagagatacatttgacagttcatttttgttgacaatcatttgttgtatatatgtaatttgatcttacaaattagcgcacacaccatgaaacgttttccactcaagaggatagctaggcgcagacatcctcctggtttcaggggat

SEQ ID NO: 34216 - DNA, 497 bp, Heterodera glycines
cgacaaccacaacaacggaggaaccgacaaccacaacaacggaggaaccgacaaccacaacaacggaggaaccgacaaccacaacaacggaggaaccgacaaccacaacaacggaggaaccgacaaccacaacaacggaggaaccgacaaccacaacaacggaggaaccgacaaccacaacaacggaggaaccgacaaccacaacaacggaggaaccgacaaccacaacaacggaggaaccgacaaccacaacaacggaggaaccgacaaccacaacaacggaggaaccgacaaccacaacaacggaggaaccgacaaccacaacaacggaggaaccgacaacctctacaacggaggaaccgacaaccacaacaacggaggaaccgacaaccacaacaacggaggaaccgacaatcacaacaacggaggaaccgacaaccacaacaacggaggaaccgacaaccacaacaacggagtaaccgactactacaacaacg

SEQ ID NO: 34217 - DNA, 916 bp, Heterodera glycines
ccgggacttgccgggacctgagaagccgggaccgggacctcgattttttttcgggaccgggaactgggaccaatcgggaatttttaaaaattcaaaaaaattcaaaaattttttacaaaattcaaattttaatttttttttcaactgaaaataacaaaattaaatttttattttgttttttatttaataaaatccaaaagttaaagctaaattaaattaatgaaaattttcaaacaaatttctttaggaagaaattgtcagggaaatttggcaaggacatccatttttaaaaatgaagaaaccaaaagaatcacttttacaccgaggaaaactcagaggaaaacaaatcattcactcaatcattcccaaaaaaggttaagtgatctactcgaacattgtgatggctttttggcttgttaacagaaaagacatttaaaattttgaccccatccatttcaaaagaaacttggtaaaagttggagaaagcataggcagaaccccaaaaacagagcagttcattgccgacagctttgggaaaaggcggagttaaattcgacattgccagcgtttcatggtagcgggtgatcaaaagtccatttcagaaaaaaaccgaattacaaaggggagggggtcggtttaaacatctcgatattccgccgaaaaaatgagaccgaatccttttggtgctgaagccatgagaaaaccgcgctacaatacgatcatcagataaccgttcaaagtctgccaagtcagaagatttaacaccaaaagatgacaatttttcaagcaaagggcgcaaatgtttaatccgagaggttcttgaaagcctgggaagtaacgagcagcgagtcagacatatctacaaagggaggaagacgaaaagtagtaagaaacaatgaaaaattgcaaaatcatc

SEQ ID NO: 34218 - DNA, 911 bp, Heterodera glycines
ttaattttaaattaattttaagaaatgattgtgtgaagatgggggaaataaattaaggttttttagtttttttgtttttatatttaaattaataaattaaaaatagagacggaacgggatcgggatcccctgggattagtttcgggaccctgacctcgggatccgtcccgaccttttttttgacttcatcgggattgatcgggatttcatcgggatcccgagtggagatgcctcccgatcacttggccaatcccacgggatcccgcgggattggagtcactataatttcgaaaattttccattttcttataaagatcttaccatattcaaatacgaaaaagtaaataagaaaaataatttgccctttgctaattttcttaacaaattccaaaaaaaatttccgccgaatctccaaaatctcactaatcttcaaaatttgaccaaaaaaactcataagttttaaaaacgattccctaaaaataattaaaaaaatttttacttgttttcgttcattgtgtttctgatgcttctttattggcatttgatcggcagatgggtcatctttttgccatacatttgtgccaacatgatcacttctaactaaaatagaaataaattggaattaaataatatttatttttaaaaactaaaatataaacaaattaccatgggcatcaaatattgttagcagcataatgaaaaaagaaaataaaccgatgaaaaacatattatttgttggcatttgtattaaagagagatttttcacataaaatttaataattagcacactaattggtttggcatttgtattcaagagaaattttcacataaaatttcataataattagcaaaaaaaatattaaaaattccctttgtaatttaaattattaaagttgttcattaaaaaaatg

SEQ ID NO: 34219 - DNA, 891 bp, Heterodera glycines
ttctatagaccttaagcttttgtttaataccaagaatataggtattgaccaagtaagaaaaaaagttatggcctaagaaattgggtatggtcattcatgggacgcataaaaccgactagaaccaagaaaaatacgcttttgcgtcgagcgccaaatttggacgagaagctttggccagctaattgtaagactgttgtttctggtgctgaattctaaccgtctccgattgtcacctttgactttgctttgtcttttcgaattgttcggagttcgctttgccaattgggcctttgctttttgccttcttttcccctttctctgtccacattgatcagctgctgctcgttcaacgccttcgttttatataaatcagcgaggcgagcaatcaatccgacgccaactcatccgaacccaacttttctcccatttagaaatctaattttgtcggatatttccatcgcttcctcaattgcgcactgacgaattcatttttcgccaattcttttttttgttactattcgttttttgacaaattaaattttggtttgaaacctgaaaagcaagtcaaatcgagaatttttaatgtatttcagcttatgttaagaatggttcttttttcaatttgggtatagtatagtcgtagcgcgacatttgcgccgcgacacttgcgccgcccaaacaaataattttagtaaagaacatatacaaactaaatatggttaaagaaaaataaatcttgtaccgcttctatttcccaacaaatgtctttcaatctaaaaaattcgacccgttttttagccttttacatacgcccctttttagacacatcgtttcaaaaaacgaggcatgtgtcaataaagagagagagtgcagagaaaaaacatctctcat

SEQ ID NO: 34220 - DNA, 984 bp, Heterodera glycines
gcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctccggccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatgaggtctaatgagcgggcactttggcaccttaactccacgtttggttcatcccacatcgccagttctgcttaccaaaatggcccacttggagctcaacatttcacgcctgggttcagagtcaagc

SEQ ID NO: 34221 - DNA, 807 bp, Heterodera glycines
aaaattaaataggaaataccaatttagaagggatctctcttctcgacatcaaatcccgagtctcgacagtatgatttgaatcaggcccgtatcagaaaatttttctgggggggggggcaccgaagcgctcttttttcttgctgttcgggccaaaaaatatttttcccagtgttatttttcaaaattttcaggattgatgcgaaaattagaaatttgtagtcgttctgtgccaaaaaatgacattaccatttttgcgtcaaatcttcaaaaaataatggtacaattagggtccgggggtgtcaattaggcgtcgccggtaaaatctaaaaatttgccccttatttaaaccatctgcccttagattattccattcggtgctagtgcgtttcctaaaaagtgccacccatgcgcgtttcctaaaagtgctattttaatagaatacctataaataaatgcaaatacaatttaattatttatttaaaaattttcattatagcatgaaataatccaacaaatgatgaatttttcattgttcattaaaattatcaccaaaaatatgcactgtccagcataaaatattttaaatataaaaaataaaatattattttttcgttcatttatttaatagacgtttagcaatgtaaaaaatttatagaatggagaaatatataaattttattaaacttatattcacttataatgttggcaaacaactgattgatagtctagacagacacttcttttcacggaaaaacaaaaaatatattcaatcgaatagattgtataataatatttatattataaaat

SEQ ID NO: 34222 - DNA, 1404 bp, Heterodera glycines
ttcagtaatttttttgaaattataagcaattttcttaacaaaattgcattaaaatactcaaaaattttcccggcggcgcctatcggcaccgccggaccattattttaccatatttttgaaaaattgatgttgttttattaaccgattttttttattgttttgactaaatataatctataaatattagatatttgattccttattattaaatttaaatgatttttcatttttggatttgctctcatttgaggagattttttattttaaattttctgaaatttaggttttataaatttctttgaccccgctcaaaaggtcgttgttaattttttttaaatagactctcatcctaaaaatttgccttttttgaaaaaaagagaaattcggttgcatttttttttttgatttattttttgttgtaatttatgacctttatatggaataaaaaacagaaaaaaaaaattaaaattaaggttcccaggcgaaatttccagaaaagatcatttgggaggcagtgctagcagctcaacgaggcattttttgaatttttagtgcatttattaaaagttttatttattaaaaattaataattaattataaacggaataaatgtaaaaattagaggagaagaaggactaatgtgaagtgaatgagtgaggaaatggagaagaggcgcgcgccaattgcagcagttttccaccacctccgaagaaaaatcgaaaaaatcaattgaaatgtttggcttttggagacgccacaaaaacaaactaaaaaaagcaaattacctaaaaatgcaataaaacgaaaaatacgcccttaagaatcggctctaaaatttcagaaaatacatccctaagaaatgaaaaatttctcaaaaatcatattttcttgacaagaatttttgattttaaaaattatgtgtttaaatattgatttggcttacttttgttgcttttttaaataaaattttgtcattttacatccctcgagggaggcggaatgtgatgccagaaaagtccacgaataaataccgctattctggaagttttggcgagatttgctgaaggcccatcaaaatggcatttttggaggcaaaaccttcacaagtgacgttaaatccaatccaatcctaaggcagaaattagttaattaggatataaatgcgaatattcaaaattttttttattaaattgcaaaattaaagccaaaaacatagtcaacttgctgagcaaaacatccaaaaccgaataaatattttgttattattcgcttaaattttatgtctctaatatgtaaggaaccgaaatattttttaagtgtttcggggctttatatataggtccactgcgtttgggcgctcacgtttcggctccagcctaagtttttggactataactttttctt

SEQ ID NO: 34223 - DNA, 925 bp, Heterodera glycines
ctttagagcactttctgaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccctctggggaatcaaacaattatggggagcaaaaatccaacgc

SEQ ID NO: 34224 - DNA, 897 bp, Heterodera glycines
taattttggttgatcaggaaaaaagttgttagcaacggcgtctaaaaggccggcgccgaagtgggcggttccccccaaacccatgttttttgatgaaatttaagacaaaacgccaaacttagtgaaattcttttgcgagattcttttcaattcaaactgatgaatgattaaaaaaaaagattttcacatggaccgtttattgttcaaaaattgccctaaaatcaaagattaaagatgttgaactatatattaaataaataaattaggtattaagatggaaaatatccttgaataattaattttaaaattggaaaatgataccatgatgtcttgtgtttgaccgtgaaaatgtttccaaggatttcgaggcgctttcatgagtctgaccgacattgacctcctcccccccccccccccccgattacgaaaatttggcttttctcatgaattatgagaagagattacaaagtatttaggtacgcaattaaattaaaagattttttaatcaaaatgcggatggagtacagggagctgatgagaaagcacatcgaaacgctcagagagcatatgaaagtgcgcgtgtttttgctgcacgccaaaaggaagggaatggcagcggctgagaagaaaaagtgccagacaaaattcaaagcattaatggacgaatttgacgaagccaaacggaagataaaggcggactttaagcggggaaatgcggacaaagtgcgaaatcgaagttaaatttaaattttaccattcaaatggagggaatgatggcgaagcattacgtggaaaatggccatttgcagagggagacgcgaatttttgcagcgaaactccaacaaattgtcaagggaaaaacgctgtcgcaaatgcgtcccgattgtacgttgtttt

SEQ ID NO: 34225 - DNA, 837 bp, Heterodera glycines
tacaaaatattttgagtggtagaacagttaaaataaagaattagacgatttttatttttgttaaattttccgccaatttcaattacgcggtgaagaacataaaatgtcatcaaataaaaattatgtgcctttgttaacaattaaaaatgtgtaaaggttcaaaatttgattaaaacattaaaaatgaattataattttcaatggtaataataacaaaattcgaacccgaaggacgaggatcccaggaaacgtggcttctcagaccgaagaacgactaaactgaggatatccacgccggaggagatccccgaaaacggaggcctccgtcgtccactccccgcctattacggcttcaccaatgcttgatccgccccctctatatccttgcccgttggtgtcctctcatcattccgcttcatcccttccattccgccagcatccgcttcatcttccgctgacatttgtgccaatcggacggagtccaagctgacgcctttggtctcgactaaccacagacaggacaccatcaagttgagcgtgccgagcagcacaaccgccaaataaacactcacagcccaaaaggagttgaggaagaccaactgaaaggtgcgactcggatgggagatgttaataaattaattagcaaattgggattcggatgggagatgttaattagctagctaaatcgggactcagttgggataggtaagctaaccgaaactcgttggaaattgttgaaaacatgaaaaatgttttggaaaaaatataaaaaatttcatggagggggagaaagccttagtgaacccaaacgacgcgacgcgttcaatggttgatgaa

SEQ ID NO: 34226 - DNA, 922 bp, Heterodera glycines
  misc_feature (76)..(76): n is a, c, g, or t
attgcgggaaattgcggggtttttggacccccgtaattgcggattgcggatttccgtaactgaggaaatctccgcnaattgcggattgcagatttccgtaattgaaaatccagttgcgcccagtcctggtctgggagcgagcctaaggcaaacgattcgaaaatggaatctttggaataattaatttaaattctaattctaattttaatttcggtccatatagatcagggatgtgatcagttcttatttataagaaatgttctgatttggagggttcaaatcttacaaaataaaaatgttcttatttgtaagaaatgttctgatttcgggttattgttcttattttgttcttatttcttaaatatattcaaaattttgaaattttatggcagaatgtcactattttatcaagaaaatataaggtttgcgcaaaatttggttattttttgacaaaaaactgttagcaaatcgcattaaaaattacaaaatttttcccggcggctcctatcggcgccaccggaccatctcccccttgttccccaaaagtagtcattttttcttctaattttcaaaattattcccttttcggtgggaattcaatcacaattttaacaattaaaatgagaaaatattgttatttttggattaaaatttgttcacaaaagtgaaagtgcattaaatttatttatttaattttatcaatcactgagttttttttggatcgacctagcacccttcaacactaacattactttgtcatgagttcgactccggctgacgttttcttttgaatttattattttttttctgattagttcaggatttatttgtgttcttatttctaagaaatgttttgattttggggaagtgccttattttaatctaaaagagggtaatttctgaaaaatttggctaatttcta

SEQ ID NO: 34227 - DNA, 1850 bp, Heterodera glycines
  misc_feature (1838)..(1838): n is a, c, g, or t
cttcctttcagtatccctgcaaagtttggtgcgcttctcattagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctactcccgaagattcggtctccccataaatctgggcgcatcggttcggggggactgccccgaaaacaaaaaaatctattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccattaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaagaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaaccanattatggggagc

SEQ ID NO: 34228 - DNA, 541 bp, Heterodera glycines
cagtatttttcgacttcagggtttgaaattggtgcatccttttttgagttctttgatcagcagctatcctgaaaacccttgtctgttaatactatcgatggtgccccccccccatttttggaagaaattttttttgttctgaaatgtcgtgaaaacatatttacgggggttttcagggtcgatgatcgcgaatctgacatccattttgccctatttcaaagaaaattcaaaattttgaaaattcacttttagttcaccccctaaatccgcttcctagttcactaagttattgctcacgaactgtacataaatgttgaagaattttttaagtcattgaattcacagcctttcttccatctctcttttattcgcgaatttttgtgtgaaatggactctgcaaaaccgatcgtgttttggaaggtcagcctaaatgaaaagccggctacagatgtagggcgagtcggtgaattgaaagctcttctctatgaatgattaaaaattggctaatcaaaaattctggggtgattggtttgtatttttt

SEQ ID NO: 34229 - DNA, 1027 bp, Heterodera glycines
aaattttgccattaattatgccattttttgatgtgggtcctgcttttctttcacaatatttaatactttcactttttggtgaccaataactaaatgccaaattttgctagtttttagtttggattttgcattttttaaaaaaattttttctaataatagccaaagagtgtcctttttggtgtgcaaaaaaaaaatttttctatcccctaagatttaaaaaaaaaattgtgagcctaaactaacaaatggcaccattttttctttcttccccatttgcatatcgttgttctacacacaaattgctcaaaattttctgaaaaatttcggcataattttgctttaatccttttttgaatgcttttttttgcttgttctttggccattgaatggcaattaaatatgtctaccaatgccacaaaaacaatacaaattgttttaaattttgccttgccacaatggacggtcccagcaggatttgagggcttggattgggtacagactgcaaatgctaatgacgagcctttttttgttggcatggcatacaacagctttttcagcgtaaatttttgggaaaagatgaggccgacgagcgccgcctttttgaaaattttggtgtatttgttaaaaaaaaacgagttcagtgtttgactttttacgccattttttgcggcgtcctttttttaatttttgggaaccgacgtaaaaaataaattgaaatttaaagacaaataaaaattgcttttgaaatttttaccattttttaactgattctcaccaaacaattgttaattttattgatttttggggaaaaaaattagcgaaatctttttgaaaattttgaaggttaggtgggcaaacaaggaaaaacgaaaaattttcagcacaaaattgacccctcctcctaggaccgtccctggccttgccagctataattattgctctccccaccatggggtggggatgggcgggcggcattcatttgcccatcatttccgtccgtccctctccaatccgccgtgttcactca

SEQ ID NO: 34230 - DNA, 742 bp, Heterodera glycines
gattgccaatcggcatgttcgggcaagcacgagtcggggccaaatctgcgcaaaaaatccggcacgggcagccccccctgcagaagcacctgaactgacatttgtggcaacatgccgcaaaatgtatctgaaaaattggccttgcctcgacataaaatgcgccgttggccaagtcttcgtgcgaagtcgggtcgaagaaggaagtggccaagcccgctcttccggctcgtccaatgcgatgtatgtacgtctcggtgtcagtttcgggcaaatcgtagttaatctaatgacaaataaaatgggaaaagtttctgatttggttaaatgatcgaaccggcaagaactgaccacgtgttcgacatttggtatgttcataccatgaactaaattaaagaaacatttacagtgactcaaaaaaatctttgaacaagcatatgttaaacgctaattaaataaatgcgtttgggcaaaagtctattcatttagtagctcaatatgtcagcttcagattcgcgaattatatatgaaataaatgtgatatggtcaaccaaatgagagatggtcaaaattctaacccaaaaagtttttgaacaaaagattattctacagtaactcaattttatgcagggaaaaattttgaaaaaatttccgctaagctaatttttggtgctgatcaaaaaagtctttttgggcaacttgatcagatcacttcttcatagtgatctgaaaaccgcaaatggct

SEQ ID NO: 34231 - DNA, 564 bp, Heterodera glycines
aaaaaaattatttttctgctatgaaaagttcaacccttgggtttcaggggcttccgatcgcgaatatgataccagataattgcaaaaaatcattgattttatcatgattttgaaaatcttagatttttcgaaattttgatcaacatgcgcaaatgctgcactttttcgagtgaagcaaccatatatgatcaagcactatttattaaccaatgagctgatcatagaacaatcggtacttccgtgctttgataccctcccctccccccactcacacatccagtctcaaagaagccttcctgtccgcacaatcttcctcatcatctcatcatcatcatcacatcatcatcctcatcatccctctcttctgttccattcatcttattcatccccccccccattactgccccggacccgccaaacgcccacaacctcactctcttccccgtttccactctcctcaccgcccattaataacttgtgtttgtccgtcgtccattggcgcggagaggaggcgagtaagtccatttgcatgaacattattatttttctttcacgagaatgaat

SEQ ID NO: 34232 - DNA, 576 bp, Heterodera glycines
  misc_feature (449)..(449): n is a, c, g, or t
atttttgaaaacgcaataatttggcatcagaaaatttaagaaatttgccaaaaaaaaccgtacaatccaaatttgtggacactgagctgcgtgatttcgagcatcagctgcacatggcgcagcaactcctttttggtcagcacatttcgcgagggcgtcgaatggtccgccgtttggatgagcacctgaaaaggcgtaaattttaaattcagtgcagataaaaggcaaatgcaaaatcaccttttgcatttttgaaaattttcaaaaaaaactggaaaaattttcaaaatttcatgattttttttctaaaatttttttttacaaacattcaatatgaggaaaaagacctaatttttaaatatcttaattattttcccggatttggattggtttaagtgcggcaaatactattttttggaaaattgggggagggtttcgacattctctanaaatttcgttttttttgggcacctcccgcacccccattcccacctgatacgatgaaatgggcgcttcgtcctcccgaattcgaacaacgttcgtcatatcctcggcaaaaagtgcgttgctcatatg

SEQ ID NO: 34233 - DNA, 749 bp, Heterodera glycines
tttttcccttttgggcaattttcaaaattttaaaaaaatgaaatttaaccctttcaaaagaaattggataaaaaaatttccagtcgaattgattttttttttggggtaaagtaaaaactccccgaaatttcatcatttgcaaaatatttttcctattgggggtcctcctatgtgcgttcccttttttcccgatccgtcgtcattttatgtcaaaatgttttcgccctttccgttttttggcaatgatttttcgcctcctattggcacttgtccaacccctcgagcccattggcaacagttgaagctgaactggttcaaaattgttttaataaaatgcgattctcgtgtttttctcatcagtattatccgtaaaaaataggaaaaccctaaaaatccaggctttatccaacgcaattatttttctgctatttgtgtgacatcattcgaaattcaacagcaaattttgctaattgccaaaaaatgaaccgacggtaagcacaaattcgtcatttatttaactaaactcttttcccatttcagttggatttgcaacgacgtttggatggacattttgcccagttttgaccatgcccaactcggcctcaaattggcacttctttcgccacgtttcaatgcgttggtggacaaacatttcgatggcaaaagcgaattgacaatttggagaactatcgaaattcgtcgcaaggacaaaggaccagaaccgaaactatctgtgtggatggatgaca

SEQ ID NO: 34234 - DNA, 652 bp, Heterodera glycines
  misc_feature (106)..(106): n is a, c, g, or t
gggcagtccccccgaaccgatgcgcacagatttatgggagaccgaatccttcgggaatagcttccctatagcctgtactttaattctgcgttggatttttgctccncataattgtttgagtaccacaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttt

SEQ ID NO: 34235 - DNA, 855 bp, Heterodera glycines
ttttttttaatcttttgaaaaaattgttatggaaatattaattctctcgtgttggggaacgggagaagttcgttttccccgcccaaatttttttttcattttcgaatttataacggaaccactcgaactgtaactcgaaaaacgtatataaatttggtattttggttccattgttcgaaattttacaagaaaataaaacgaaaaaatttttctcgctttttttcaaaattttatgatgaatcactaaatttttatcaaaaaattgccgtagtgcacccggggaaaacaaatgcatacattcgcaacacaacccaccacccataattggatgcattttgttaggtttgtgtcgtgcccggctccgggtttggccagcgtcctggcactttccatttccgcaccaccattttgccgcccattgacattttcgaggacatgctcaaccgtttcggcgccttccacaaacgctttttggccaagtaaatagacgataggcgaaattttttttatttctaatttaaaattttcaggtacaaataatatcttcgatgtgtgcctcccatatgtgtttgtaattattatgaatgatggatgatgtcacggtgttcggctgtgtgatcagagagattttttgtaataatacatatatagtataataatttaaaattgcgttatatccataatttgcttttaatttaatgactgattaattatattgtattgttattgtttgattatgtaatttcgagcatcgcgatacttccctttcctttaatagagacggaccggtcggtttttttcgatttcggtttttaaccgaaaccgttcgaccgaccctcttgtccggtctctagt

SEQ ID NO: 34236 - DNA, 728 bp, Heterodera glycines
gtgcgtgcgtgcgtgggtatgtgtgtgcgtgcgtgtgtgaaaattttggtgcaaagtgcatgtgatgtgcctgaaagtgtaggtgcaggtggttgttaagtgcaaatgtgtgcgtgttttcggtgcagggcagacacaagattaggtgaaaatgtgtgttatgtgcacgcgttttgggtctaggtaggtaagtgtgggtgtgtcaggtacaggttcaagtgtctttctttgcaactgcaggtgcaaataaaagttagatgcaaatgcatgtggttgtgtgcgtgctatggcgcaggtatgtgtgtgtgggtgtgtcagatgcttgtgcaagtgtgtttgtttgcaggttcatgcgttcagcgtatgtgcaaatgctgtgcgtgtgagtgtatttgtgcaatgtgtgagtgtctgcatgtgtaggtgcagatacgtaaggtgaaaatgcatatgtgtgagtgtatttttggtgcaggcatgtgtgtgtgtggtcaaatgcaggtgcaagtgtgtttgtttgcatgtgcatgcgttccgtgtacgtacatgcgtgccttctcatgtggtgttgtgcaaaagttaatgcaaagacaagtgcgatgttgtgcctggaagtataagtgtaggtgcatgtcaggtgcaaatgtgtgtatgtcagatacaggtgcaagtgtgtttgtttgcaggtgcaggtacaattgttgttttggtatgtaattgtaggtatt

SEQ ID NO: 34237 - DNA, 1003 bp, Heterodera glycines
ttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaaatttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcaattgctctagtcaatttttaaaaatttttgttgaaatatttgtcgtgctctgaataaattattccttttattaattaaaaagaaagtttgaaatgtacaaggattgaatatttatttaaattgaaattaattttacaaattctaatttaaaaaatacaggagttctttaataaaagtaaataaattattattttaatttaaaacatttttcacaaaaaaacaatttaatttaaattaaaaaattttatttttattaagaaaaaaacactcttttaaatgaattaaaacattaaaaataacccaaaaatacatagaaaataatatacaccgcgcggattcgaacttggccccccccctcaaaatgatgcctcagaatccccaatcacacagggattctaaggtcttaacgatgtcagaagtaaaatctgatcacgcattcgtgatcagcagcccaaataacgcctaaagacatcttttttgaaggtttttgatgaaaaaatttttgcactcaaaaatcctgaacacccccctgtgggcacgaatcctaaaattccttttatttttttaatctttttttaaaaatgtgataaaaa

SEQ ID NO: 34238 - DNA, 1044 bp, Heterodera glycines
gccccctctttttcaggaatgttgaacgtgatcagtaaagttcgccaatttaggaatattacatttttgatagaggctaaggattgttcccattgggcccaatctcttcgagactggttcgagattgaatccgaggacatgcccacctgagcgcggtgtgcgggtagcattgggcaacaccggtgctgaactggcgcacgtactccttgttcagctgatcaattggattcgcaaaggtcgaattgaacaccagattgtgtacgcctctgcgcagcacccacaacggaatggtgaaggactcaaccagccggcattggtcgtccgcgctggcgcgcttttggctcgtcggacagccgcacagctcaccgccaatgcaaaccttttttaaggagccgatcataaatggcatcattttgcatttcatggcaattcttcactcattttgcgcagagttggcacaaatgccgaaaaatgatttgttgattctaatcagaatgttcgatcaaactaatcaattaatgttatgtggcatttgtaatcaacgtgatcagcagctgttccccccttttctgcactcacctcgccaagtgactgtttgcacacggcaccgttgcactgttcgcccggcggcgccggcttcgcgcatgggtccaacagcccaacatcggatgccacactcagacgaccgttgccaattgatctgacgggatcaaatggttcatcaatcactcccggtcctacagagttcggttatgcgaaaaggaaatttcttgatcttattaccgagtctcgaatttgtccaagggattcttggtccctcccggctcgatgaaataatttttcgcgaatggcacattcttgaattagctttcgttttttgttccaatcagttaaaatttccttcccccatcagcagctgatttacccattagagcgatgcaacgagctgatcagctgcttccaaagctcacagcgatcaatcggctcattgccccgatgcgttccgatggtaaaattgatcagcagtccgtccgaccatgaact

SEQ ID NO: 34239 - DNA, 1032 bp, Heterodera glycines
caaattgtcaggaaatgttcgtcgatgctcttccggcctcaattgtcagtctaaatcttacttcaaatcgtcttgttcggctgacaaaccgaatttgtcgactccagcaactcggcacacttcggctggaccacaaccttttcgaggaactgcccgaggatgtgagtatacaggggaaaaacgggagaaccctaatttgtaggactttctttgctcttcgcaccgatttttgcttgtaatttcataacagattttcaccaaaaaatgccaaatttttgcaattttgagcatttgacgaccatgaaaagttcgcccgttttccccctcgtttttggactgttttgggtcctcgaagttaaaaaagacgttttcaaaaaaaaatttccagctctgtctgatcaactcgttgtgtcatttgtcgctggtcgggctcaatcggctccaatttcttcccccgtctctttgtgttgtcaaatttactgcaccacgcttcattttgttggacatttctggcaatgaacatgcgccgttcatcaccgggcacggcacggctcacaatcaacattctgttcacaatgctgccaccacctcttcgacagttgtttctgttactgctccgccggcactttgtgaatttgctgctgccgcagtgcttaacaataagtgagaaaaatgggagcgggcaacgacgggtgtacttcatttccccccttgtcgtgccccgaaaaataaaaaaaaattttcaaacttcgaatttttaaataacaaaagttcatcaaaaaaaaaatcgctgaaaagtttttaaaatttgttttcttaaaatttcttactaagaaatttccaaaattttttaaatttccggagaaaacggcctgctcccacaacgggtatatccgctttatctcttttctccgatcctcggctttttttttgtctttactccattccccttcccaaaggacagtccctgacggatgttcgaatgctgacactgattcgtacatcatagtaattttaggcaaaaattgtgct

SEQ ID NO: 34240 - DNA, 1012 bp, Heterodera glycines
  misc_feature (12)..(12): n is a, c, g, or t
tctactcaaacncggttcagaattcaataaaaataacattcacggtgcgaaaatggggtatgaaaagtttattgggggaaaaaaagactttacaaaataatacccctgggagaagggagtgggaaacatgacccctgggagaagggagtgggaaacatgacccctggttcagaaggaagtgggaaacatgatttcgaaattttcaattttttgtagtctaatctactcaaaccggttcagaattcaataaaaataacattcacggtgcgaaaaatggggtatgaaaagtttattggggaaaaaaagactttttacaaaataatacccctgggagaagggagtgggaaacatgatttcgaaattttcaattttttgtagtctaatctactcaaaccggttcagaattcaataaaaataacattcacggtgcgaaaaatggggtatgaaaagtttattggggaaaaaaagactttttacaaaataatacccctgggagaagggagtgggaaacatgatttcaaaattttaaattttttgtactctaagctactcaaaccggttcagaattcaataaaaataacattcacggtgcgaaaaatggggtatgaaaagtttattggggaaaaaaagactttttacaaaataatacccctgggagaagggagtgggaaacatgatttcgaaatttttactcaaacaggttcagaattcaataaaaataacataacatgatttcgaaattttcaattttttgtagtctaatctactcaaagcggttcagaattcaataaaaataacattcacggtgcgaaaaatggggtatgaaaagtttattgggaaaaaaaagactttttacaaataatacccctgcgagaagggagtgagaacatgatttaaaattttcaattttttgtactctaagctactcaaaccggttcagaattcaataatataacattcacggtgcgaaaaatggggtatgaaaagtttattggggaaaaaaagacttttt

SEQ ID NO: 34241 - DNA, 945 bp, Heterodera glycines
aatttttcaggttaattcaggtcatatagggctatcgaatgatagtaacatctctatattttgttcgttctaagaatgttttgatcagaatttgtgataatcaaaataattttatttttaattaaaaaatttatgttagaaattatttttgttttagttttcttgctattagtcgatagctctatgtgtcctctattagcctgcaaaatttcaaaaaacagttttttgttgaaatttttcatttgatggttttttatataacgcccattttgatgggttttattagagatcgacatttgaaaaaagcctggacctggattccatgttggacctggaccttgatttcctggacaaaaatccaggaaaattcaggtccaggaaaaatccaggttgccgaaaagagggcgcagaaaattgatccaaaaaatcgaaaaaagaaaaaattagaaatttaatttattttgtagcgcctgccgaaaattctaaaataaattagaaattaatctgttcctcataatatcacactctgtttctgggctcgactctcaactcgagaaattctctggccttttcataaattattgagccaattagcgaataaaatttaaaattaaaattaaaaataatttgctccactttagtcacagtgtctgtttccattgtgtgccaaatgaacagggcacaaatggcataggccggcacgagggcatacctttgggaaaaaaatgatggcaaaaatgccgaaaaaataattccaatcacttgacaagccaatgccgttgaaaaaggcgttgccaaatgtaaaaagtgaagtggcgattgtccgccagcaaatacgggtgctcaagtgtgaacaaatggacaattgagaacagtgaaaaagcaacaaaaagtgctgcagggagagcaaaacgaagaagcgaaacactgaaaataaattaataa

SEQ ID NO: 34242 - DNA, 552 bp, Heterodera glycines
attgttttgcttaaaagcattatgaaagaagctcaaaaaacgcatttcatttgaacgtcaaaagctgcgtcaataaaaaaagaaaaaaaaaacaattttttcggagtttttgaaaaaataattttggcaattggcattattaatattcagaatgccaaatattttttgtgttttttcaaaaaatctgtgacaaaaaatatttagaaaacaagttttttgaagttttctggccataacttttttgaaacacaacgaaaaatttttgaaattttgtcttctaattggctataaaatgataccaagaatgtttaatctagatgattttataaaaagttatggtcgattaaaattgttaaattattttatggtcctgtgaactgcagtaaagccaaaacgattcccattaagatttgcttgtttgaaaagataattcaagaaacaattatttattctggcatcaatctactgtataatcgcaaaagtgtgctaattgcaacaaaaaacgaacacctcggtaaacaaattcaaaactcaccctaaaaatttttattt

SEQ ID NO: 34243 - DNA, 1009 bp, Heterodera glycines
ccttatggctaaactaaagcctcggaggactgttatttttccttttttccttatttgtcaatggctttgtgcgcgctttaacacccttttgtacgaagtacttcctcggagggcaagtacttcgtccactacacaacaccttccaaccctctgttcggacgaagtgcttcctcagagggtaaacactaagtccgctacgtccctcgtgaagttatgcctcggaggacaataactacacgaaactatgaacactagacaagcctcagagggtccttgtctaggctctctaatttgcttttcccttcccctgtgtcaccgggattcgtcgagtcaatccgtggttcacagcaaatccacccaggagcgccaatttgtcccgattgctctgggtcgggccaaatgtgaattctaccggtgcggggtcggggcaagcagggacgaggaccggccaaatcaaacgccgagaattgattaagcaaaatttattccgggaaaaagcctcaaacttgggtaattaaacaaaaaatttgaaatggtgaacaaattatcacaaaattgatcacagataaaatgccatcaccgggggattaatcacaaatgaattggggaccgggatgggacaggaaatggagggcactggggccatagaacaaaaatcaataaccgggggtcaaagaatgatcacgaatggggttatcacagttaaaggcaaatggaagggaggggagagaaacggcaaaaatgcctaatgaattttggttgtgaaattgggggcatttttggccgcttaaataacaataaatttaaataaaaagtggcaaatgtgagcagaacaaaaatgggccgaaaattgggcacgaaatgaaaaacgggggacaaaatgaacagatgaacaaaatgggcggaaaacgggaaatttgggggatcttcggtcttttggagtttcattcccccgaattggggacgggggaaaaaaagttgggggttttgataaaatgggcattaattg

SEQ ID NO: 34244 - DNA, 738 bp, Heterodera glycines
ttactatttttatatagatctttccatttgtcacacctttccttcatcaaatcgcacagaaatgtgcaggggaacatcgttaccactgaagtcggccgacgtatggtggagattaatggtgaaactggaaagcgatttaaacttttgagttatgaggggtgggggggggataaaataattcttttagtatattgaattaagcctaattattttttgtaaaagccaattaatttcccaccggactgagtcttccgctgtttttcctttaacaattagcgtttgtcccggctcaaaaggttcggtgagtttgcttcggtaaggaattggctaaaaaatttgggatattttaaaaatgtgtttttgaatgattaaatgttacgtattgcgattcggcggccattagttcacttagggttaatttgtggatgtttgacggagttggggttgacaggtctaaaggaatacaaagataagaaattgagcctggccaataaaatttatcattatcagaaaatatgtcaaaatgagcgaaataattggaaaagggtaaataaaaagaataaaaacaaaaacagcggaggctaattatcgatcgtttgttgtttgtttgtacgctttcattgagggggacagagaaagaaagaaagaaaagccgaggcgaagcgaagtgagcaaaaaatgtgcaatttgtgcacggagcggaagaaattggaggagatagggaaaccaaatgaaaac

SEQ ID NO: 34245 - DNA, 729 bp, Heterodera glycines
tcattgggcgtacaacgacgccaataaattttaatggcgaattgcacaactttccaattgtaagcaaacaaatccggcaccgagaaatttatgaagattttggtccctaccgggagcacgaaaattttttctccagccaaattcaaatccgccaacaagctgcgttagcgcggcagcaacaaaacgcaaacttcggcgtaagggatgagtctttgccatgcgaacggcaacacaacgaattcgtcggacgacatctttttgaagatggacgtcaaatgatgcacccaacggagattccgaggcaaatgcatcaacaaccaccaagagaagagcttggctggcagcaaccaaacagtgttttgtaccgtccagtggcgcgacagcagcaaaattttccggtgtacgaaaatcaagtgcagccgccccaaagcgaaaatttagcggttttgaccagtctcgaatataatatggtccttgaaagaatcccagacctcaacggaaaggaagggacggacgaagtcaagcgttttttcaaaaaattcgacgcttataccgacagttggccgggtggaaaaagaattaaggcgcttgaaagtaaagtgtatggccgagctgaaagagcttttgaagcggcgaaagcagtcattccgataaagtatgaactgctttcgggtgaaatgatgcgacaattggaagaaacggactcaaaaaacttgaatgcttttgatg

SEQ ID NO: 34246 - DNA, 942 bp, Heterodera glycines
  misc_feature (84)..(85): n is a, c, g, or t
acggagggggggattcccccgggagacaggggaccccacccctttctctcgtcacagtccaatcaaacctttggggcattttcnnccaggaatgcaccgatttttcactttatcggaattgggaaggccgtaagtaattacatttgctcatggctttcgccccccccccctatttaattctttgattttttcccgaactttgttgatttttgctctgttgtgcctcaccaaaattaggggacaaagggacggtcagccgaaggaatggcgaagaacggcggaggcaaagaacatcatcatcatcacgccttaatctgaccgatttggctattcctccacatgaatgagttcacctcgaccctttttgagggggcggaggcaaaggcttatttaaatttggatggaaagggtatttaaattggggatttacatttgacttccccccccccccactaaatgcttctttcattttattttgtcttattttctgaatacacaaaatatcattgaaactgagcgaagttacaatttaccaacgctacacaaaatatttttccttaagcatcggcaatgctttgtgtaaatttaaacgatgaaaaatgcccaaacttctccggcgggtgggaattcctttcataatgaacatttagcctctttattctttgagagaaaatatttaattttatttaaattcaattgtttaattcaatcattcaatgacttttgtatcccccattcctttcacttttttaaagttttatttattgtattttaattatttcgtccgccgtcctttgtttttttttgaatttgatttaaaaaatttaaaaatgagtacctaataacatttaactttatttttcagtccatgttgacgaacatacgtccgaccatcgaatgtttgggtgggcatttccctcctccgccattcggtgggattga

SEQ ID NO: 34247 - DNA, 1449 bp, Heterodera glycines
gggggtaattaattaacgggatcgtcggtgaaaaatttcgcgcacttaaaattttaaattggtttggctgaggggggggggcggcggtgtagaggaagtgtgtacatcgtgaaaagagagagtcgtgccgaggagagggagtggacggcgtcccttggagaggcgtgcctaggaaagggagtggacggcgtccctagggaattagttgaagcgagcgaaaggagggtagagagtcaatgtgtcaaaggtaataatccgtgcaagcaattgaatgatgtgttgataaacatctaataataacatagcgaaaatgcccagatgtgaataaataaattgttaggaaagtactgcggattaacggtcagggagttgtagcaatggagaagggaggggatatggcccagatcgtcagagtttggccaacattcttcaaaattcctcaccaaaaaatgaaaggctggactaaatttgacagtttcatttgccacgaccacctgcagtgtgttagaccggtttcttatttgaaaccggtcttatgtttgcacaaaagtatccgtaatctaacggatttcttgagccgaggactaccggaaacaacaccaacgacagtgccgactccagcaaatgcaacggttgcatcgactacaacaattgctgcaacatcatcatcatcaaccaatttgcaatattggtggtggtctgcattgttttggttgcggttttgtgtatcgcacaggtcggtttcatttgattattttgtaattttgttaataaatttttgtactctaccaatacaggcggtgcgtttcgcattgaaattgcgccaatggttggcccatctcaatgctctactgctttgatgaaatgaacgcggcggtaccggcgcttcaaaaattcgggagtcgatgtgtatgcgggagttccatccgaagaattggtcaagcgtcttcctaagcccctcttgataattctcgatgacctaatgctgtctattgatgagaagtatttgtccgatttgttcaccaaaaagtcacagcatcaacaatttgcggtgggtccgtcacacaaaatttgtttgaacggaagattaaagtggcccgcctgtccgctcaatacctggtgttgatgagggcgccaaattctctgttgtctatccgtaacattggtgttcttctcttcccccgtaagctcgactttttccttgatgcctatcgcaaagcgactgcccgtctctatggctaattgttgattgatatgcatgcccgcgtccgatccatcgctacggctgcgaaccaacatatttaaggacgagcaggaggatgaagacgaaggaacagttgtattcatccccaaaaatggagcggcaaaatcaaaaacaacaacaacaagcaaaaaattggacatttgattaaagaaaatttgtgattggcttttgggccttggccagga

SEQ ID NO: 34248 - DNA, 520 bp, Heterodera glycines
attaaacgttaaatttttctccgcttattttttaaattaattttggccaaataatagcttgactaccattattctttgaaaataaagatatgatattgtagtcattttttgggtttaaaagtgaaattttttggcacaaattaatagtttaaaataatggaatgacgatttcttttatgaatatattaattatttttaattaaaaaaatgtcccatttccatgcttttcctctgattgttgcttatttttgaaggaatattatacataaataatatttcaaggtatttaatttatctaattattttcattaaagtattttatttttgtatgctaatcttttaattttacttggcatttgcattaaaattaagaatactttactattgaaattcacgatttaaggattatttaatctaatttttcaaaacaaaaagtaagagaataaataacgaatgatagaattaataaaaatacttgaaacatcgaaaactaacaaaatattcattggaacattaaaaa

SEQ ID NO: 34249 - DNA, 1340 bp, Heterodera glycines
  misc_feature (47)..(47): n is a, c, g, or t
tcgctaattaattggcaaatatcatttttaaattttttaatggcacnaaaaaataagctcaaaaaatcagagaaggaaacaaaagtcatcgaaattaaaatgtgaaaatatttttattttattttagcaaatttttacgttcacaaaatgctctgtttcccgttttgtgtaagtgggattaagcggcacgtaaatggcaccaagccgaaggacagccaaataaagtgccaacgcgtcaacagtttttgaagttcgacataacacagtgtcacccttctgaatttgaaaaagaaaaaaattaattatatctttgatatttaatttaaataaaaataataaattttattaattaaaatttaatttaattgattattttaattaaaatgtaaaaaggttgattaacaccaaatttatttaaatatttatatccaaatgaatgtatttatttacttaaaataatgtttgaattaatcaatttattaattcatttaatgaaaattattttttgtttatttattttttggtaattaaataatatttttgtaaaatttattttgctaaaataaatattttttgattttttaaattaatatttcgcattttgtcttcttctctcccacctgaatgccgtactttttgttgagcaatgccgcaaaacgtccggctgccacgttcacgtcgttgtaacttcgggagctgccgtttttgagcaacaacagttttttagccgcgtactgcttggagtcagtggaggcagtgaagcctgccaactcgacaaagttggacgatcgccgaatttggcattttgggaaaagagtggcacaaatttttggcaatttttgtcgttggaaaagcatttaaacttttgaaagtgcgcctaaattggaaattatttattttgagtaaaagatttaataattttttttaatggagaaaaaatagattttattcattaagaatttatacattttgaagattaaatgttcaaaatttaataaaataaatagtttgaattggaaaaatatatttaaatttatgagtaggatttaagagaaaataaaaatttaacttttaaaattaatttttaaaatacattaaaatactgatttaaagtttttacatttatcatttttacgcatttatttttgaataaatgcgttagtaaattgaattgattaaacaaaaattttaggagaaagaaaatgtaatttaatattaattgggtccatcaaaagatggccaaattaaatggtatgattttgtaaaagtgaaaaacaaaaaggaatttttgataaaatatatggtaaccaaaatttaagataattaaatggaaaataaat

SEQ ID NO: 34250 - DNA, 217 bp, Heterodera glycines
cataatagcaacagacacaacttataattataaacttcctctcaaaaaaacaacatcacaagcaaataacactcacttattctatttgtacataatatatcttctccatgtcttcttcctttttcttcttcgcttctcttcatcaaatggcgttgctcttcgaagggtcgcctttggttgttggtttaacttcgcgcaaactcgtcgcattggaacg

SEQ ID NO: 34251 - DNA, 1115 bp, Heterodera glycines
tgtcatcaaacaatgggctctgcagatcatacataattcatgaatatgatctctccagggccaggccaagcatctaaatggaaacaaaaagttgtaaacatatattcatcaaaagaatattagtttgaatctatcccgttttcaaagtgctttaatggaaatagtactccatctatttccaaaacgttgcaatgatggtaaaaaatcaaaagactttggctaaaaaagactacttatgtctgtttatgagtgtgaaattagagagatttatttttgaaatttgaatggtaattgttttaaactaattggaaactcttaaattgaaaattgtatatttaatattaactagcggggtcagcgccttcggcgcatcccccgctaggtagtacgattgtattataggattatgaatgataaaatcgactggctcggccgcttcgcggcctcgcatccttttcttcccttttacatttcaatcgccgggactcaacccaacagcattctaatcacagggactcaacccaccagcattccaatcactggcactcaattctcctacatttcaatcactgggacaacccaccaacatttcaatcactgggactcaacccaacagcatttcaatcactgtgactcaacccaccagcattccaatcactggcactcaattctcctgcatttcaatcactgacactcaattctcctgcatttcaatcactggcactcaattctcctgcatttcaatcactggcactcaattctcctgcattccaatcactgagactcaattctcctgcatttcaatcactgggactcaacccaccagcattccaatcactgggactcaacccaccagcatttcaatcactgccactcaattctcctgcatttcaatcactgcaactcaactctactgcatttcaatcactgcgactcaacccaccagcatttcaatcactgcgactcaactctcctgcattccaatcactgccactcaactctcctgcattccaatcactgcgactcaacccaccagcattccaatcactgcgactcaactctcctgcatttcaatcactggaactcaactctcctgcatttcaatcactgggact

SEQ ID NO: 34252 - DNA, 572 bp, Heterodera glycines
gttgatcaaaataatataaaaatgaaaaaattgataattttttgaatttttcaaaaattataagtacagtacaaataatgaaccagtcttttgaaatttaaacgaaacacaaaaaatgtaagcaaaatctcaaaattattttttgccgcaatttttaaagctgactttttttcaataaatcaccggcttaaacattagcgcccaaatgattcaatgaagtgatcagattttttattcggaccatggtttctcataattgcactgattgatttgatttggtaatttattgttaaatattttgatcagctcacacattccttcattggaggagaacaacaaaatgttgttgaacgtgttggaaatgggcacccaaaagaacaggaacaagttggtggtttgtgttgttatgtgtttaggacggacaaagcacaaaatggccaaaaaaagcttattttggataaaatgtattttgaattgcttaacaaaaagtttatatatttttgaatagagttgagcgggaccgggacctgaacacggacaactgagtaccgaagtcccggctttgaccggga

SEQ ID NO: 34253 - DNA, 725 bp, Heterodera glycines
gtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaaatcgattttttcaagtgtccgtttgggttactcaaacatttatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccggaaggattcggcctccccataaatcttgggcgcatcggttcggggggactgccccgaaaacaaaaaaatcgattttt

SEQ ID NO: 34254 - DNA, 1391 bp, Heterodera glycines
gttttaattggctaatttcatttgacactcacatcgacccaagtgagtcctgcttttcgccgtgctttccctccacaacaatttggttgcccacaacagacacctgaaaatgggacagttttattgataaacagctttttttgattatatttccgcctgatcagtaaataaaaacatgaatttgaaagattattttataaaataaagggatttgaaaaagcagtctcgagagcctgggacctttttttgaaatctctagactcggtgaaagtatcgctagaaaagcgatcagaaagaatttgtagtaattattatccgatcagttaaatcatgactgattacgaatcactcactgatcactaatttcgttttttcacttctatatacctcatctcgatcaaatgacgtttgctgatcactaagataaactgatcagagcattttttcactctgatcgcaactaggaaaatgccacggatgaatgcattatctaccttcagttcttcgggtgcaaacatggcacagtccatgctgaccgacagactgtcgtcagacgagtggaacgagcccgaggtggcggtgccgaattggtagttgtggggctggacgaaggtggtgccggtgcccgtgccgagtccgcccaagtcggaggggaagccggagccaagagtggtctgaaaagggcatggggaagaactaattgacgataattaatgctaatgaagccacaattgacagtgcgaatggtaatgacatgaattaactgtacaaaatgctaaaccgacaaaatgccatgatttaatcctcgctaattaattaatcatattaatttttccaaatccagtctgtgaccaatgaatatgatcagtaagtggagattaatctcaatgactgatcaacccaattttataatgcgatcagaaacaatcagtgagttgcctttttatcgaaacttcataatccaactaattgaaattcttcctaaattgttttgatttattttattttttcaaattattttgttcaattgccttgattgtgttcagtggtgatgaggtgaacatccgcgtggtcattgtcggcgtactctcttcgatcactttgcgttcgaaagtgcttaaaaagggcagggcaattaaaaaacttaattagttaatttcaattttttaaggctcaatcggcaatcaaagtgccaaatctgtttggcactttcggagccgggccaaggccagggatttccccagccaattttccaaccgccaaagcgtcgcttaatttggcactttcacccactttggcacaaaataatgttttttttttaaattccttctttgcagcactcaccgattataggaggagctctggttgaagctgctgctcattttgctgct

SEQ ID NO: 34255 - DNA, 627 bp, Heterodera glycines
gggcgaggatacaagaaagcaggggagggagtgagataaggggagggagacggacagaaaaggagagagggagtgagataaggggagggggggagggagacggacagaaaaggagagagggagtgagataaggggagggggtgaggcacaccgttacagaaatttatattgattgtctgaaccgctttggagagattaaactagaaaattttgtgaattctgaaatcatggttcccactcccttctcccaggggtattattttgtaaagactttttttccccattaaacttttcaaaccccatttttctctccgtgaatgttatttttattgcattctgaaccgttttgagtagattagactagaaaaaattgaaaattgtgaaatcatgtttcccactcccttctcccagcggtattattttgtaaagtctttttttccccactagacttttcaaaccccatttttcgcaccgtgaatgttatttttatcgaattctgaaccgctttgagcaaattagactagaaaaaattgaaaattttgaaatcatgtttcccactcccttctcccaggggtattattttgtaaagtctttttttcccccataaacttttcataccccattttt

SEQ ID NO: 34256 - DNA, 795 bp, Heterodera glycines
atcaccagtggcccgatctgtgcgttttggtctgtcggtaatgaatttaagaatcagagcgcacaatgtccacactctcccttctttctctttctctccctccactctctttctctctgtctccctctctgtttctctccatttctctctctctcccccatcctcttccttcttcctcttcctctccctccactctctttctctctttctcttcctctctgtttctctccatctctctctctcccccatccgcttcctccttcctcttcctctccctccactctctttctctctctctctccccatcctcttccttcttcctctctctataatttttactctctttcccctctttctcttcctctctctttctctccatctctctttctctctctctctctctccccccatcctcttccttcttcatcttcctctcattttctccctctctttcttcccctcccctcgccctttctctcctctaaattatttaattcttttaattttatattcctatttccccgtcttttgtaaaggccattgactgtgccgacgagcaaattgttggtgccattttgtgcaagttggaccggaatgcattggatgaacgggactgcattttgtcacggggtccgtgccatgaattgggcgtagggatagaatggacctaaagtgccaaaatcagacttgaaacgaattgtttttctcggcaacaatgcaaaattttcgtttttttttttactctctttttatccttcaggctacatcggcatgctggcggtggaggagtcctac

SEQ ID NO: 34257 - DNA, 955 bp, Heterodera glycines
aaattaaaaataaattgctttggtagcctagagcttaaatttttatcagtcatgacaaacaattaaatttaaaaaaaaaaactcaaaatagttctacctttttccctaacattgtccgtaatttgctgttataaaactatggatccgaaattaagaacgagcaactatatactatatttatcaatggaagcttaacttcttaaaaataaaattgttttattactttcgatgtttattgcttaaggtgatcagtagggctgtcaaaaatatggatataaaatcgcaaaatatgggcataaatgccaaaaatatgaaataaatcgcgaaaatggataaatatggaaaatatgttcaagttggaaaaatcaaaattaaaaaaggtaacgcaatttttggaaataattattttttgtttttttagacagttcaaccctgaaatagtggtccgcaaatgtcggtccgcaaatgtcggctaaccccaacaaacaccttgaacatccaatcatcgcatggcttgtcacagtccttctcgtcactgccatcgccacagtcgtcctgcccgtcgcacagttggaatggccgtgtgcagttgtggttgctgcactggaactcgcccacagggcaaatccggtcgccgcacacctcgcggcccggctcgtcatcaccggccgcacaatccttctcgcctattattaaacataattaattaagtagcattaattatgtagccctattaattgcattatttcataatattagcgattgcttctgaggaaagctatgaagattttttgttgcttttttttttttttgaaaaacagtactaattgtctttttaccaagtaaagccaacccctgacaggcgatgccacattaaaatattacaatatctaataatttttaaagaaaaaagacatctttacctaagtcaaaaccttaaataggtattatggaa

SEQ ID NO: 34258 - DNA, 826 bp, Heterodera glycines
  misc_feature (802)..(802): n is a, c, g, or t
agcggaaaagagtgaggggaaagaaagagggggaaagagagagcgggaaagagagagagcgggaaagagtgaggggaaagagagagggggaaagagagagggggaaaaagtgagcgggaaagagagagagcgggaaagattgaggggaaagagagagggggaaagagagagcgggaaaaagagagagcggaaaagagtgagggggaaagagagagcgggaaagagagagagcggaaaagagtgaggggaaagagagagggggaaagagagagcgggaaagagagagagcggaaaagagtgaggggaaagagagagggggaaagagagagagcgggaaagagtgaggggaaagagagagggggggggggggggggtaaatggcaaaatttaaatgtcggaaaatctcaaaattgttaaccaatagcgaagaaaaaattatggaaatgatttttaggtttttacttatttttctgcgactttaattcaatgagaaaagcacgaaaaacacatttttagaacgaaattcttcatttgaacgcccctttggcactttcggcatttagccccattttcgcctctattcggcatttttaaacattttcttacccatgaaaaatatacacccataaggaccgaccgcttcaaattttttttaaagttgaaaaagtaacaaaaaaatttttagatttttggataaaaacaattaaaaatttctcttttaatattgactacaaatgaaaaaaccgaaaaatcgaattttctataagaaatcttttttttgctttttatagaaaaaagatgnaaatttaattcatttgtaactaaa

SEQ ID NO: 34259 - DNA, 713 bp, Heterodera glycines
cctggacttgaccctgggtttttttccatatttgacatggacctggattttctggacaaaaattcaggaaaaccctggtccaggaaaacccaggttgccgaaaaaggtctgaggattcaataagattttccagccctggctggatccaggcccaggtcgagcttgaaaaaatacactcactgtctactaacaatttcacgcgttcgttacgcgcgctctcattaaaaacagttctcttgtgttttgatggcaaattctttatcatttctccaaactctgttaagcattgtttagcctgaaatttaaaaatattttttaaaaaatattattcccaaaattgttaattccaaaataagtttttttttttgcgctttggtggagcttcaggatgaagcttggtgggcatttcctctctttttttcgtagtggcttatgcccatttatttggtccaattttcactcaaaagttcaattctcatctctaaaaagcaaataatcctttctgtttgtttttttaatgaattttttatcgaaaacagtgaatcggggcatagtacaaattggggcttttttttacctgttttaactgtccaacgggttaatggaaaatgcatgaaaaaccaattttaaattcttagaaaaattaaaaattttgaaaaaaacatttaaattgatcaaattctttaaaaagtgattgctttgatgttacaaac

SEQ ID NO: 34260 - DNA, 969 bp, Heterodera glycines
  misc_feature (867)..(867): n is a, c, g, or t
  misc_feature (899)..(899): n is a, c, g, or t
aggcatttaattaagattttcataaaaaattttgctaaaaagattcttaatatgtgcaaaagatgtataaaaagtaaataaaagttacaacccttctgcttcacatagtcctcaaattatgtttttatcgaaaaataaaattctatgcaggttagttgggtttcactacagcactcacaacaaacacaggccttacgctgaataatttgtattatttttctcaacaaaaatttttgctttttagaatatattaatttgttcttgagaattctttcgcttcatttgtagttttgtacacagtaaacacactttctaattgtcattaatggaacttaattattcaaaactgggccaagaagatgcctatttaagctgcaattatcaaaaataaaataattttctttggttttcccaaaaatggcatattttgctccttttccccccatttgtcttttccatttaatttttattttccaattgctcggccccgttttctgtgctaatgtttatttgaaaaagcaatacggtgagaacgagttccgtattgagtcatggggcaaaacgaactgttcactgaacggaattgacattgtgcagcttggaattggccgaccatgtgaagaatggccagattttggtaaaaagacaattaaaaaataattagccatttataattaacaaaaaaaataaataacactttataaatgatttttaagcaaccattttctgtgatggcaaaatacttgaggtaataattaagaattattaattaattacgtttacgtaatttattaggcagtgaattattggggcgagcgaatgcttttcatgcgcgactcaaagcatttcgttgaccgtcctctgctngaagatgccaaaaaagtggtcgatgaatttanaaccatttttgatgtgacggaatggaataaattcgtggtcagcgaaatgaacgaagcgcaagtggacaaa

SEQ ID NO: 34261 - DNA, 796 bp, Heterodera glycines
  misc_feature (787)..(787): n is a, c, g, or t
attggcaatcagttaaatctaacggagttataaaaaaacaattaaaaaaatataatttactgttttgaaaagaaaatatttgttgacccaagtttcgttttgttttttttgctgagtagctgtacacatagaataaaaaaagattgctaaaattgttgtattctttagcccaaatttattggtgtttttgaccattgatctcaatttcttatggatttttcgtgaatctgagggtaatgtcacacaagagagtggggctaccttggcatttgagtggtctgcgctcaaagatggcactttgctcggcgaaccattccaagcggggaatgcacccattgcttacgttgtgcacagaaagaacaacaaacagttcgttttcataaaacaccttctgctgttgtaaataagaacatttttgctttcctttgctcctccgtttcaccttttttcttagcaaagtgccgttttttaacattttttgctggagccatccccgatgaacaattgcccgttggggctgttgcggatgctgcggtgtcgttgtccgctccatttgtgcggtgtcctctcgcttttggcgctttatgcaaagctgaaggaaatcgacggaatggcgacccatcggatcggcaatcgacgaaagaagcactccttttttattatcaatcgctcatttccgcagcatcactccacggaataataaaaataatcgcattcgttcacattctgtcattacatcgttcgtctgtttatttatgtcagagggaatgtctgtcgaagacattanaagtgacta

SEQ ID NO: 34262 - DNA, 917 bp, Heterodera glycines
  misc_feature (695)..(695): n is a, c, g, or t
atttcacccaaaattgaccataaatcgtgccagatgtaaaatttcgggtctatttcacttcaggcgtcaacaaatgacctcttcaataataaaatttcaaaaaaaattaaaaaaatttaaagaattttttgaaaatttttttggtaaagtgcattaaaacctagtaagtaattctccataaaaagaaaaaaatttctttcttagatatttgtggaaaattttttaagattttgaaatttctgtttggaaataaaaaaaatttgcgattttgagcaaatttttaaagaaaatcaaggatttttagggtccggcggtgccgataggcgccgccgagaaattttttgaaaatttcgatgcgaaattgtataaaaatgaagaatttttggctatatcataaaccggtaaaaaccggtccaaaatgccggtttccggaccggtttggcattttcaaaatgaccggtttccgggcccggcctctcaaaaaccggtcaaaccggatttttccaaaaaaacgccggaccggtttgctgggcccggtaaaaaccggtaccgggcccggtccggtccgctctctacatttcagcgatttcttgaaattttttttgaaaaactagttcgtcaaaaaaatttataagatattttttttagaatttgttagaagaaaggctttattttaaaattgctatttcttctanatgtgtttttaaaaaaaattttttttttttgaaggtatggcttaaaaattgggcaattacttctcttatttttacacttcattttgtttcacgttgcagggtcaacgatgttcaaattcgaattgatgagctcaatttgcaatttgtgtaccgtttgggagtgatggcggacaaacattgggaatgtaagttgggcgtattgtctttacatattaaaacatt

SEQ ID NO: 34263 - DNA, 981 bp, Heterodera glycines
  misc_feature (952)..(952): n is a, c, g, or t
catttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttgtctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatttaaaaatcctctgtgaaataaaatggcgattgtgcacagccctccgtctcatacgcaagcgcttttgtgaggtataaaatttcctcaaaaaagagatagacattttctgggatagagtataatttanaaatccctcaaaataaaagtctattgcgc

SEQ ID NO: 34264 - DNA, 543 bp, Heterodera glycines
tactttttcacaagccgaagtaaaaatttttttaaatagtgttttgtctattttaccagctttatccggtccccggattcttaaattggatcgagaattttttcccgcatttacaattgatttcaaatcgctttgtagggattccagagcccgaaaattatttgatgatttagaaaaaagatatgagcgttcgaaatttggattttcttataatttttgtattagactatagacaataatgaattcactatagacaggtgcagaaaatttttctctattgatatgcaaaatttgaagcggatttaacatcagggaaaaaaattaaacatcggctaagcgaaggagaggtacccaagtgaacatgtgactgccgaatgaatctttcagggtaggtagattaccccccccctttgtattataaatttttttttatttttgttaaatgaagcttctggccgagatatgaagcttttccactttggccttttctatatcattttcaaagaaagtaaagagcaatgtgagcgtcggtgacctggtggt

SEQ ID NO: 34265 - DNA, 1432 bp, Heterodera glycines
  misc_feature (1373)..(1373): n is a, c, g, or t
  misc_feature (1394)..(1394): n is a, c, g, or t
tcattgattcccctccaaaaatcttttattacggatttgccattttgttaaaatttaattattattattttgataatacattgttatttgagatgtttaagtgtacaatcttgatgattgagaatggaatgtaagtggaataattagaattaagtgataatttttaattcatataattttttggctttttaattttatgaattaaaaaaattgttaataaatataattaaaaaatgtaaattcaataaaaaaaaatttaagtttcggagtatttaacacattttaaatggtttaaattaaagtcttttaaagatgtaaagaatccgtcgtggtacaattttttcttgactcgtttttaattgaaaataatcaattaaattttttgaaaaaatctaattttttatacaaaagtttttaccgtccctggcgggattcccgttaataatttttttttcattttcccgttctcggaattttttttaccagactacttttatctatcagtttcattataggcacatttggagggagaaatatctgagcacagacaaatgtacatggacttggtaaacttcgctaatttaaaataattaaatggaacaaacagagcaataaaatgtggagaagtgtaatggagcaaaatgaaatgattcgcttggaacgctccgtcggtgtaatccgtcggcgaaggcaatgtaagcacattaaatggaagagattgccttgggtccaactagagcccggaaatttcaaatttgcggctctcgctgcgggattaagaattcaacaattttcggaaaagatcccccattttccaaaagatcagggattgcggactgggaccccgcaaaattctgcgtgggattctatccgccctcggggctctaagtccaacaattatttttttctcaagatgaatcttctccaacagccgtacccaaagtgtcatcgtcgtgcccacaggggccaaaaggcagtcccggagaaagcggggaaccgggttaggcttgaacaaggcattcttctgaccaaggccaattcaggcttggatggtgagccaggttctccggggtcgctcggtttaagccctgcggcagagcccccatcggaaaacccatatggggccggaggaaatggtcagagctgtggaaaatggtgaattgtcatggatgaaagctttatcagtgtattttcagcccagcaggacctatgggattaccaggcattccaaacaattgaaaaaataatttacgaatgtttaggttacaaaggaaaacgagggacacgtggagaaaaggggcaaaagggtacgacaaatttagttacactctcacaaacgattacttgagttgaaggtgctcctggcatgcctnggaagggacggacagcctggnggatgaagggccccggaggggggagaacggactgcccg

SEQ ID NO: 34266 - DNA, 821 bp, Heterodera glycines
attgaagacggaataccgaccgaggaaatgacaattgtttgatttgttacacaccaccgacagcaaaagcaaaagaaggaaatggcaaccagagaaaaagggttattgaaaagaaaagtttattccaatatttattttttgtagtcatccagcagtttgggcgagttgaagcgatcggacagtttgaccaaattgaaggaggaattgggcaacgaaccggcaaaattcacggagcacggcaaaatcgtcgatatccaggagccggtcacttacagaagtgaaggtatcagtgcaaacaaactctttatcacttaattgtttgtttttaacccggtagggtccatcagcggtcgtttgtcctccaacagcagttgggaggacgtggaaatgccccaggtgaaagtcgccgccatcgacaacggactcgcctttccgtttaagcaccccgaccaatggagagcatgtgggtttggccgggcacctaccaaaagcacagactgacattgacaccccaattcagaccctttccaatgggcaaaactttcgatggcacagatcccgttcagtgaagaaaccatccataaaatgttgccggttctcgaaaagagtgaatttttgcgcgagttaggcaatgatttgcggaacatttttacagttggaaaataatttaaaaaagaaacacaataataatttatacggataagggcttcgacgaaaagacgttcaacaaacagctcagtgtgctctatggccaaattttcaatctgcgcgaggcgttgagggaacggaagacgccggctcaattggctcaggtggggctt

SEQ ID NO: 34267 - DNA, 949 bp, Heterodera glycines
tcactcatattttttgctaattgagcagaagcgtaccaatctttgcagggatactccccggtaaaggactaacttacactgaaatgagcgccgagctagctggctcaaaaaaatttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgccgtggatttttgctccccataattgtttgagtaccccaacggacacttgaaaaatcgattatttttgttttcgggcagtccccccgaccgatgcgcccagatttatggggagaccgatccttcgggaatagcttcctatagcctgtactaaatctgcgtggattttactccccatattgtttgagtacccccaacggacacttgaaaaatcgattttttgttttcgggcagtcccc

SEQ ID NO: 34268 - DNA, 954 bp, Heterodera glycines
  misc_feature (893)..(893): n is a, c, g, or t
ctctcttcgtcgagcaccagcagagaacaacgcgtcgcattcgatttgatccgatggaccacctaactcagtttttcagaaagtcccggcatttttcatcacctccttgtgggacagatcaccaatcgattccccgttgactgcaattatgtgatcgccaggtctgagtccggaaagctgcaaatttaaaaatttctatgcccatttttgttttgctaattgaaatttacgtccgctgggctgccaatgtcaacggcaccaacaaattgtccttttcccctttcggcgtgcagattaaatccgtattcgcattctgcgctcgatttttccacaacacaaagacgagggattggaacggaacgcatcaaaaaaaaggcaaattttgaatgaaatgccaaaaaagggaaaagtcaaaaaagtaaattagaaaatgcttttgggtttatcctttcctacataagtatcctcaatttgatttgttttctgctcaaaaagcattgccaaatgggttaatttgttttggtaaagcctttcaattggccataattgggaaaggtcgcaaattcgcccgagtgaattgggccaattggaatcagtcaaagtgacatggccgcgaaaggctttgcgattgataagaaatgaatgaatggagctaaacgaattgcgatttaaaatagcgaaatgggaagggcgaaagagagaaagggaggggggaggagggattataaattatgaaatttaacagtgataaacaaactttagaatgtctgggcatgattaggatgtccaattatatggaatccgttttttctgggctttatgaggtacaaaacgcacgaaaaaatattattagtgaaaatggcctaagattttttttaaatggcacgaacganaatttgcagttttcgcagccaacaaaattggaacatcacagaggggggggggggggggggg

SEQ ID NO: 34269 - DNA, 905 bp, Heterodera glycines
tcaaaacttacagcaattattgctgcatgaaaaaccaactgtacaacttccatcgaggcaagctgttcaagaattaattaattaatcaattattattaattacacttactactgcaaatgccaacgttttggggggccgaaaaatggagaaaatgcaaaaggaagagaaaaatggaaaacgaagtgacaaaagagggaataatagaaagaagtgaatttgcaggaaacatcgcggaagggaataaaagaattaaatctattatttattaatgaagaacatatttaaattttggaaataatgagccgtttattttcatattaattaaattattattactaaaaaagtatatcaaatttaatttgataaagaatgaattggcaattgaataaaaagcaaaaagtgtttgtatttccttttatgcatcattttaaaatgaaaaaagtccagaaataaactcgttggaataaaattgtttgcacagtttcatttattttagaagcctacaaatcatatttattgcttgaggcgattaggaaagggattttataaagaaaataacataaaaaattcgctttttaattttcgtaaaaaatataattaatacaaaaaacagaaattccgtattttttaaaacagagatagctgtctgagaatagaattttcatgactcgggtagaagagaccaaaaaaaattgcgaatttctcgacccataggcaaacaatacagaaaagagcggcgcccatactttgccaaataaaaaaattaaccgctgagcaaattttaaaaataatctcatttatgaaactttctaatttttgaaccttttggaaatgagttaggaatggcaattttaagaaatgcgccagcgccgcaagaaaattagacaattttcataaatttatt

SEQ ID NO: 34270 - DNA, 1187 bp, Heterodera glycines
tgcaggttgaaataataataaatgcatttattttttttttcatttgaatttgaaaagaaatgtttacaatatttatgaaataaaattataaataatttaatccatgttcacgaaattaaaaaatttatttgaaattaaaaaaaaaattattttattttattttaaaatttttaatttgaaaaaaataaaaaatgtcaattctctttctgttttttctccgaacgtgcccattgtgaatgaaaaaagagatgaacacatgccactgaagtggcggcactcaacggcatttctttccttttttttattcttttcttccaaaaaagtgccaccacttttttgagtttgtcaaacaaaaaaaaatgaatgagcaaattttgtgccattatttaattggtgaaaagtctgtggtggtggcggcggtgacataaccaaattaaaagtttacacatgaatggaaaattggtagtgattttggatgggtttggcatttgtaaaatgccaattaacaaactgtaaatgccaaatgggataaaaaattgtgctgtgcccgccggaggcaaacaaagtttttttattgcaaatttgaaaaaatagtgacgaaatgccatacaaaacaaaaatatggccaacaaaagtttacacatgactagggatgggatttttaggtttttacctattttttttgcggcttagttatgatgagagaagcccaaaaatagcattttctcctaacaattttcgatttagagcgactttttagcacctaaaaacacctattttagcgttttggcacctaaaatagtttacaacctattttggcatttttcgaatttttagcacctattttgggattttcccagaaatttcatagtaaaaatgcaataaaaacgaaaaatacacccctaagaatcgatcccaaaaaatttaaaaatatacccctaaaaattgaccaaaatttcagaaaatattcccctaagaaatgaaaaattttctcaaaaattcgctccaaaatttatttatttattttcttgaccagttgcaattgtgcgggcgaaattgataaaaaattagtcacattttgaatttttgtacataaaaacactggattttttcaatttttaacacctattttggcctttttggggctttttagtacctattttgggatttttagcacctaaaaatcc

SEQ ID NO: 34271 - DNA, 1172 bp, Heterodera glycines
tttgtggagcctattggccttgccattgtctcatcactctctcccgggcatttctgggtttcaatttttacctccgccggatgtgtctccatttcgttcagtcgccgccgcttcagtctttgctggaagagaatggcattgaccaaagcgaacagactcggcgtatgtcgcgcattaattgggtcattagatttaaatgaaattcgttctttcttctcgcggacgaccgcactgacaacgagcattagaagaagataagcagcgtttttttttttggcaactgagagcaattcattaattcaggtgttagttacccttttctatttatgtgttcaacttattgaagaggatttactcattacattggcaaaaaccttccatttcgacaaataaatactttttaacaagtaggtaaacaaatgaagaaaagttaaaaaatagaaaggaaaattgaaaaatgagatcggaaaattcatcaaacggcaattcagtcagctattgctatcgtcgataaaagtgacatcggagagcaatgcgactttggacgcgagaggataaggctgaggagatagcaaagttatggacttcttctccgcatttacagcagtgacaatgacaaagccaatgcacggcttttttagaagtccctgatcgatggctgagttcggaggcatcagagccaacacatggttgaggagttgggacccaattggtacggagacaacctgaagggtgccagtattagaaggaacacattctttatattataaagtctaaaatttgccaaagtaaattcatggctaaaagcgaaagacaaaaaatattttgatatatttgaaaagatccgagttttgtgtttgatcataataattttctttaaagtcagattccctttttcttttatttataaaaccccaagaccaaacttttaattgttaccaagaatataagaattaacaagaaatttatggccaaataaactgaagactggacacccaaagtggactatagcgggagaacttcccccatttacctgagttcggtgatcctccagcaccattccgactggcacacacgaagccggcagctgttcagctccaattttggcaattaataattcctgttcgtccgacggtttgtcgtatgacagttcaaatgaatgtgggtaaaaa

SEQ ID NO: 34272 - DNA, 1278 bp, Heterodera glycines
ttttacttgggaaaaaaatccaaaattttttttttcattctttggggaggaaaaataaaaattactttattggcagggtggaacttaattgccatttttctttaaatcaaattattattttccaagtttttcttttttttttccagaaaaagaatcggccccctggcaatatttcattcaagtaatattcttacaatttctttgtgttaaagttttccaatttgaataataattatgtaatcaaaagtaattgaccaacaggtagaataataataataattaatgaggtgccaaaaattaatatcaaataatactcataatataagaggtgccaaaatttatataagctttttgaactccagcggtcatggtaagtctagtcacaggataagcgaggtttagttttcattgacactgcaattagtggaatcattaccgtggtttgcttttttggaattgctctatatccgtctcttgtttacatcgccgtcaaatttaagttaccctggttcgtacaaagatcaaatttctgactagacaacattaaatatcaatcatattggcatttcttttcatatatctagtagtgattcgagaaaaattaagagtattgcatctcatctttcagtacagcttccacgggtgtgtgacattttccgtggcatgacgccaaatttacagcttcttatacttaactgcatctcacctagcgtctataggcattttcggtgattgaaaaccgcgcctagcggaacctcacccttttagggtctattggttttttgaagcgttgaaaaccgcacctggcggaacctcaccctactggggtctattggttttttgacgcgatgaaagtcggcggtcgaaatgtggacggttcgttttcgtccacttgaagaccggcggcagaatgttgaaatccaaaaattactctcgtctggagatgtaataaatgaataacaaatgcgctttatgtcgtatgctttttagctgactgcgccaatgttcggtccgaggggttttgttgtagtccaattaaatatttatttattggagaaggaaaagaaagtcacaacaaatttggtgaacaaatatatatgcaactgaatgaagggaagaaaatctgagagggggaatgggagcatatttatgggcgagggaacaacatgaaataaggggaatcgattggattggcattatgtcacggacattcaaatcatcggcggcaatgcgccgaacacctccccccttaagcgctgttccgaggttacggtgaga

SEQ ID NO: 34273 - DNA, 978 bp, Heterodera glycines
tgttttaagccaaaaaattttttcgcagttgttattgcgatcataatgtgtcttttgatattcatgttccagtttttccctagtttgaaacctattttcagaaatttttcgattccggtgactacaacatgaacaagaacaagcctattccaccgccgataggccagaatttgactgctgccaacactcccaaactggccgttccgattgaaactgaacccgagaaaaaaatggaagaatcagctccgattattgtatcgcaattgctcccaatgatgcgtcccttggccggctcaatttcgggttgttcgatggatggcggcgaatctgacgatgagggcggacagcttcaggtttattgttagactcacagtcatcgatagggaacaaagggtttctttctcttcagtcaatttttcctgctcaaaacatttcttgaaaaactgacaattggttaattttgtctccttcagattcctcgacctgacacagtgccgcagcgcaaatcgtccattttacatccgtcagcacatagcaaattgagtcctcaaccgcacattcaccacgaacacactgacgagtcgttgaccttcccccagtcgtaaggagtgaaccgaaggcgaaaggagcgcaaatcgaaatggtgatcttccaacagcaattatagctgagatcggctttttgtttgatgtaaaatttacttggacttttgaggaatgacttttttgggcatgcttataattgatgcatttttctagcgagttggtatgtgcccattgtcagacatttaaagcccttttccataagcagttttttatttcaacttcggccaccatccttaagctttttcattatatatcattcgaaagttctgcctccattttaagaaaaagaattatctcgagtcggggaaatttgaagaaattaaatcgtcaatccggaaaaatgaacaatactgatgccatcgaaaattatgca

SEQ ID NO: 34274 - DNA, 936 bp, Heterodera glycines
attcgggtctgctgaaaagttagaagcaaaaataaaaaagcaaaagcaaatactcgacttcgacttgttgcatttgtcgcgttcattcatttttccgtccatttaattaccaaattaattcaaattgttttatttctttaatttacaccatttaaatgcatttatttggtattttcaacaattcatgggcccaatcaatttttccatttttggaaaatgttgcggaaagtgcaaaagggcgtaagaaaaaccgaggaatttggtgatgagagagaatcgctttgcgtcattccatctttttttattcatcaaaaatgccccccacatgcctcctttttcatttcctgttctttctctcctcttcttcctcctcttcattcttcctcctgcatattttacctccttttccttctcctctttctcctcttctattctacctcattatcctcttcctcttcttcctcctcctcctcttcgtggatggatttgctcatcaaatttccattcggattgaatggattttcctcttttgtccctccaccaagtgaatgattgtcataattgttgggttgcgaatattgtgaagcaaaaatggaagcggaagactgaacaaagggaagcaaaattaagaaaaaggaagggacgtacagaacggaggacagcggcggaagaagcggacgggcggaggtcgaagccgacgatgccgcggaggctggcggaggagcggcttttggtgcggattttgtacagcgaattctccgcaagttccgctcgttcctccgcgtcctccaaaagccgctgcatctgcttgtacttgttcaggttgaggttcgccagttgttcctgcatttcctttcccttttctttttctctccgcccttttccttctcaccgcctcttagttttgtcgtttgaacgtcttcaatttctgttgca

SEQ ID NO: 34275 - DNA, 974 bp, Heterodera glycines
  misc_feature (863)..(863): n is a, c, g, or t
cgccattctaacgaaaaacagaaataaatatggggaaaaaccttaatttgaataaaatttgattttactgaaatttggcttaacacagtgttatgatcgtagaatggcgacttttgaaccggaactgacctcacaaagccaaaagcacaattcatcgaagccacgagaagcagcctgggaaaaataatttaaatatatttaaatttttaatttaaaattgtattgtccttgagaattacgcagaatttccaagcggtctcgagacgacctttgacactctcgagcgaatcattaatgactactcacaatatgcagcgcagtccgtccctcatagtccggggtggacagattggcaccggcggcgtgccatgccttcagtgcgtccaagccgccggtgccggcggacagacaaagttcgacaccttgaaaatttttgaaaatttgatcgttagaaaatttggaaaaaaatttcaatgggaatcaccaatgcgaggccgtggaaccactaattggccgcctgcttggcgtaccatgctaatcacgaccaaattgcgtgatcggactgcgcacagtaacgcgttctcatcgttggcgtcgctggatggaaagtgtaaaaatgaacaacggagtcggatttttaggcaccgtaacgggggaataattagccataaatgattgaataccgtaaccgggcgaaattcgatttacttactacaacaaaatgatgattagaattggtttttagtgcaactcaattgttaattagtagagacccgcccgacaaattccatttaactacagtaactaactaattgccaattagtaccgtataacctgcccgatatattgcatctgactacagncaagtaactcaattgccaattaataccgtaatccgcccgacaaatccatatactatagtaacgtaattaaatgcattagtaccgtaatccgccgacaattacatctgacta

SEQ ID NO: 34276 - DNA, 757 bp, Heterodera glycines
  misc_feature (738)..(738): n is a, c, g, or t
ttagagcattttctgaaaaaatatttatgaattaatttttcaaaaaataaataaacagttaaaaactcagaatttctaaaaaaatttaaaaccaattacaattgtcattttttcaggttaagttagtcctgtaccggggagtatgcctataaaatttggtacgattttattgattattgaaagagctagaaccgaagaaaatctttttaatttaagcctaaactttttggcatgtttaaaaagcaattaaaaattttattcatctccctttttgatagtaaaagcatcagagagccttatttaacttgtacataaatttgatgcgtttcagagcactttctgaaaaaatatttatgaattaattttgcaaaaaataataaacagtgaaaaactcagaatttctaaaaaactttaaaagttatttctcttcctttcagtatccctgcaaagtttggtgcgcttctgataagtttctgaaaaaaaagttaagcctaaactttttggcctgtttaaaaaggaattaaaaatttttaaaaattttattcatctccctttttgatagaaaaggcatcagagtgcctaaactagcatgtaaataaaatttggtgcgtttcagagcagtttctgtaaaaatacttatgaattaattttgtaaaaaaataaataaataatgaaccctcctccttaataattttcctgcgcccaaggtctcactcagcctcttcgcggcctcgtgtngggccttcgcccccccccc

SEQ ID NO: 34277 - DNA, 849 bp, Heterodera glycines
tgagtaatgttgacgaaatgtttttagtattcaattttgaatttcaaatttgaatttcaaaattaatttaattatacaattcggaatttttgaaagggatttggtctaaaaaatatgaagattaaaattaatttaattttaatgttatttggtttttgaatgaagaataaatttaatttaattaaatttaatggaattaataaataaattattatttttaggatcatcattttttggccatagaattttgaaaaataataaaattttgaaaataaaatttaacccattaaaaaattgtcaaaaaaaagaattgctgtggaccgcgccggaacatttgcgccaaaacaaccgggccggcactgttgagggggacgtgtacagcttcgcaatcatctgcacggaactggtcaaccgcgagacggtgtggaacggtgtggagcgcgagcaggacattgacggtacggtaccgttgaacggaagttacggtagtggggggggggggggactcgagagagtcacaaaaaatgtgatcatcgtttcactctcgagattaattctcgaacagtctcgggttttcgagaattttccggggatcagttaatgtctcgacttatctgttacggataaagtactgactctcgggggatcggggtcaaaatgctttctctccaatctcgaagtctcgggatctcagtctatttttgcctcaacgtttaaaaaattaatttgttttttccccataaattttgtatcgcctaaaacggaccaatgtcccactacctcacaggccacaaagttcgcggaatgaagagatgtgtgaccaccaacgcctggagagggggagctgtg

SEQ ID NO: 34278 - DNA, 1031 bp, Heterodera glycines
ccgggacctgagaagccgggaccgggctcgatttttcttcggaaccgggaccaagcgggaatttttaaaaattcaataaaattttaaaaaattaaaaaaaaattaaattttaatttatttcaatgagaataatacaaaattaaattataatttttttgtgttttatttaataaaatccaaaagctagggctaaattaaattatgaaaattttcaaagcaaattttcttcaatcatttcaagtagacactaggccatttgcacaattgttaatgttacttttaaagaatatattaatatttttttttaaattttttcttttaactccaattttcatttctaatttttcacccagaccccattcttaccagtgcttgtttttcccgattcccggttgccctaccgggaccgggatcgggacctgagcttttcaaaatccgggaccgggacctcgggtgaccgggaattcccggcccggtcccgcttcactctactttatacatagagcaaatttaaataataagacattaggccaaagctccatttttaaattcaaatttaaaattttgaattcttttctgattgtcagtacaactattttaagatgtagatgtgagtaataaatgaatgaatgttattgtatttgttttattaaattttgccttttgtactttttaattttgcattatctattaaatttaaataaatgtcttctgaaatcgaaaacatcgtccccaatggcgcaatagatgaccatcagaaagaaatgaacaaattttcatggacattgaacgatttcgaaattgggaagccattgggaaagggcaaattcggcactgtttatttggcgcgggagcgagaaacgaaatatttaacggcactgaaagtgctgttcaagaaggacatggacaagcacggagtatcacatcagatgaagcgcgagatcgaaatccaataccatttgaggttggtggctgagttttgctggctcttaccgtcttcgattccatttcctctccccccagttaataat

SEQ ID NO: 34279 - DNA, 967 bp, Heterodera glycines
aaaaaccatcaaatgaaaatattttttgatataactttgttctagagcatctaaatttttaagtcttgatatcattaaatagcacaaagtgttttctattagcctacaaaattccaaaaagtttcgttaagtttcaagaaagttatgactaaaaatgttcaaaaaaacttggttttttgagcttctcaggtcataactttttttaaacttaaagaattttttaaaaacattccgtcatatcactgatatgacgtcatatatttgagtttgacttttaacattggctaattttgcttaaaaccaaccaaattttaaatattgatatcatttgatagcactaagtgttctttatcagtcagcaatcagcaaaattttaaaaaatttcgttaagtttctaaaagatatgactagaggaaactcaaaaacatggtttttgaatgaacatttttggccataactttttgaaagttaacaaatttttttaaatttttgtaagctaataatatagaacatttaaggctatagaatgataccaagaattattgcttaagagaaattttttttagtttttatggtttttaaatacagacataacatcttccaaaatgtctcgtccttttgttgaaaatatttaaaagaatttatatgtattatctaaattgaaaagtttaggcccactgttgtttacatgttttttgctgtgttgagtgcaacgattttttccggtaaagcaacaataaatgtggcacaattaaatacattagcgtaatcgggttaattaattttaaattttacgaatcataaatcgagcttcaattaacatatcaaaattattaaaacaattaaaagtaattatttcatcttcacttttaagccgaatttgtcaaatggttctgattctgatggaattaagaatggagaaaaggggattggaaaggaagaacaaaacgacgactatttatttgtc

SEQ ID NO: 34280 - DNA, 992 bp, Heterodera glycines
  misc_feature (40)..(41): n is a, c, g, or t
  misc_feature (186)..(186): n is a, c, g, or t
aaaaaacttttattgcgctacaaatgcttttaagcccgcnncgtgaggcgggacagttccaaaatttgcaccacattttactgtgaaagtccaagtaccttaattggacaactacgtgtcaatgagcacagtcgcctctgacctcttatggagcagaaaagggtgaatatcagatggggtgcgtcncatcctaaaaattcctcttttcgtctaactatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggctactttttgtgcactattttcgtttttaaaattggatccggattttttggcttttttaaataaattgtgaaaaattcaaaacaaaaaacttttattgcgctacaaatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggctcctttttgtgaactattttcgtttttaaaattggatccggattttttggcttttttaaataaattgtgaaaaattcaaaacaaaaaacttttattgcgttacaaatgcttttaagccccgccgtgaggcgggacagttccaaaatttgcaccacattttactgtggaaagtagaagtatattaattg

SEQ ID NO: 34281 - DNA, 714 bp, Heterodera glycines
ggaaagtgagtaggttgctgacatgcatgaataaatcggcaaggagctttgagggcaattagtaatatgggaccggggagggggagggggcggagggaactaaaagtatccacggacaacccccggggggggggagggaacgagtacacgggtcaaatccaaacaacctgacaaatgaagaatgaaaaattcaacaaccaaaggggcttaaaaatagacaatagggagagaaagaatttacaaaaaatgaaaacgatttattaagaaagccaaggattttctttgtttttttagtcgttccaaaaaaggaaaaatagcatttaaaacctatttggttgaacatttaataaacgcaatttattacacactcattcgttccttttaatcaccaaaaatatttttaatggattatttaaagctaaaataaataaatatggcgaaatgagaaaaaaaatcgagaaaggaacaatgtgaactatttggtatttgacactgggtctctgcaaatggaattttcaaaaatttgaaaaatattcagaaaaggaagtttttacattgggggatgagaaggtggataaaaagagtgttgagatatggtagtagaagatgcatttgggtgtcggatttgtgccgctgcagcgaacatcggagattgccatgggtaaacggaggcggcggaagggacagtcggtgcggtcaaaggggacgcagaag

SEQ ID NO: 34282 - DNA, 1116 bp, Heterodera glycines
  misc_feature (1078)..(1078): n is a, c, g, or t
atggctatctctttttttggcaatctggtaatagaaatctctatggaaacaatgacagtggctgtcatcagttgttatgctctaaaaatgattttcgggccgtttgagtatatgtggggtatggacggtccaaaaaaatggctatctctttttttggcaatctggtaatagaaatctctttggaaacaatgacagtggctgtcatcagttgttatgctctaaaaatgattttcgggccgtttgagtatatgtggggtatggacggtccaaaaaaatggctatctctttttttggcaatctggtaatagaaatctctttggaaacaatgacagtggctgtcatcagttgttatgctctaaaaatgattttcgggccgtttgagtatatgtggggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtggggtatggacggtccaaaaaaatggctatctctttttttggcaatctggtaatagaaatctctttggaaaaatgacagtggctgtcatcagttgttatgctctaaaaatgatttttcggggcgtttgagtatatgtgagngtatggacggtcccaaaaaatggctatctctttttttg

SEQ ID NO: 34283 - DNA, 1000 bp, Heterodera glycines
ttaacacggcgattcaattttgggctccaagttcaaataagtttattatttatttagtaatcagaacgccaaaactttgcaaaacttaaaattttccggggattttcccttgtaaaaatagaagagccgatctcgagttaaaaagcattttgataaaaaaacaaagcatcatcctataggttgggttaaaatatgtgtttatgcaaaatttcaagaaaatcgcaactttggaaaaaattttacgactgggcaaagttttttctttttctctcattttgacgcactatttccatgtctctaacatataagataacacatggttcatttttttgccagtaaacaatttttttaaacttttgactaattaagaaatattcttcagaatttccccttcaaaatgagcataaaatggttttgtttggtctattattgaaaaagttttaagctaaaaaaaaattcataaaatcaagggtaaaataaaatgtttaccttttattgtttgtatttgttcttttggcgttctgtttttattatttttttatttatttgctttaaaaaaatgaaatttatacacaaacacaaagaggatttgaacctgagacccactttttggtgactaactcacagaccactaagacgaaaaaaccaacttaattgtacttggagcccaaaattgaatcgccgtgtttaacaagactcaatattaaaagtgtgacttgagtatctttttttggcgtgccatttgactagaaattatctgttttatgccaaaatgttattttggtttttattgttaagttgcactttcccatggctaattgtaagacccaaaaaacaataattaaaatgtcgaatttggttggcgataaaattctcgagttgggaaagtaaaggattcaggagaattttttatatttttttgattccctttcaattttgagtcctaattcatttttcatctttagcttttcttgatcgacccaaattatgtattcgacct

SEQ ID NO: 34284 - DNA, 972 bp, Heterodera glycines
  misc_feature (930)..(930): n is a, c, g, or t
  misc_feature (938)..(938): n is a, c, g, or t
gtccgaagtccctttttcaatttgtcatcgatgtacagagaaaggtattcgggtgcttttggactgatattgagaaagtgttcaaagtccgactgaatgcactgcttgaattccctgtcgttattgaacgcttcgagcagaaaacggtcgaattgttctttgagtccaattaaactctaaaaaaataaagtccaaataccgagacagaaaagttcacctggatgaaaatgattggatttgaaactccgccgattggctctacggtttctccctgcggctgctgttgggtgttgtcgttgacaactgcggtccctttggcacgcaaaaatctgctcattgtatttgtcatcgtcttaggcccgctttcaactcttttgagcaattcgtacagacagcgcaaatctaatagcaaaaagtagacagatttatattgaaatgtaaaaccatcaattcggtcattgagcaacatgtaaacgagtcccgagttgtccatctccacaattgtcgtcatgttttttgttataagttcttcgttcagaacctaaaaagcaaatccaatttcgttattctcttcacagaattaacgtgaatgattttcgtctccgttattttgtccaaatagcgctccgatcgttggacctcctcaatcaaagattcgttgactttgtgaacgtaaacgcacgcgctgttctccgccaaaaacttttgacttgcacgacgatagaaatcggcagtttctcggaggaaaaggtcctcaaattggtgctcgtaataggcgcgattgtccaaacccaacgcaattaacatttggcacacatttttaaggtcaatcctaaaccaataggagtaattttttatgcagatcactttttaaggtaagaatgaaatttgtctttttagggatatttttcaacaatcattttgctctanagtcctanaaatattacaaaaagaggggcgctaaactgcact

SEQ ID NO: 34285 - DNA, 980 bp, Heterodera glycines
aattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttctcggggcagtccccccgaaccgatgcgcccagatttatggagagaccgaatccttcgggaatagcttccctatagcctgtactataattctgcggtggatttttgctccccataattgtttgagtaccccaaacggacacttgaaaaaatcgattttttttgttttcggggcagtccccccgaaccgatgcgcccagatttatggggagac

SEQ ID NO: 34286 - DNA, 842 bp, Heterodera glycines
ttgaagtcaaaaaattattcgaatttctccaattttgtttccataatttccgaatgttattcggtatcataatgccaaaccaaaacgaattcgttttaaaatattcttttctggacttgacttggtttctcaatatcgaagcttttttctccgcaatttctaaaacgcttataccaaaccctagatttttggttccgatgggtttcagaaaaaatcccgtgtggtgaaaacatatttcacatttcacttcataactttttgagttctgcacggatcgagaccgggataagaccattggaaagagcagctcgagctctacaagaagctatggaaagaaaaaatcgacatttcagggactttttcagaaatcatatttaattccccaatggggccccattttgggtccccagccacagccccatgcttctcccaattgtggcgaaaacaatatttcacatttcacttcataactttttgagttcggcagggatcgagaccgggataagaccattggaaagaacagctcgagctttacaagaagatatggaaagaaaaaatcgacatttcagggactttttcagaaatcatgtttaattccccaatggggccccattttggttcctcagccacagccccatgcttctcccaattttaagtcttggatttgtcaaataaattaacgatttcgaattaataataaaaaattctattataaattttttttgtagaggggaaaattctgaaccaaactactatttgaaaacccaatcaaaactgggaaaaaatttgaagtcaaaaaattattcgaatttctccaattttgtttccataatttccgaatg

SEQ ID NO: 34287 - DNA, 664 bp, Heterodera glycines
  misc_feature (38)..(38): n is a, c, g, or t
ttattttgaggcaattttttgaaaatcgtaaatatttntgccgcacactattagcgaatttttgttttaatgtatcactttaatgccattgtcatttgattttctaaagtagtaatatatttattttgcttttctaataattaaataatatagtttattagatttgtttttctttttttcttatcattttttattttaatctcaaatttaatataaattttttaaattattttattttctattttatttatatttgaattgaaaacataagtaaatcaaaacacttcaattaatcttttttttaaatttatataaatgaaaattataaaattacaatatcaactattatttattttattttcttgtatgatagtcctgactacttatcattgctatgtgagaattttttatattaaaaaatggatttatttattgaactattatttgatatgtttaataaaatttactttaaagtttacattaagtattgcttttttgtttttaaactttcttaaaagttcgtttattaatcaactatttgtaatatgtcctttgttgaagtaatcaatttgaaggagtaatatttctatttctgtcttaaatattattttattttgtaataattatttttgtgcataagttggaaatgaacggaccgggtcag

SEQ ID NO: 34288 - DNA, 893 bp, Heterodera glycines
  misc_feature (8)..(8): n is a, c, g, or t
cccaattntggccacccccccccctcccaatttctaccggcaattcccccggcgctgcttccgcccgaactgctgctgacttcgccccgttggtgctcctgctcagtccacaagtgcaaatagagccttttcagccacaacacacgtcggtcgggattgcgcatctgatcttgaagccgcttaatgaccttggaaaaaacattttgaaacggcaaaagccgaacaattagtgttcactttgtccaatcccatccaataatgagcaatttgttgcggtgccaaaaagtagagaaattcgttgtcattgattgagcagccgaaattgatggtccaacattccaccggcacctaaccgatgataaaaggctcaaccaactgacccaacattgccattttgctccgtttgtccttcttttcaaggacccatcgttacttacgctcatttcctccacgctgtgccgtcggtaaatagcttcaatgtccaagtcgtaggaatcgaccaattcaatggctttaatgtaggaagtgttaagaaagccttcgtcaagagttatcagcgctgaaatgttatttattttatgatcaaaaattcgacggaccagcgcccggcggacgcggactgaacgaagtttgcgcgcggttaatggccgcagcctccacaacttgcaaattcgcgcttgcctttgccacggcgatcatttccttctcgcggacatcgcggccatagaaaattctgcggagagagcagaaaaaggggggaggggagatggcattgacttggggtgatcggtttgacttggccgatcagctctgacgttcgctgctttgtgcccacctttgccacaccacattggcacatgcggcgtccagccgaaagtcgcacagtacgctcc

SEQ ID NO: 34289 - DNA, 883 bp, Heterodera glycines
gaataaatttttaaaaactgttgttaatttgtaagcattaaaaaaactaaataatcccaaaaatgaattattttttaccgaataaaatattacaaataaaataaattaatactataaaattaatttaaagtgaaaaaaaaattgaaaaaatgaattaatttattaaaaaggttacatttgtgctgcaatgtgtagtctttttgataaaataaaattttatctcttcagcataaaatcccgtcggcattttcaaatgcggcaggacataatgccagaaaatctttgaggaaccccctagtggatttatattttttctctcttcaaaatggcccaattttttagtgcctcggccgggtaatgcgcgaatttttcgtagtccgtcgcgtgggtggcgagcgcgaggttaaagtgcaccgcgccactgacatgcgtactgagaaatgcttgacgggacctgccgggtgaaaattgggggtttttaaatttgaaattcaaatttttttttggcgactcgtcgtttgggtccgcctcaaaatggccaaatttgtaggacgggggccgcgcattgggcacaaaagcgcagtcgagcagacgaacattcaccgaagctgtctgaaaagtgcatggaactttggacgatttgacgaaaatggtattccttacgaaaagccaaaataatttttaaaaatgaaatatttaaatctaatcgaattttattaaaaatttaaatcaacatgcaaattaattttaatttccaaaatataagtattttaattttttaattccgaatcgaacaaaaagtcgaaaatacaaattttccaaaatatgtgactttcagttcatttccatgcgttgaaaatcggctcagcacaaaattcgaatt

SEQ ID NO: 34290 - DNA, 757 bp, Heterodera glycines
ttgaggaaaattattcgtattgctgtcaatggatacccttttgtactagggttcgataaaatatgaacaatatttttccttgctagactttgggaggcctgaaacgcacgaaaaacatgtttttagcttagtttgaagcttctaagatgtttttctttctgaatttttttaataactcgcaaaatttgttacaacgattattatatgaattaaatttcagaattccaatattgattgtttaatgcttatttatcaggaatgagataaaaaataaatttgggtagtgtaagtgattaataattgagcaagtatatttcagggctcgcaagtttttttttttgaaaataagtacaaacgagattaaaactaggattttgaccaaaaaataagattttttaaaaacggctttttacattatagaaacaattaaaaacatggctatcaactgaaaccttcaaaatcggcatttggtcgattaaaaaaaaatcgttatttgggtcaaaaattagcattttggaaaattattcaaagtaaaaaaatcaataaaaatgttttctttttgcggcgtgctttttctaaaaaaattttggcaaccgggagggggtcggtccgccggcggtgccgataggcgccgccggaagtttgaaaatttgaatgcaatttgttaacagatattcaccaaaaaatgatcccttttgcgattcttagccattttcaaagaaaattggtagttttggggggccggcggggcccttag

SEQ ID NO: 34291 - DNA, 788 bp, Heterodera glycines
atcggatggcgaatggttggccatccgtctgagtggcgacttcaaatgccatttttggcattgttttgctaatggacaaaagtggacggacaaaggagaaaataaatggacaaagtgacgaaaaagcgaaggacaaaaggccaaagagaatgaaaggaaatgatcagctgagacattacggcacattcaattgacccaacaatatttgacttgatttccaatttaccactctgtttgtttgatgtcctttttttgtatatttttttgtttccctttttcatatttattttttctcttttcgaccatttcaaattgacatttttaaaatgatgaatgaaatttaccctttttcctttgcccaattttctttgactctcataaaattcagttttttaaattaaaatcccttttttttaccattcgccttttgctgctaatttctgatgcttttccaaaatcggtgcttcaccaattgagtgtaccttttgcttccgtttgtttctgctgtttcgttgttcacttaatgcccccaaagtcattgagagattcgcccggggaagtgaaagggtgggaaatttttagggaggcaaaagaatttttggaatttgaaaatgttttggtgggcgagcagggcatttaacaatggcggattatgtgaacactttgccacaataacaaattggtacgcaaaggacgaaaggaatggaaatgctctgtttggtgtgcggtgacagggccagcggacgacactacggtaaaaagggggggagacaatggggaagacacta

SEQ ID NO: 34292 - DNA, 909 bp, Heterodera glycines
  misc_feature (40)..(40): n is a, c, g, or t
  misc_feature (46)..(46): n is a, c, g, or t
  misc_feature (891)..(891): n is a, c, g, or t
ttttggcgttctgattactaaataaataataaacttattntgtacnttggagcccaaaattgaatcgccgtgagaaagagaaccttagtgactttttgtgcgttatgttccattgatttttcttttttgtctgtctgtcttcctcgcctttttctccccccccccttaagctatttattaagcatgattcgcattgtttgctctcctccgccaattattgatttttgatagagagaaaagacagcggcagcagagaagtgatgtgtgggtgtgtgcgaaacatttcgctctttttgtgagagggcggattaaaacaggggaatacgttcgctcgatcccacggaagatttttagtgaaaagggcgtatatttataaatatattttttatttacgcagtttcacgcgcttttctacgcattttactcgcttttgaagttacccttaaaccctcataacattagctaattgacattttttctcggtttctcaatcaattagaaatgtagaatctttctccttttcatactacgcgtaattccaagaaatcgatacaatcgataatagcagcgggcggaccagcaactgactaaccacattcaacaataaatgcatcttttcattctttgtttacgccctgagtttattatgtgtgaatgtgcgtgggccgatatcaaatatagttcaattgggtcggggtcacttcggcgcggaccatttcggcgccgcaaaatacatatttgggattttcttacatatttgtacatattttggatttttttcatatatattttcatttttttacatattttgagtatttttatggaaatttttggaaatcctcaaaaaaaaatccaaaatttcggcaaatatttttgtacatattttcattntttttacatattttgaaa

SEQ ID NO: 34293 - DNA, 978 bp, Heterodera glycines
  misc_feature (917)..(917): n is a, c, g, or t
gcgcgggattttttctccccataattgtgtgagtgtcccacacgcacacttgaaaaaatatatttttttgttttcggggcactgcccccgagacgagacgcccacatatatggggagagcgagtctctttggaatatattctctatatcccgtgctctatatttgcgcgggagtttttctccccatattagtgtgagtgtcccacacgcgcactcgaaaaaatatatttttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttactccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaangtgctctaaagcgcaccaaattttatttacaacttaattttagcactctgatgctttagta

SEQ ID NO: 34294 - DNA, 736 bp, Heterodera glycines
ataaataaaaacgaaagactcagattttcgaaaattttttttgagccagctagctcggcgctcatttcagtgtaagttagtcctttaccggggagtatccctgcatagtttggaaagcaattaaaaaattttaaaatttaataattttcctgcaccgaaggtactcactcggcctcttcgcggcctcgtggtgggccttcgccccccccctcccacgcccttcagagcacgacaaatatttcaacaaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttttcccaataaacttttcataccccatttttcgcaccgtgaatgttatttttattgaattctgaaccgtttttgagtatattagactagaaaaaattgaaaatgttg

SEQ ID NO: 34295 - DNA, 1057 bp, Heterodera glycines
aaaaaaaagcaaagtcaagaccaaaacctttaaagcccttagccggttgaaataaatgaaaaaaaaagcaaagtcaaagcaaaaataggaactttattcaaatttaaaaaagttaatattttgtattttggattatgcatttaatcaaattttttctttctttataaatgttagttaattagtcagcgtctattttattttctgtaaaaatttccctctttatttaaaattaaattaatataatttcaggaataagacacttaatgtatagagaatgaattaacgtggtcgatgggaataaatggaaaaaaaagcaaagtcaaaacacaaaaccttaaagcactagccgattgaaataaatggaaaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaataggaactttatacaaatttaaaaaagtaatattttgtatattgtatatgcatttaatcaaatttctactttctttataaatgttagctaattagtcagcgtctatttattttctgtaaaaatttgcctctttatttaaaattaaattaatataatttcatgaaataagacactaaatgtatagagaatgaattaacgtggtcgattggaataaatggaaaaaaaagcaaagtcaaagacaaaaccttaaagcactagccgattgaaataaatggaaaaaaaagcaaagtcaaaacacaaaaccttaaagcactagccgattgaaataaatggaaaaaaaagcaaagtcaaaacacaaaaccctaaagcactagccgattgaaataaatggaaaaaaaagcaaagtcaagaacttattctacctaatttcatggtgactgacgaggcatttgactcccttaagagagccttcccttctcatgtacttgtacctaaaa

SEQ ID NO: 34296 - DNA, 207 bp, Heterodera glycines
  misc_feature (51)..(51): n is a, c, g, or t
  misc_feature (53)..(54): n is a, c, g, or t
  misc_feature (56)..(56): n is a, c, g, or t
  misc_feature (59)..(59): n is a, c, g, or t
  misc_feature (64)..(64): n is a, c, g, or t
  misc_feature (68)..(68): n is a, c, g, or t
tctgcttcccgacctgtcatccccgagatttcttccctttccaggaggggnannantanaaaanaganaaggtgattaatcactaacaatttttgttgtatatggtagttaattttttttattattagcaggattttttaaaaaaatagtattaagtgttttttattagactacaaaattccaaaaagtttcgttaagtttcaagaa

SEQ ID NO: 34297 - DNA, 575 bp, Heterodera glycines
  misc_feature (536)..(536): n is a, c, g, or t
ggggaatttggcagtgatcgccaatcagtggaacaagaaaagaagcaacagacaaagggcaaaacagcagcagaaaaggtgccggcaaagcaaagccaaggcgcaaaggcagcgacaaaaacaattaaaaatttaagaattattataaaaaagacaaatgaatggacggatgagcaaacaaattaaagtgggggagggggggagatgaagcacaaaatggaagaaaatggcaacaaaaccatttgcactgactgacaccccaccaccagcacagctcaccccccatcacatgcaatgggcgggtgggtcaatgccaaaatatcagtcaaaacatcccttcgccgcagtgtttacgacgccaaaagggcgacgcattccccggcaaaaaccgctttttgtcttttgctatttcatttaaataatcttcagctcacaaatgccatcaaaaatataaaaaacaattaataaacttttaagaattttggcccgaaaaaggaaaagtgaccgccgccgagggaacgcagcaaaagaattgngaaatgacctcgagaaacgaccgaccgacggaacacgtc

SEQ ID NO: 34298 - DNA, 854 bp, Heterodera glycines
tttcttccattgcttatggtatttatatgaattttcccttttaaggaatttctttgtcactcattttcggcatttcttcttttatttgccaataaattttcattttctccattttttctttctccgctattatttttcggctaattccaaattgcttcatccattttttaactgtgccataacttactctgattttcttacaaatttcggcataattttgttgccattcttttcttgaatattttcttcctttttgcttaaattcatttgttatttcagcaaatttctgcacaatttcaaatttttgctcatcagtttttgatttgtagcatttgtttgttttttgatttaatcccaattctttgatccatttataaatatattggcgatttgtgcccaatttttttgctatttttccttcaattttactccattcttttcttgggtattttcttcctttttgcttaattttctcttttatcttattgaattttccaattatttctctttttttctgttcttcgtttcttttttcttcccatttttctccaaatatttcatcaaatgttttttgttccaattttttattttcagatccgatctgatcagttagggtgatcaaaaataaaattaaacagaataataggcacaatttcaaatgcattattttaaaatattactaatttttaaaaataaaatgcacaatttggcagaatttgtttaatgttattattaaaatgattaactatataaatttgatgacgttaattagaaaatttttcgcctgtttattggctttttcaaaattaggacacgttatgtaaatgcaggacattctttgattttttacatta

SEQ ID NO: 34299 - DNA, 1028 bp, Heterodera glycines
cgaagaagccataaataaattctgtttttggaaagaaagaaatgtgtgccaaattttaaatttacaaatttaaataacttaaaaatgtgaaaatattttaaattaatactaagaataggcaaattataaaatttaattatgtatgggaatttatttaatatatgcaaaaaaaatttataataaactaataaattaggaatataatcgtgtttttccacaatgatacttaaagcaattaaaaagtgaatctttgtaaatataaaaaaataaaattaaaataatgtttaaaaaacatataaatttaaattaaattaaaattttaaattaatttaaatataaaatgggatttaaaacatttatctaataaaaaaaattatatttaagcaaaaataaattttttttaatttcttttaaaattgaaaatgagataacctcccaactctcgaatgcttttcctgctttgtaaaatgctgcttcttcccttgcccacctgttcaaacccgtcgatgccctccaccgtgtccgcgtcgcgcagcgtgcgctccaccgcctcatacggcaccacgtgcgtgccgttcacgaaacacacttgcatcactacctttgcggcttgagatggtgacgaaaaaaggtcgtcgccggggaaaattgggggccttcgtatgaaaaattggtcctggcgcaccccttgttcatgtatgttcctcatcccctcccccaagtcgtcatatattccccatgttatttgtttttgttttttttacctttatagcaatttgtataattcagcccatgaccaaaaccactgttgtgtgccccccgggtaattgtaaaataaacagcattattggtccttttacttattttttcactaaataaaaaaacccttcattgtttcaactatttgttcaaacgcattattaagataatgatggtcattctttgtgtattacctaatttgtagaatcaattaagtcggaattgtccacttattcgaagttcgtgggtcaaaatggacggttcaaaat

SEQ ID NO: 34300 - DNA, 814 bp, Heterodera glycines
agggaagctattcccgaagggattcggtctccccatatatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggct

SEQ ID NO: 34301 - DNA, 1341 bp, Heterodera glycines
attttaagcatacattttttcctcatcagtggacgggggcacgccccgacgtgttgggtgggcaggcagagaagagtggtcgtgggaaaagcatcccccccgggcattttcatcagtattttctttatccactcactcatacgtagtggcacttttcaaataagcacccacccacccacgccaccaactaaaagcaaaaattccaccaatcgtgtggaagaaaagtaacaaaaataatccaatttttttttgaaatgggcagcagctgatgggggaaggaatgggtttcatgtcgttgtcgtcgtggtccactcactttcattggacaacaaatgacactttgctgcttgctctctctgtctgtttttgcccattttacggatctgctggtgcacctcaaatgcttgaaagtggacactttggtacctatttaggttgtttttgaacttgggaactatgataaccagtgttttcgtttgtctttcaattttattgaatccaatcagagactaaccaatgccatgccattggttatgaaatgaatgtccgtctgtatgtttgtaaaataaaatgtgtgtgtgtgtgatgtgagcaaagggcaataaagtgagttgaaaattgccactgaaaaaatttgtgtcttcagtcggtgcgttaatgaaaaataaataggtaaaataacaaaacggacattttcaaacgatcaaagtgggaacacaaataataagatgataatgattaaatgatcaataatcaatcaatgcgcgcgtctcatatcaaagccagaagaagagcaaaaaggagaaacaagcaaaaaagaaagaaagaaagcaattcaatcaaaaaaatcagatcatcaacggtctccccctctgctggccgcgttgttgttgctcaagaattcacggactgaaatgttcatgttagccggaccactgctcatcatcatatttgctgctgttgatcgctgctgattgtggtggtagtgttgctgatgctgctgctgctgttgcggttgttgatagaccaccgcaggagaagcggcagaacgtcggtgatgatgttgctgaacagctcggccacccgctgtcgctgaagatggcaacgacaaaacatgatgttgctgctgctgatggtacagttgctgttgttgttgcggcatcaccaattgcgctgttgtgtcgcctgatgatggtaatggtgacggcaaagaaggccccgttgttgttgtcagcagcgtgccgtgcggcatgggctgaagggtgcctggcggcatcaccgccaacggcagaacacgtggagagtcttgcaaccagcgaactgttttttggggtttgggaa

SEQ ID NO: 34302 - DNA, 1266 bp, Heterodera glycines
caaaactaagagattttgtactgatttttattgacaattctatttatttctcacgacttgcgacgtcattttaatgttgacaaattcgtcaattaattaattacctaattaattttttgctaattgttcctccgtttcgttcacagattaaaaaaaaaaagcaattggaaaggcaaaagttttaatgggaaaagagagaaatattaattaatcattattatcattttattagtttatttttgcgaaaggaaataaaagtcgacgcttataaatgaggaaaaagcaaaaataaaacattattttaaaatgtttaaaatatttattaatttaaattaataataataataattataattatttttttttaatgcgatttttccttttgcttatctttgcctattttgcctcaacatttgcccattaaaaatgttgctcaactcttccaaaatcactgttttcttgatggcattcttcattttggccttactttttgttggcattaaaacggaggaaacaaacggagatggcattggccaaccaaaagtgaaaagtgataatttgaaacactaaaatttgattccaaactttaagattggccaaaaatcggcggcaaatggctagaaaaaacattcaaaaaagtaaaattgactagaaaatttaaggtaggcccaacttggagaagaagccgagcgaaaagcgccaaaagcgacagtgggggggatggccacgaagcaaagccaattgaacgaattcggatgaatattcgattaatttaataaaattttttacttgccaaaaaaatgtttaaaaaaaacaaaacaaatttgttttgtaatgcttttactgacaaattcaattttgcgacgtcattttaatgttgacaaattcgtcaattaatcaattcattaattaattaattcttaaatggatggtaatgtcatgctaaattgtcccattatttctgttttgttttttccctctgatcattctctggcgttttccctttcctctctgataatttaataaatgaaatacaggtgctaggccacttcacaaaaggtgcaaatttgggcgcttcacaaattgtcataacttttgaaaaactcaataaaatttgttgaaatttagcaagctaataacgcaattcaagggctatcgtatgatactaagattgtgcaatttggtggtgtctgagaaaagttatgagttcatttagtcaaagatttagcaaaatttgcacgttttgtggagtggccaaccatggaa

SEQ ID NO: 34303 - DNA, 993 bp, Heterodera glycines
  misc_feature (845)..(845): n is a, c, g, or t
  misc_feature (859)..(859): n is a, c, g, or t
  misc_feature (896)..(896): n is a, c, g, or t
  misc_feature (914)..(914): n is a, c, g, or t
gacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatccggttcggngggactgccccganaacaaaataaatcgatttttttcagtgtccgtttggnggtactcaacattatggngagcaaaagtccacgcagattaaagtacagctatagtgagctattccggaggatcggtctcccataatctggcgcatcg

SEQ ID NO: 34304 - DNA, 1414 bp, Heterodera glycines
  misc_feature (67)..(67): n is a, c, g, or t
gatttgatatttcgtcttttttgaccctagatttatgatcaacgttaataaatttgagatatgcttnaaaaattaggttacaagaaagagggacgaggtgccgccgattagcgcgccagggaaaatttttttttgaaaaacacctacattttttgttgataaaattttttcgtaatttgcctaataaaaagaaatgtgctcttcacaaatactgctgctgttcccccaccagtgtttttgcttttattagcatttttcgcttaaatccatcccctcccccctctcccgtcatctgtcagcaattgtgagaccaatacccactaaagcatttattgtaataattccaaatcatcgcatttacccttctcatttggcttattgggaggggctgtgggagatgagaataaaaaatgaaaatgatgatgattatgagaagaggaggatgacggaagggggggggggcaaaaatcgtttcaattttccattaatttaactcataaatcctaaaaattgtcaattttgcgaacgaacatttgaaattaattcaaaaaacaattttataagaaagaattcaaaagaatattttaaaaagttccgattgatgcaaatcgcgatcaatttggttcattgattttaacataattattttttaataaaattgtcatatttcatgggtttatgccaaaccctttaaaaaatggcaaatttcgctgattccaagaaatttatttgttaaatattcattccaattcattgaatttccccttaccatttggcttacaaattagtgggggggggggaggaagtgaataaaaattaaaatgatgagcgatgtgtaaaataagtggaggatgacggatgggggaggggggaggtggacaaaaatcctttgaattttctcgtaatttaactccaaaatacgaaaaatttatcaattttggagaatattttattagaataagtggcaaagaatagataaaaaattttccgactgatacaaatcgcgctcaatttcgtccattgtagcaaatatattcacattgaatgtataaaagaatataaattttcataccgtcagaaattacaaggtaaaaaaacaactatcgagacatatttgcgacaattagaggctaataataaaaaatgattaggatgcaaaggcacatcttttttttgtgtttttcaataaaattttatttttcaaacagttttaacaaggtaaaagggatcaaattaagaatgtgtcttcatactttttcatgcttttgagaaaatggataagaaattagctcccaaatttgagtgaaaataataaataggcaaaaaatccagtttattatatacccttgaaataaaaaaaacattttttcctatttctgtgacttacaatttgcctatttttgtggctacatat

SEQ ID NO: 34305 - DNA, 1271 bp, Heterodera glycines
tttattttttttgtgttatttgataagttcagcatttttatgcattaaattaattaacggtgtcttttcttcgtcctctgttttttaaaagctctttttaagcatttttattccttaatttaatttttaatacataatataacccctaatattacttaagattgattgatgattgatcgcttaatatattttcaataaactcactttcattttcatttatcattcattatacatatatctctcctccctttttccttatcatttaatgcctaattaattgtaatttaaattctttaaaattttgtgtctttaattctccggataaaatttcgtgaatcttttttcaattttaatttttccatttattacgtcccattctcataaattgccatttccatttccatgccaaagagttataaacttttattcctttttttttgactttctttcgtcaataaaaatcacacattttgtggttctgtgctgaaaatgcattggcaaaagaacggcgaaatgagtcgccgcgtttaagcgaatcgataaaatgcacagaaaatgagcaaaaaaaaaagcattttgcttcataaatttaaaatagacaaaaattattttgtttatacagttaatttatttagctaaatatatttttaattaattaattttttcgacttaaaatggccattcaaatgttcagcagctgcagcttaatcacttttgccattcttcttttttctatgttgattgaggcaagattcttggacaaacgaagtgagaagccgctaaaatttgcataattaggcccaatttggtattggtggttttatttttttgacagattttaagaggtatcttaacagctgattttgtttgacacttaattagcgcattaattaattgcttgggtgggaaggaatttccggttttttagcctctaatttccccatttttttggtttacattttaaaacaaaaataaattaaattttattttagtccaagtaaatcaaatgcattaattacctcctgtattaatttttaaatattctctgaggtgccaacattcgcttcgtcgttttggcattatttccctcttcttcagccgataattgcttttacggcatgcgccatcgcaacatcccttcgggtggccttgtcgcgaaaatgaccaagtggaacacgttcaacatgaagaagggcgaccggatgaatgagcacgactgtcgcgggtcgtttgccggctgtcagacgtattcatgcatcgatggtggcact

SEQ ID NO: 34306 - DNA, 832 bp, Heterodera glycines
tgaaattttattcaaaaattcggatatttgcttccattctcctggttgttatcgacatttcgatcgtgaagggcatttagcagtgcacgtgtttcaccaacttcccaacgaacttttctggagtgccgagatgagcaatttaaaattttaatcgaaaaaattattcataaaaaatcgttgcacttctgtgcatgtgctccattccctactcactgatcagccccgccaaacgagcaatgtccccttttccacgagcgtcttttctcgacatttgcgacatttgctcaccgctttgtcactctatccatttccttttcggctttggcgaagctttcaccgattcggccggggccgagaccaaaatgaacgcgttattgatccaattcaattccggaaaaaaagatcggacaagtcaccaataacaaatggtccaatcagtctcgaacattcacgaattggcctcgaccagtgaattgagcctctgatctatgacgagtagagatcggatacggacgggatccgtatacggatttttacggatccgtagtccgtaatccgtatttttttggccgatacggattttttacggactacggattttacggatttttaatccgtaagtccgtatcgatgttaagagtccgtaatcctgatccgtataaattatgacaattttaaaaaatccgtatacggatccgtatttttcctggatacggatttttacggaatacggattttccggatttcttgtccgtaaatccgtaatccgtatgtgtatctagtccgtaatcctgatcctgatacgtattttctcaaaatgccgatctctaat

SEQ ID NO: 34307 - DNA, 1226 bp, Heterodera glycines
caatcggcataatataacatccccgcttggggtcgtggctcacactacaaagttggcaataggtctctccgcattcatgttccttcttcgggttaaataaatatgtcttgtcacaaattacacagcgcttccataagttgcaagtctgatgtccctgatgataattatagcattcccaattgtaaaagtaacgtcgacacttcgtgcattcaatcttcactccactctccttttcacatggcattcctcccactctattgcaataataacatctcgcccggcaatcgaaagcatgcttaacatccttgtcgtaaaaacattcgcaatcaatgcagaatttcctccctcgattaaaaaagcagacgaaattcttcagaccatcccaatggccattctccaagaataacggcacgacattttcacgccccataggacctttccacaaaacacgtatcgatttcctcggatccgcagatttttcaaacgccacaacccggtactttccggggtaaatctcatcctgaaaaatttattaattttgcattttttcatttaaacccacccaatatttctgaacattcggcaattgctccacaccatagctatattcgttaatatcaattccacaattatgtaaaagttcaatagctgaatccctctgtctcacaatatttttcataaatcgattaaaaatgtttcgatgctcttccaaataaagctttgacgccaccaatgcataaaacaaacaaaatttatccgcatttgtaatccttaataaaattattattatttccatttattttttctttattatttaatttattttttaaatttttttttctgttttttttgctgctttgcttaattaaaaataattatttcttttttttctttactttaattattatttaatttttttttgattttttaaattttattttttatttatttaatattttttaatatatatttttttgatttttaaaatttaatttttatttattttggctcattaaattgttattttttaatatttttaatttatttttaggttttttgttgctttttttcattttttctttaaagaatttttgcttcattaataaatttaatgtatttattttaaatttatttattgttttttttattttaagttttttttctattttaatttattttattaaaaacacttaccctatccgctggtgttccttgaatccaaagtc

SEQ ID NO: 34308 - DNA, 1003 bp, Heterodera glycines
ttttttcttatcaaaaagggagaataaataaaatttttaaaaatttttaattcctttttaagcaggccaaaaagtttaggcttatctttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttaggggcagtccccccgaaccgatgcgcccagatttatggggagaccgaatccttcgggaatagcttccctataacctgtactttaattctgcgttggatttttgctcccacataattgtttgagtaccctcaaacggacacttgaaaaaatcgatttttttgttttcggggcagtccccccgaaccgatgcgcccagatttatggggagaccgaatccttcgggaatagcttccctatagcctgtactttaattcagcgttggatttttgctccccaataattgtttga

SEQ ID NO: 34309 - DNA, 930 bp, Heterodera glycines
ttttctatacaaaggccgggcattttttcagtttggacccgcaaaagttagaaaatctacagaaattgcttctttttctttttttttgatgaaaccttgagaatgtgtttggaatagcctccgttgtcgtccttgcgaagctggtgcacaagcgaaagtcgccttaaaaaacggagggtaaaaattgaaaaaaaaattaatttttcacaattttaattttgttttcgctcaaatggcaattttgttgaaaaaacccaataaaattggcattcctttgggtttcctggaccataacatttcataagtttcaatgaacaaaataattttgactatcatttgaataaaaaattaagcgaaaaaaaatgaaaaatttgtcggcatttttttcaaattgcagaaaaatttgagatatttttctctttacagactctgtcttttgacaaatgaatttacaacagtccaaaaaaaaaccaggaaattgtattggatctgatgttcttacatacaattagctaaaatcgcatggactcgcaaaattttgatgggacacttaaaagtccataggacgcgtttctgtgaccctaatttttggccggaccgttcctttttcgcgttccttattgaaattttcttgggtagaaaaaagcgcgcaaatttttaacattcaattagtgcctcaaaacattctccatggaatgcacccaaattcgtggacatccgtcacaattttgggcccttcttttttcgtctgtcccttttgcttctttcttttcccgttgcttttctcgtcactgctgctgctgatcggctccggcggaatgtccaaataggaggcgcacaaaacgatggaaccgacgtcgacgcactgaaatttcaaaaaataaactattcggcaaatatcggagcgcctgagaatgggggggggggggg

SEQ ID NO: 34310 - DNA, 1004 bp, Heterodera glycines
tttgcgaccgctaatcacattgatatctcgatcaattctgtaccctgactaaaactttttagtgctattttcaatgggaaaattctcggagaatatctaaattttgtttgatttgaacttaagtttatgttttgcaaagttttggtgttctgattaattaataaaaaataagctaatttgcgtttggagcccaaaattgaatctctgtgtgctgttaataatccgctcctgctctgattatttacaaatttggtgatatttgtcattttctcaaattttcaatgagcggttacgtcggcatcaaattttgccccgaatggtattggttttgcttaaattccattaaccattcccaccaaaagcaataacatgctttacccgcgtgaagacaaacaaaatcggcagcttatgtacgtttgtcggaattgtgagcacagcgaaccggcggacaatccgtgcatttatgtgaacaaactgactcacgaagtcgagtgcgttttgtagtcaaattgcaatgaattattttaattgatcacccttaatgagttaagtgagctgacacaaattgtggcagatgttattcacgacccgactctgcccaagacggaggagcacccgtgccccaaatgcaaaaacgccgagtcggtgttcttccaggcgcagtcgcggcgagcggaggtttgaacctattttgactgaccatttaataccctttcatattataattagcaatttgacatggcatttgtttaatcagctggtcagatttttttctggttaatgcctaacgcgcaccgccgggtcccaatttcttatagccgaagtttgtctcaaaatggccaaaatttggcgaaaatagcagaaatattttgcaaaaatttctaatccgatttccgacataagaattcttccgaattccatcttttcctttcctaatttgttttctctttctttccccacccattctgagggagttgacagtgagatgcctattttttaaattc

SEQ ID NO: 34311 - DNA, 1039 bp, Heterodera glycines
atttgaagtcttgaatttatttgacaaatccaagacttataaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccatacgttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaaatatggaaacaaaattggagaaattcgaataattttttgactgccaattttttttccttttttgaattggggtcaaaa

SEQ ID NO: 34312 - DNA, 984 bp, Heterodera glycines
aagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaataaagttaaataaggctctctgatgctttttctatcaaaagggagatgaataacatctttttaaaatattttccttatattttggttatttcgttctactttcggtggggtgcttggaaaattggaatcatgcgtacccgtccgatctgacaagttaagcaacgctggctgactagtcaaaaggatgggggccgtgatgaaacgaaaccagcactgcttaccccgcggcacccggcacggacccccgaaggaatggaattaattaaattctctccttcggggattttttttccattaggtcgaccgttagctttcgattggtctagtcaaatttttttatttaaaaaaaaaatttgttttttgaaggcactctgatgctttttctatcaaaagggagatgaataaaatttttaaaaatttttaattcctttttaaacaggccaaaaagtttaggcgtatattttaaaagtttcatcgaacctagcgcactaaaatcgatataatctctccaaattttgcaggccttctccattgtaaaggtactaacttaacctgaaaaaatgccaacgctcgttgtttttaaaatttttcgaaattctgactttttcattaattatttattattttgcaaaattaattcataaatattttttagaacgtgctctgaaacgcaccaaatgttaattaaaagataaatcagcctctaagacgcagggtctgtcaaaggggataagaataaatataataaaaggtgtaatagttaggtg

SEQ ID NO: 34313 - DNA, 1425 bp, Heterodera glycines
attttcaaggaaaaatctgaaaaaattgctcaaaattttgtgccgactcagtatcaagaaaatcggaagaaaaaaatccgttcaactccctttgtgttccatccaaatcccatccttacgttacaacatcctactgtatcttcacatcccctactgtcctttttatatatatcaaaaacgtgtggcttctttttatactgttcaaatttctttttgtcgttgtcctttccgcccaacaatggaagtgatttgaccatctttcctaattgcttccatttttgcttggttgatgatgctgcagatgagcttgcttcttcgcttgaacttttttcttaaataacactttcgattttattgttcattttttgaaattataaaaatttttctcaaccaaaattcattttgttttatgttaaattattattatttatttattttttattatacaccaataatactaaattctttatgcaattttcagtgaaaaattcaaattcataatttttttccttctatattttcaatttttttgtccacttcttaatatctgtgtggaagatatggtgggtaaaaaaaaaattcggctagacgagagcttggaagtataaaaaatagcaaaaaaaaaaaaaaattaaattaaattaatcaattaattggacttataattttgggattagcgaaattattttattttttttatttaaaaaataaataaaactgaccagcaaaatattctcttgaaatgcgatatgtttcttcattaaaatatttattgctcttaatttcagctttttcttctgcattgttgatgtagatagttttttgatcaaagctaaccttaaaagcactgacattcaatttatttatttttgggtattttatttattttaccttgaattcgttcatgaattcctccttggtttttaactttttgctaaatctcaggcaatcatttgtttcaactttggcataaattttcttaatactcgaatttttggcatcaagtgtattttgggcaagcgaatacaacttttgagttaactaaatttttttaaaattaaattaagtcttgaataaataggactgtcattttttgaccaaaaaatttttttgaaaaatgcttgactaataataagctaaaaaaacaaccaaaaaaaaatgccattaaataaataggaaaattaaacattttctgtcggcacttttcattttttggcattcggtaaggttttggcgctgcttacccatgctttgtcagtgtaaaatccaatataaacagctcgtttgcaattttttatcgaattaaaagtttccttgcctactggagcctcaaattgaccatttttatccgtgaaaatgtcatcgatcatcaatttttctccacaaaaaatattaatcatctacaaaaaaacaaaaataaaaacc

SEQ ID NO: 34314 - DNA, 1001 bp, Heterodera glycines
aaaattttcaaaaacaccacccccctgatgagaaaggaaaaatttctcaaaaattcatctttcaaaattatttatttattttcttgttagaatttttgatatatctcattaatcatttggcataatatctttgctttttgaaggaaattttcaattttacacccctaattttggaactttttggcacctattttcccatttttagcacctattttgggggtttttagaacctaaaacctacctattttggcagtttttagcacctaaaaatatcatccctacttataatagaggaggacacctaaagctatcgctcaagatctttaatttgacaaagtttaagctaagttatgatttattattcagcaaataaaattaaaatattaattaatttaattattattatcattgatacttttttaggctcgacctaacaccgacccttttacaaaaatttccttgccgaaaatcgtatgagctttatctcaaaaggcttgaaatgtactcaatttgcaactgcaacagttaattttttgaggtcatttttttcgcattttatttcaattagaagtagagttcggaccccgcccccgtcacccccgtccccgcccccgcgactctgacccccgcaatgaatttttaaccatctttgacaaattttttatgaaataaagtaaattttgctgttaacttccaatatatttgtggtttagtggttagtgcttcaacactaaccgtatttcttgttaggagttcgataccggttgacgttttcatttgaatttatttttatctgattaatgcagggtttctttatgttcttatttctaagaaatgttctgattttagggcgtattttcatccaaaagaatgaaatttctgaaaaattttgctaatttctaacaaaattcataaaaaaaaattcccccggcggcgcctatcggcaccaccggcccccaaaaagcgtattttttcttaaaaaaattagcataaatcaataa

SEQ ID NO: 34315 - DNA, 455 bp, Heterodera glycines
ccccccccccaggggtcagagcccatttccattacggatcgaccattttttgcctgctgaagacttttttttgctctccgggccaaaaaaattttaaaaacagaaatttttaaagaaaaaaattttctgtttgaaaatttcttacaaatttattcccggctgtgttatgtctcggttatgtttcggcccggctgtgtttcaacggctgtgtttgtcctgttccggtttctggatttccgcttgggtggcggggttcacacccgggagcaggacaaaacgtcgtcgccggacaaaacgtagggggtctggcggtgccgataggcgccgccgggaagtttttttgtgtttttaatgcgatttattaacgaattttgtccaaaaaattaccaattttatgcttttaagcaaaattatagacgaaagggaaaaagttgatttaaggcgatcgtaaagat

SEQ ID NO: 34316 - DNA, 896 bp, Heterodera glycines
  misc_feature (774)..(774): n is a, c, g, or t
  misc_feature (782)..(782): n is a, c, g, or t
  misc_feature (797)..(797): n is a, c, g, or t
  misc_feature (814)..(814): n is a, c, g, or t
aaatggtttttttttatatttattattggtgttctctatgaaaaatcatatatctttttatttacatatacctataattgttttgaataattatatttatttaattggattacagattcaaattttgtttttttttattataccaatgtcaaatttattatcattttaaatatctatttgatttttatttggataggtaaaattatttattttttatataaattttgtttatattttacaactaaatttttaattcttaatatctttctatagccctaagagttctctattagcctataaaatttcaaaaactcgtcaagtttaaacaaagttatggccaaaagtacacatgaaaccggcttttcaatttttggccatacttttttgaacttaacgaataacatgaatttttgtgacagccttcaaataaatatcatcatatcgctttggataaataatttaattttataaaaaatttataaatttgttggataaaatcttaattactttattaaattataaacaattttctgttctattttaaaacgtccttattgttagcatattttatggagaatgccaaagaaagtttgtgttgccaattttagttattaatattatttcacaccttcatatttaaaatgcaatataatttttattaaactgataccaaaatataatttttttcttctacataattctttcctttctattatttgtagagtgcagcgggaccgggaattttgggcaaaaccgggacttggaactaagggnaaagccangagactagccactangccatttgcacacttgntatgttacttttaaagaatattttttttttttcctttgactctaatttcatcactaatttttcgctcagacccccattctta

SEQ ID NO: 34317 - DNA, 542 bp, Heterodera glycines
atataagtattattccgcaaaacgataaatcaaactagaccttttgaaaaatttataacaaatccacaaatagcccaattcactcaaaactcttgggacaaccaaatgtctatatatattcattcattattggtttattgtatttttttatagtaatagattttcaattaaaattgttttaaatttttattgtggaaagtataattaaactatgaatttttcttttccccaaatggattacattaaataaattgttttattatttaattgaaaaaaattatatgaaaaaaatttatttatagatttaaaaatatttggtttggatgttgtaaaatgtttggtttgtgcacacatttcgcattttgtcatatagcggacggctcgaattattactagagaccgactaaaaaggcaccaaaaatctcgaaaaaggcactataaaaggcatgaaaaattgaaaaaaaggcatgaaaaggcacgaaaatcccgaaaaaggcatgaaaaaaggcatttaaattttttttattaaggatttttaggga

SEQ ID NO: 34318 - DNA, 188 bp, Heterodera glycines
caccccaaccgaccgatggtcgacggatcatttcaatcgccggaacagtgaaatgcctttgaagggaaatgaattatcaaaacaaaaataaaattattgtaacaattgtgagaaatgaattactttttcctcctaattaccttcgttaatttcctttaataagtgaaattatttaaaattttggcaaa

SEQ ID NO: 34319 - DNA, 941 bp, Heterodera glycines
  misc_feature (830)..(830): n is a, c, g, or t
  misc_feature (864)..(864): n is a, c, g, or t
  misc_feature (907)..(907): n is a, c, g, or t
  misc_feature (913)..(913): n is a, c, g, or t
  misc_feature (932)..(932): n is a, c, g, or t
ctttcaatttgaaaaacgaaatttaaatttaattttttccttccaaattagcatattaattaacaaattaataaaataatacatcatcatatgttttgttctgctttgatagaaaaggttttgctcttgctgcttgtgtttctgcaatgctgcttcaccaacagttatggcagtatggcaattaaaaaatttttatttttaattatctaacaaaccctacggtggcccgagattgtgaattcaattttttgtacagtatccatgttttaaaattcaaaaacaaatcgcaacaagtcatttttagacatggttattccacacgttttggacttggtgtatttcgtgaagacaaaagtttttttaaattaggcctctctctattcggggttttcgcccctaaaaattttcactcctattaattacaagcaaaataatttgaaaaaaattcatgcaccgcgtacattcttccggaatttctcgttttcatattgttcattttttccaagaatatgattgttttgtgaccattcgtcaccgtagtggcacaccgccggacgaaatggtgcaatatgtcaagggaaatgctcaactgaatgccgacattgtgaacagtgattcgtcaaaaaattgtccacttggagaaccgactttttgggaaaagaattttctgggcaagaaaaaatcatttaaaggatgccataattttcggtgtttggatggtaagtttgggcttaataggtgcaaaattttggcaaataaattaaattaataaaatgtgtgaataagaaaaaaaaataatttgctcaaaatcatagggacatttttccganattcaagcaaaaataaatttaaaaaattgatttnaaaaattattaaaattgataagagcgacgagaaaggcaattgngcgccngccccagtttttggcgttnaaaaatttt

SEQ ID NO: 34320 - DNA, 91 bp, Heterodera glycines
cggtggtgctgctcaagcgtaaagacttcatgctgtactgcttcgatccgcatcatgcgcgggtgattggcctgccggtcaagctgctgca

SEQ ID NO: 34321 - DNA, 1094 bp, Heterodera glycines
  misc_feature (32)..(33): n is a, c, g, or t
  misc_feature (64)..(64): n is a, c, g, or t
ttttgagcgagtaatatatgtacatactattnntttaaatttttcattttacagcctccgcggngtgtggtgatggctggtgatgctgtggtggtccctgacgtaactgcggaggcatttaaggcgatgttggcatttatttattcggatgatttgagtggactgaacggagacaatttgtttgacgtgctttacgcgggtcggaattataaaaaaaaaaaaaattttggaaaattctgcggatgcctcctttccccctccgcgatttgtagaaaaaattcctgactttaaaaggttgtaaaacatttttcgaaggatttcatggcgtagaactcaattctgtcattatttcgacatattaagaactccggagtcgaaaataatacaatttttcgattttttcggattgttcaaaaattgaaacaaagcaaaaatagttgcaaattcattaaaattatcaaaaaacaatttttccatacagattggagcatatgtagttgaaattttcgggaagttgtttgaattttttgacttttttgttcgaattcggatctgggatccggaatataaacggatgtcgggggaaccctcgacagcattaaaccttctcaaaattcaattaattaattaattcatgtaattattgtaattttgttttaagccaagaagtaccaaatcaatttgctggtcgatgcctgtgccgattttcccgtttctaatgtccaaaacattttcacagcatttgtaagagcacgcttttttggagaagaggtgaagccggggggttgttgcacttttgtattggaaattttcgggtgcactaagtttgagttatgaattttttactgaaaaaattagttttttataagaaaatttcaaaaaaatttttttggttgtcttgaaaatttcgagctttaccactttttgggattttaaatttgtcagagagaaaacggatctgcttgctactcattcccgaatcccccccccccccccctgaggttacgggggcggggggggggggggaggataagaccaagggtttatcattttttaaatcctaatatttatgaattttgcctaattaactatcc

SEQ ID NO: 34322 - DNA, 1621 bp, Heterodera glycines
  misc_feature (968)..(968): n is a, c, g, or t
ttgcactcattccaatgccctttcatttcaattattacatttccatttttaatttgttatcattatccttttttcagttaaatctttgccattgcgctgctccgaagaaatgaacggatcgcccacaaatttctcgaaaaatgagaaaggctttgagccgatggcggaagtgcagctgctgaaggacgacgatcaattggtggtggaggagcgatgttctgcgttgtggaatgagatcaaggacgccggggtgttggacggggccgaattatcggcgagttttgacgaatcgatcggttgattgattgatttattaatgtggggatgttgcgcgagagaaagacgcggagagagagggcgatgaatctgatcagcaaatctgaaaagggcgagggaagggagtaaatatttatcggatcagcgggggaccggacgggcagcaaaaagtgcggaagcaagaaggaaccgatcaatgcaaaaggggattaagcggctaacggcggataaattatctgtcgataaatgagaaatgacattgctaaaacacattcctaaaatatttgctgattttctaattcctttcagaatgcttttttggctcagctccaatcggaaagtgaccaattggacgaacaggttcagaagctcgcgcaaaagtcggagacattggcagcgaatgcacagctcagactttgttcggtttggacagcgttggaggagctgaagcggaagaagcagcgaattgcgggggaaatggggggttagtggggggggggtgatcagcaggaacaggcgggctgataagaaatgggaggaaagggaacaaatgattagtggaagagataatgataatgatcaaagagaaaggggcaatgagaaagtgatcggataaagtcaaatcatcagagagaatgggagagagagagaagagagaaataatattcaatggtcagagaggaaagggcaangagagagtgatcagaaaaagtcaaatgatcaaggagagtgagggaataattaaacagggaaggataaagaaagagagagagataaaggtaatgatcagagaggaagaggcgatgatagagtaatcagatgagcagaaagaatgggagagagagagagagaatctcatggaggaaaggacaataagagagataatgataatgatcagagaggaaagtgcaactagagagtggttagaaaaagtcaaataatcaaggagagtgagagaataatcgtagagaaacggataataacatagataaagacgatgatcagaatgtacaatgagatcgataatgataatgatcagagagaaagaaggaagagaaaataatcaaaaaaatttaaattagagagaatgggggagtgattcgtcttccgttcaatttggcactgatttgttttcccatcgccacagattttcaccaccaccgaccacagattggcgctctccgcctcatcaacagtttccggaaatggctgaaacagaaggaggcgcaacagagtcaggtcaagcagcgcattgcccactcccacgacagtgagtcgtcattgcgcgagttggagcaggaacaacaagagcggaacatcattcagcggagtttgggggcacgga

SEQ ID NO: 34323 - DNA, 719 bp, Heterodera glycines
cgggcacagcgaatcagtgcaaatgccatgccaattggcactgcttggcttccccgcccccgcctctctccgcgccactcgtccatttctttccaattaattgtccctcatttctttgtccatttcagcttcgtttactccattcgttaccttttcccaatgctttcgtcccatcatcgcgaatcacttctcctccaatacggtcattcgcaagtgctttactcggacgaattctgcaaattgaccgacgaaattctgatcatcaaaaagttcttttttggcactctccggccaaaggttgtgctgctgaaggacattcgcgtggtgtacttcgacgagcaaaagaatcagcagaagaaatacgcacatcgccgtgtgtgggggcgggcgccgaattcgctttattgggctgccgacttcaaacggtaaaaggggcgaagggcggttcaattaaggcaaaaaagttgctaattgattcgacatatcattgactaatgggttgctttttattggcaggtgtttgcctggcgttgacaagtgcaaccgcagtgacgtcatcatcgacatggaagacggactgctcaaagggttcaccgtggccgatgcccagtcatttctgagcgtaattcgccttttcgcgccgatgtcgacgataattgtggacaatttggacattgcttaaggcacttttcgcctttaatttcggccattagtagtta

SEQ ID NO: 34324 - DNA, 981 bp, Heterodera glycines
  misc_feature (968)..(969): n is a, c, g, or t
gaattcgatgtcagattggagatcagcgtcctctaataccctcggataacaaattttcatggatttttatctcaaaaaaattttgcaaaacaaaagggtccccccttttgtttttgatagaattcaaaaggttactctttgcaaatagcggccccggttttgatcccaacttatataattaatttttctgaatcttgagtagcattttttatttattcactatgattggtcaaattcttcgatggaaatcacaaaggataatgatatgtaagcatttaaaggctttaacttgaaaatcccaaatttagtggaacatataatccgggacaactttcatgattacgacgttccgtccctgccgaccaatgcagttcgcccacatgtttgtgtgaattgataaattacttttagaaattaagaacttcaccctcatttagcaaaggaaacagttcacagatttgccatttgatcagcaggagaaggctttgttcgaagattttctgtccgtttgtcgcgtgggtccatttgccattggcaaaacaatcgtttaatttttgtttctttttagggcatcaatgggccattcattcaatgcgaacaattagacaataacgaaatcatttgggtatggacggcggagaattggaaacagaggacggataatcagaacattgagcggtggatgaacgtctgtttcagcatgggcaccactctttttgacttgcttttgtgcatcggacgtacgcctttttccgggggggggggacgtttatttgggtacttttttgggcttacacctcaaaatttaaaaaagtttcacattcaataatttaaacgcaaaaccgaaatggagaggtcctttatcgctactttaatttatgctatgtgaatggtacgcaattgtcccttaagcgtgccctttttgacattttttaaaattttgaggtgtaggccctaaaacggaaaannatacccattaat

SEQ ID NO: 34325 - DNA, 1283 bp, Heterodera glycines
atataattactctcctttctaattaatttaattggtttcttttatttaaaaaagagaatatattcttcttcgggttttattgtcataaatgaattaatgcatcatataataataaaaaacggataaagctatcttcatgattcacaatttaattttcaaaaatcgttaccgtaatctgtgcctaataaatttcaacaaaaaatgaattgtatgttaaatttcaaagctttcatattgtgttttacgctaatgaggcaacaatcggattacggtctgatgaaatgaaatacagtatcagactgaaagaggaaacaataaataatagcgaatgggttcaatttttgttgcctctgttttggcgttccgtcagcacttccgccgtttcactttccgccgtaggcatggcgaacagtacgccctggtactgtaccccattaatttccatcgacaccaccatggacgagggatcgttgcccgaaaaagtggctgttgtcgccggaggcaaattgccagcggacgaattgccatcagtggcattttttgattctaaaagaccgcggggataataacccgaaaccgaattaaatttgagaaatttatgattgggttcgaaaacaattttgaaggaaatgccctcggcgaatttttcaaaattaacaaaattcggtaattaatttgggaatttaaaatttttaatttccaaaatcattttttggaaaacagccatttcgtttcgtccaccttcgccgttgttcactttgatgttgaaacgcaacgcattttttagcaaatcgccaaacgggccgaggggtgacgcaacggaagtaccatcgccgcaggcgatggcattgtttttcggcacatttatcgacggggcacggccaacggatgatgaatgaggcccttggtcgctcacatttcgcattttctcagatgaaaaattatccgatcagcaattttctttgttacagtatcccttccttattggcactttttgccaattttccctccagaaattcgaattttggtcatgagcgccgcgtccggcggcagatagtgtatgaggcgggttgaggggggaggtggcataagtcgagagaggaagttgagggcgatgaaggtgcgggccggaggaggaggagtcgacactcttcctgattagaacatcgattcagtaattaagatggaggagagagtgcggtggcgtggggcttggggcagtggcaagttcaattgcgaaaagggaaaagcggaaaatgtgaagggacatttggatcaaatgg

SEQ ID NO: 34326 - DNA, 825 bp, Heterodera glycines
  misc_feature (789)..(789): n is a, c, g, or t
cttcatctcctattcatcgcttttccgcttcaacttatactttgcgtgttgacaaagtttgtgcacaatgatttacaatgtaccaaaagttatgaacaagtttgtttttccttttaagttgctctttttttcatcctgttttgttgtgttactactgtttcttctgccgatttcgactttcgagtatgtagggagttttaaacgggtgtatttcatttccatttcccctcgcatattcgcagaaatttattggcaatttcttctaatatttcttataaaaaaattttttaattttttttttaaattctatgttagtaaattttaaaaaattctcaaggggaaacgatgcggggggaggggggggggaatgagctgccccctttttaaaacttaacaataaaaatttcttttctttgctcaagaaattgctttggaaaacaaagtcaaggcgtatctatatggagtgaatttatcctttgtgtatgcacttggcggattgactgtcgcactcacgacaattatcattggaattttctgcggcctttacaatttcgaccattacaaggttgctcccctaacccttgaggagcaaaatgtcgggaagtgggcaatagtcaagaattggtgtcccgacaaaaaaatgttaaaaatttttcatgtattttttctatgctaaaaaatgcgctgatcacgaatctgaactactcagattttaaaaatcattgatttttgtccatgacttttcatcaactacttgatttttttattttttaaattattattaaaaanagtaatgaatttggtgttaaaaaatacactggtgac

SEQ ID NO: 34327 - DNA, 922 bp, Heterodera glycines
taattctgcgttggatttttgctccccataattgttttcttccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacgaacacttgaaaaaatcgattttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaatcgatttttttgttttcgggcagtccccccgaacgatg

SEQ ID NO: 34328 - DNA, 1614 bp, Heterodera glycines
  misc_feature (86)..(86): n is a, c, g, or t
  misc_feature (101)..(101): n is a, c, g, or t
  misc_feature (118)..(118): n is a, c, g, or t
  misc_feature (1593)..(1593): n is a, c, g, or t
ccatttatagaaaaacacattaaaaataaattaattttataaaaaaataaaaattaattaattaaaaagtcgtcatgacatgacanaaacatggatgcatncagacgaaacgaaggcncaacgtttcaaaggcaacggacgactttttgtgacacctgaaaaaatggagaaaatatttttcgaaatgtgtgaacgcttttggtccagcgaaaattatcatgagcaaaaagcaaattgcttggattttgttttcaattttgtgaacacattgtgcgagggaaacgcaccaaaaaagacggtaaatttgcgcaaagggacggacatttggacaacgggaacggacatttcatcaacagggacagcatgtcaatgcaaataaccgagaaaagattagacttggctaatgacgagttgtacggggaaaactttgaaaatttggagataaattctaaggagaaacaaaaaatatttgagaaaaattcaaaaatttctgagatatttgagatatgagtggcccacataattttcaaaatttgagtccaaatttttcattacaacattttgttcttttaagttatggcctgataattttattgaatttgataaatttatgtccagaaaatatgaaagaagcagctttaatttatttgatcccacatttcctcaatcggcgctcgataggaaacccattaaattgccaggtaatttttttcttttttggttaaatatttgaattttaaataaaacgatatatttacgactagtgatggacaatacgccgccgtggaagttttttaaattttatttaaaatttggacagatttttcattacaacttgggcttagggtcggtttttggctaattattaaaaaaaagaaattgtaatacgtggggcccggcggtgccgcctcagaaattttaatcttttatgtgcgatttcaaaccacaaactgaaaaattgatcaggctacgagccttatatattacatcatttattattgtcatttattatttaaaattaaagttataattgatacaaattgtcttttaaaataccacaaattggaaattttaatcaaaaatacgaattgcaattcaaacaaaaatgaagataataaagaagaaaacgaagttgctaactgttcaaattttgttttgctgcacacaactggccattttgataagccaataaaagaggaagaggattttgaaaatccaattttaattcacactttgccagaaaaaacggtgcaaaacggcaaaaacattgccatacaattcattctaaaggcatacacatgcaaaatgaaaagcagcaaaaacggtcaaacaagaacattggtcactgagttaaggctgatggacgaaacggtcagtcgaatacagtacattctttagttactgtaagaatcacaaatatcgaaaactgatctatttaagcttagaaatagaaaaatagtggcgatggcatggcaaaaacttacagtaggaaaagaccaaaatttttttatcgctgggcactcacaacctcaagaaaacaaacagaaaataaacattgttttccgacaacaaaattcctattcattgccaaanagtataattttttatattaaa

SEQ ID NO: 34329 - DNA, 896 bp, Heterodera glycines
tttcccgcgttaattaattaattgcctttttgtcttttctcccccagaccaaaaaatggacatccgcgtcttcgcctgtgctctacaacagcttcatacgatccaccaaagcttctggcttcggcatttaattatttcaatagaaaattgaataactggacttataatttgggacggagcataagatcggcttttttgatacaaatcggaaaaagttcagaccgtagtcggtctcaatttgtaaatacaattgtatttatgtataatttatgttccgggataacaaactgcaaagatgtcactgacatacatatgtaaataaatacacagcgttttcttcattgattatttgccaattgaccgaatttaaaacaatcaaagaacaatcaatgcctgcccagggggcgggggtggggggggggaagaaaatcggctttttaaaaaaggcggaaccttccgcgaaatctttaagcaattgccagaaattattttgtttggcggagagggcacagtgtttttgttcgcattatacacgttttaaatcgataataaataagacaaacagaagagatcgctaaatgaaaaggcaaaaaacgaatgaatgaaaatggcacggagcaaaagccaaaggcgaaagggacgccattcatttgtcagggcgtgtagaagtgatttccggtgacaaaccgtggcatcggtgcttcacctgaacaattacacacattattaagcaaatttggcactttgatttggcctaatttgtcaatttgcgcccaaattgttggcacaaatcgttgccccggcaaaacttacaattcgcatcactgcccacaaatcgcgcatttctcagcacggaaatgaaatcgccgttggagtggacaaaggcgtagtcgccg

SEQ ID NO: 34330 - DNA, 940 bp, Heterodera glycines
ggccgatgaaaattttgaaaattaattgttatttggtcactaaaaatggacaattttatagattattgggtctaaattcacagatttaaggaacaaatggaaaaatgcaattctaggctttttaattgttgttaaaaacgaccttaatttttgtcatcatattttattttaaaccagtatactttcggaaaatgttcaattcagttgttgtttcgagttcgtattctgacaaatttggcgggtatttattgtctgtttttaaaacaattttctctttggaaaaaaataatagatttgcgtagtaaagtctattatgctgttaagcacagccggaaatttatttggggttttgagttagatttacctatagatttacatttatctcaaatttaaaaaattttaacagtagtttgtccccttttctgggtggtataaaaaattttaaagttattaattaaatgtttacacacagaaacgacggagaaaaaaaggcccatgtcgacattccgcgggataattccaatcgagttgatgcgaagaaattggatggtctctttaaattattttaatacccttaaagcaatctaattcagaacagcgtacagaacatttcgctaaactcactgatgatctccgtccaaaaattaagggaaagttttgggcataaactgaatggaaaatagggcaagcgcgagtcggatgatttcttaaaatgatgattctgattcattcttattagcttttatattgattttgaaaatcttattaataaaaaacattaaaaaaatatttcgtgtttttatttgtaataaaagtaagagatttattaattgattggtgcgacacgaagattaaaaaaatatagtcatgtaataattcatttttgttttttaatcttatttcggccaaaaaaactttccctcacatatttcatacatat

SEQ ID NO: 34331 - DNA, 821 bp, Heterodera glycines
aaggacaaataatactcccaaacggctgcgtcacaatttgatgttgaagccgatgaaataggcattgctaaacaggacgagaagtcaaaataaacaacctccacccgccccagaactgtggtctccctcctcccaccaattgcgtctccatggagctcgtccttgtccaacaaagaatcaaaggtgggttttgcagaatgttgtctgctgttgttgttggccatgtgatttgactgttgcgactgtctgaaagttcacaattagtaaaagaaaaaaaaatttcaagggggaaaactgatgtgaggtacaccccaaaacaccgctggccgaaaattcgccgagatattaatggtaataaatttatcattagtgggtatttgcctttgtgccgtggacggctccactgaggcggtgacaatcagtttcggaatttcgccgacaatgatcgccgggatggagcacgccctgtgcaattcgccggccttttgttgctgtgaggacgacaatgagtttgagaaagtgccactggttgtgatgctaggagcgcacaaattggttgtgcttgtcgaagaggacggactgttgtgaagggatttgccaccggcggacgacgaaacggaggagacggaggagatgtgcacagcggaggacgaagtggtggtgcactgttgctaaatggcggaagggaaaatggtagaaaaaggaaaaattcggaaataaatggaaaattaattaaacattttgtcggtaaagtagttaaatgttcaagaaaaaactgtgctgcctcatttgtcagggacacaatcccgaaatttcttgaa

SEQ ID NO: 34332 - DNA, 1341 bp, Heterodera glycines
  misc_feature (157)..(157): n is a, c, g, or t
tccccgagattgacgtgggcccccttctccacgagaagggtgactgaaaatggtgaaaaagtgctgataagaaataatcccggacgattgattccccgatttctgtgctgcctttgtcacatgcgagcagtagcggcgtcagggaggagtcgcttcntaagttcacgttggcaccatgagcgatcagcacacggcacatctccaactggcgcatattgacagcaatccacaggggcgtaacggctgaaaatggggcgaaaaagggatgaattaggcatcagcaacaattgccccccccccccccgccttcaaaattttgaaaaataaataaaataataggagactcagaattttgaaaattttttataaaatctgatgacaagctaatgtgataaatcaggttatttctcttcctttcagtatccctgcaaagtttggtgcgcttctgatcagtttgtgaaaaaaaagttaagcctaatctttttggcctgtttaaaaaggaattaaaaatttttaaaaattttattcatctccctttttgatagaaaaagcatcagagtgcataacctaccatgtaaataaaatttggtgcgtttcagagccctttatgaaaaaatatttaagaattaattttgcaaaaaataaataaaagcgaaagactcagattttcgaaaaattttttagagcaagctagctcggcgctcatttcagtgtaagtgagtcctcagccggggagtatccctgcaaagttcggtatgcttctgctcaattagcaaaaaatatgagtgatcaagctttcactaaaaagttaagcggtaaattttttggcatatttaaaaagcaattaaaaaatttttaaaattttattcacctccgttattgatagaaaaagcatcagagagccttattaacttgtaaataaaatttggtgcgtttcagaaccctttttgaaaaaatatttatgaattaattttgcaaaaaataaataaaaacgaaagactcagattttcgaaaattttttttgagccagctagctcggcgctcatttcagtgtaagttagtcctttaccggggagtatccctgcatagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgccccccccctcccacgcccttcagagcacgacaaatatttcaacaaaaatttgaaatcatgtttcccactcccttc

SEQ ID NO: 34333 - DNA, 1014 bp, Heterodera glycines
tttgccgtcatttgttgctttcgtggtcgcccactcccgtgccggtcctgccgcctatggcatctgccaagcgggatgtgccgcggtggtcgttgcctgctacggtgcggccggggtcgttttcggcactatcactgcaggtgttggcactccgccagcgattatggcctgcaacgcagcatacggatcgtgccaggccgcctgctgggctgcgttgttcacgccgacgctgtgatttttgagagccacccaaacttgggcaatggaatgaatgctttgacgaaagtgccatttattgtgatcgattttgaattgccaaattggcaaaaaaaatttttcattttcaaatcatttttaaatgaatttccatttttgtaaatgaatttttgggccgttttcagcccacaacgttttttatttattgataaatcggcacttttaatcggtttgaatgcaatttgaccaaaaaattgtgggtgagaaatgtgcgggtgattcatttggcaaatttatttatccgacaaatgctaacagaaaatcaaatgaataatttatatttatttaattggccaattatggaaatacattttatttttgctttaaaataaatttttctgaaaaagtacttttttcttaagaaattccgtgaaaattttctgatcattcatcgccgaacctaaaattcccctagaaatttaaaaattcgacctgaatattgctaatttgatgaagagaatttatcggggacaatgtctccccgatccccgaattttctcttcccgagggtcggggcccagccctattttcttcgatgatatctgacgaaacctacagtcatggtcataagtgttgtcccatcatgctttgaaaaaaataattgcgtataaaattgtcattttccaatttcaacagataagtagcataccattggatagcattttttatgggctgtccaatgagaccatattagcatttgtgacatggacatctatctgatttattttaccatatatc

SEQ ID NO: 34334 - DNA, 808 bp, Heterodera glycines
gttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttattttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttatttctgcgttggatttttgctccccataattgtttgagtaccccaaacggacacttgaaaaaatcgatttttttgttttcggggcagtccccccgaaccgatgcgccccagattatggggagaccgaatccttccgaatagcttcctatagcctgtactttaattctgcggtggattttgctccccataattgtttgagtaccccaaaacgacacttgaaaaa

SEQ ID NO: 34335 - DNA, 1286 bp, Heterodera glycines
  misc_feature (1243)..(1243): n is a, c, g, or t
gaaatgacttagcttagattattgaccagttgattattgttgttgttattttgttatgttattaaatataccttgtggaggagtgggagcacatctaatctatagtccggtagtttgcaaatgtctttgactattcataatccctcgacacaagaccacatgagaatgagaattatcgcgatctgaaatttaacaaagatatggataactcattgagttgacattttctcctttataatagtagaaacgatcatggatatttattactacgctcttcgcttattacgcgaaaaaatcgagaaataggcattatatattgcacagaaaacacccagaaatattgcacagaacaatatagctaaataaaatctttttattaacgctattttaagtatcaaaacaaataaaaacttaatccagacacttaatctggatatatttcaattgttctaaggtatcttaaaataagggaaatttttaaacaaataaaattatcaagaactggcgaaatagacactaggggtaaatgagtccgctgatcataaatccgatctcagattttcatttctatacttttatctatgacttttcatctatttattcgggtctttcgaatttaggtttaggattagaattagagcaaaataaatattagactcggaatctacgtacccaaaaacccctagaaagacttttttgccatttttcaatttcttttttgcattttcctgaaatgttggatattatgaaaaagtgacgacagacgacaaatttacagtagattttgtcaattgtgattggacgacaattcacacgacagagacaaacgacaaacggaaaaacggcttattcaaacgacaaacgacataattttttgtcgtaacgaccaaatttgtcgtttgtcgttcgtaattgtgattggcccctgaagccgatgatttgaaaggcaatttcccctttcttttcatgttgttccctcgcccataaatatgcgtccattccctctattatgtctatggctgtgaattttagtgacgaaaaatcccaaaatagttaactaaaatagtgagtaaaaatgccaaaatagtgacaaaaagtccgaaatagtgacgaatagtgacataattttcagacaaaaattaagcaaaaataatttttattcactgattgcattgcaaatgagtaggggctgggatttttaagggcaaaaaaacaaataggtacataaaaaaataattttttnaataaaattctttgcacgaaaatactttttgagaaaatttttt

SEQ ID NO: 34336 - DNA, 714 bp, Heterodera glycines
tttccacgtaaaaatttttggacaaaatttttcaaatactaaatttttattcagttttcgcgcgagtgcctgttttttagcattagaattgttcagaagtatatgtatattgagggtgaccaagttttttttcaaattcaggataaagaacactaaaattcagatgtagacctcaaaattcagattattgcaaaacaagggatcagcggccaattttccaattttgcgaaggggtctccggccatgtaaattaatgtaaatcaatgaccttttttgctttcaacaccgcttttttcgcggcacgtttttctcaagacttttgggaacaaggagggccggcggtgccgataggcgccgccggtaaaaattttgtattttttaatgcgatttgttaacagaatttgtaaaaaaagaccaattgattaagttttgggtttttaggatgcttaacatgaaagaaaaaagttggaatattttttttaataaaaatttcaattaaaataaaaaatgtgaggaatattttatccaagtggggaattgaacccaggcgaaaaattatgaaggtagaaagtttaaccactacaccacatgttcatgcgtggaatcccatgactaaatgaaataaaatttaattttttctcatgaatttctccttcttcaccaatttgctagtcttttctcgaccagacccccattcttacgagcgcaaatttt

SEQ ID NO: 34337 - DNA, 961 bp, Heterodera glycines
  misc_feature (904)..(904): n is a, c, g, or t
agtgtccgtttgggggtactcaaacaattatgggggagcaaaaatccaacgcagaattaaagtacagactatagggaagctattcccgaaggattcggtctccccataaatctgggcgcatcggttcgggggaactgccccgaaaacaaaaaaatcgatttcttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatcaacgcagaataaagacagactatagggagctattccgnaggatcggtctcccataatctgggcgcatcggtcgggggactgccccgaaacaaaaa

SEQ ID NO: 34338 - DNA, 1233 bp, Heterodera glycines
ttgctgtatttaatttatgaaatttaaataattaactcaatattaacatttatttagttgaactcttaaaaacaaagtgttccataaagaatcaattaaataataagattaagatacaataaaaaaccgaacaggcgttgagaatataatgagcatacttatttaccgcagtgaccgatttgtaaggatattgaaatttaaaaattaaaaaaatatttaattaacaaaggtaaatttaattaataaagaaatttttacatatttagtcacataaaaagccatttaaataaatgaacgaatttaaaattaaatctatggatatcagacaataaaaagaattatattcaagaattatagtaacttattataaaacaaattaaatgaataatttaagcaaacacctaaacaaaaacttaaaagaaaatcacataaacaagtcttaataagctaatttaaaaaaatcgaagataatatttgttgtagaactcaaataaagccaaaatgaattaatgctaaaaactacaagtacaaacattttctaattcagtttattttcaaccaatagcgtataaaattcccacaatacaccccaaagaatcgactaaaaatttttcaaaaaaatatccctaagtatcgctcctaaatttaaaaaaaatacacatataaaatgaaatcaatctacaaaattttggccaataaccgaatatcagcagttcgtccccttccaacaaaattttatttgtattaagttgaatatttattcactgggccggtttggcattttacggcaaaaagagcaaaatttgtgtcttttcgaaaggtattttaataattataaaaagatttaataaaaatgaaatcatcaataaattaaataatgacattagcttatcgaataatattgtcggaatttccattccgatcgccaatcaatgatcggcgaattaagagggagggcgccccttcaccaactccccccgccgcgcgacggggtttaaccgttccatccctctgtccctcttcccttcaaattgttaattgtttttctgtgttcctcctccgccccgcgcacaaattaatcaacaattaattaaaccgcaacttttcgcccccgccccccaatttggcgaatgcgactccaaagaacgatgaacgcccaagtttcccgtttatcgccaattttgttcgttcgtttctttttagtgaactgtttatcattttatgcacaatttt

SEQ ID NO: 34339 - DNA, 936 bp, Heterodera glycines
ctcgcgctcgccgtcccggaatggcggcgctgacaatgagatggacaccagcaacgagaacggcaatgaggcgaaagtcaagaaggaagaggagaaccattcgcgcaggttcattagaacaaacgctttattattgggggggggaaactgaaaaagttcgttatttgtaaatgctttcgatgaaattggtttgttattccaaactatttttttgctatgttaagtgcgtcgccggctggctccgctgggaacgaagcgtcggatgactgattgttcagaccaatcggtgcgctgtgacggtatgttttttgctgcgaaaccatccaccccgtctctctcgttaaatggtgtacacacaaaggagtgcttaataatttaataggtttggtcttacttttcaatatttccttgagtgtacgcccttttttctgtttttgtcattttgaattttgttaaatttggatggatttcacacgtgctgtttggtctttggtcacacaattattttgctgatttcttcataaaccattgattatttgctgcattacagttgcaattttttgaggaaagccggcacattgttatccctcagaaggcatttctctcaaaaccatccattacgatatttgctgcgactaattctcttattcgataaattctctaaaccattcgtagtttttccctggtttcttaatgatgaactttgttttccatttcatgtgcagattccaaacccacgaccgtacggggagctcgggtgcacaaagagcgagcaggtgcacaatgagcacgcacattacctaatgaaaacagccagaacagacctgaaccaattcggacaagcacagcgttttgcgcgacattggtttgggttaaaagggacgaagtcggctttacttttctgtcccccgactcgaaaatacttttatttcaaaa

SEQ ID NO: 34340 - DNA, 871 bp, Heterodera glycines
aaatataattttcaaaaaaaaaattaaagctatccaattcgaatttggcaattttctaatattgcttgcattctgttaaatgcagcggcaggatcaaatgcaattgtcctttatttaaacaggtcattattattgaactaattaattaatggtcaacgaaatattgaaataaattcttttgtctaatttttattcactcaaaatagcatttttaattgtacaacataattattattttttcaatatttgattcaaaaaaagtctttttttataattattaaggtaagaaagatatgaattttttatgattttttaaaataaacttctaaagggtgtaatttttccgaaattttttttaataaattttaattctgagacgcagcaatagtaaaaaaaaaaaaaaaaaattaattatgcatatattgtaatggctatttcttgcttatctaatggctaaagaccggatttttaggtttttacctataaaagtgcaataaaagcggaaaaaacacccctaagaatcggcccaaaaattttcaaatatactcttaagaaatgaaaaagcattttcaaaattttttatttattttcttgaccagttgcaattgtgcgggcgaaattgatataaaattagtcatttttggaatttttgtgcgtacggacagtaatttttccaataactgaatgaatggctctcggaaaatacgtcaatggaaaatgcgtcagttatactgtatttctgaaataaagtactattcattagagaccggaaatttcaaatttgcggatcccgctgcgggattggactcaaaattttttgctggacggaatccccgcgggataatccccgcatcccgcatttaaaatttgc

SEQ ID NO: 34341 - DNA, 466 bp, Heterodera glycines
aaatttgactttttgtgcggattctgcgggatttcattgattttttgaaaattttaaagaacagaatgccaaaattgaaaaaatttaaaataaattcaaattaaatccatttttcaacacaaatttcatctagaatttgcaaaaaaaaaaatttcccggctgcgcctatcggcaccgtcggatcgacttttacttattaatcctgtagaaatgagtcaaaagatgtgacattaggtcattttttggtcaaaatcagttaagaaattgacaaaattttcaacaaaaaaaattccgacggcgcctatcggcaccactgccctttgttcctagttttttgaaaaaatttcgccgaaaaaagcagttttgaaaagcaaaaaatagtcaaattttgacggacgaaaacaaaacaggaaaacgaaactcaaaaagtgacgaaaaaaggggacgacacgaaatttcgcacacc

SEQ ID NO: 34342 - DNA, 977 bp, Heterodera glycines
  misc_feature (93)..(93): n is a, c, g, or t
  misc_feature (244)..(244): n is a, c, g, or t
tttgaaaaaatacagagaaaaattgccatacatttatttctttcattaggttatctaaatttttatgagaattgttattttgaaagcttaatntgagcaattcttcgccttccaaatttcagcaaaatgtaaaaaatggcacaaacccaaattaaatatcaaaaagccctgactttttaagtatccatctgtcagaagttaagtagtatttagttctctgtaagtggcaaaacaaaccccactngctgatgtgaatgggatgaatgggatatcattttttcaaatatgctcagatgctgtgagcagaatgccctggtcgcttttcttaatcattttcgcgctctgttcgccgcccatggcacagttttggccatccaaacacggaatgatcgcattttggagttcgtcgtgcgcaccatttggccccttcttcggcacaacattcgctccatcactttcagctacgactgcgatttgcgtcagctctcaccctccatgttgttcgatagtccatcacttcgctcaatcgcttcatttggtggcattttccccgcctttccgcccgacgacagtgccaatgcatgggatggcgaagcggtggccaaatggctgttgcgcccgcggccggacggcgtcccgaagatgcttcggatcgactttttccagattaatttatgggaagcaagaattgatggattgaaaacggtgatttgaatttgccattttcaaatattcaatttcggcactatcgggcccacaattcccttctcaattttcctcctaaatgttggcatttgcaaaaaaaattgacatcacttctcagcttaagtggtgctcgagaaatctcgagaccgcccaaacccattactttctcgattgagaccgactctcgagcattattaaaatcatattaatttaggtataaaattcattctcaaagctccaaatcaagcagaaaaatttcgttcttttggcat

SEQ ID NO: 34343 - DNA, 1166 bp, Heterodera glycines
  misc_feature (1115)..(1115): n is a, c, g, or t
  misc_feature (1119)..(1119): n is a, c, g, or t
ttatctgcttcacataggcacatttcagctccacaaggcccaccggcgtcgcgccgccgtctccccacgtggtgccgtacgcttcaatgccacgggcgcgcaacgcattgataatgcccttgggagtgtttaattgataattagtgccataaggaccttttaatactatgccctcgggataaaattgatcatttaattggtaattgatattaatgagtgttccctgggttatttaattaataatggtgccttttcagggttcattaatatttttgacaaaatttcacattgaagcgcgttattttgttgctgactccgtgcacaataatcgccgcttcgtccccactcggcgccgcgccctgcgcccgtccgccggtgctgccgtccggtcccaaatcaccgcgttccaactgatggacgacggaaatgccgtagcttaaatggcgaattgcagcatttacttcgtttatgtgtcaggaaatttcataaagctatctcatcattctattcgataatcaaaaggtctctgatcactttttttggatttacaatcaatgtgccctctctgatcgatgatctgattatatgtctgacccattcttttgtgtttccctcttgatttgtgctgatacggtggcttgaggaccttacgaaattcggattatattcaggcagaaatatgcatatgcaaatttttatctgttggaaaaacccgtaaaccctataaagaattacatatacgaataagagtaaggattatgtttggctgggtacttatacggggtacggattaaccggctaacccgtaaaatccgtagcccgtaaaaacccgtataagtcgaaaaaaatatgcgttgcaagttaagtgtccgtaagaacccatgtacgagtccggcccgtattttatctatttattcaattttgtcttcatctgatctatttatcagttagtgctaatttttcaaatcacttttgtttaccgattgtgaatgaacacgcgaaagtcggcgctgaactcggcatttacagcgcataaaaatggggacagaagttggagcagtacgactttgacgtgcatctgctgaacagaacaacaaacaaaccaataataattngtgnggaaagagaaataattttgcatttattacatacatccatttggaaga

SEQ ID NO: 34344 - DNA, 768 bp, Heterodera glycines
aatggaggaaaagcaccgactgagggcggagggcggcaaatgcttctgaatgggaaaagcgaacggaatttaatttaattaatttagcagcaattagtcactttgagtctgcccgtgaagaaacacagcagaaaagcagtgattgaacagaccgaaatggtcaaaagtgatttgagatggaagaacggaggccaaaagatggacggaagaaagaacacaacgccaagacaaaagacaaccgaataaaaaagacaatgttcggcgaccatcgaaaacagagatggagaggacacttctgatgctaaacattttgtatttgaattaatgacagtaactggcctcacattaattacctttaatctgttggcacttttgcatttgctccctatgggggatggcaattcgagcggacattgtgccgagaaggaattgccaggcccgggccaaaagccaacccatcgcgacggaatttgatggggctaagcgccaaaagagaaaggatggaactacgaaaagcacaaacagtgccgacagctgaacgagtagacacttcataggacgacgccgaaagagtattgagctgaatttgaagagaaaaaggagcggcggagagagtgtcaaaagaaattgcaattggacggagacggcccacagatggagcagaggccgcggctgactgatctgaggagcaaaacattggaagagcagcgaatgccaaagggtactccgatcagttccaatgtccaatccacgtcggtcatctgatga

SEQ ID NO: 34345 - DNA, 1457 bp, Heterodera glycines
  misc_feature (152)..(152): n is a, c, g, or t
caattgcatgattgttctttctcatttgcattccatctcatatttccatagcgttctcacatctttttcgccattttccaaaaacatttcgaaaaatattcatatttgaataataaaattatgaaataccaatatttattactgcattcaanaaacaggctttaccgctggcaattgatttgtcatatttgggttttttgcttaattattttattaattaattaaatgatcattaaatggaaagcaaaaaccttcggcagatattctgaagaaatattcatacaaaatatgcaaatattttttgtatttttggcacttttcttttaaatcctctccaactttggcacattgccaattttttctcattaaatacataagaccaaaaaaggccccatattgttgtaaataaaattcctttgatttcacagagtttgaataatattctttaagcatcctataaaatttctcaaaatttgtctcttgacctttcacaaattcagtaaaaattgcatcatcagtcttaattttggcattaattaaaacaatttgtttttaaaagactcacccatacaaaataatcatcaaaaatcgatcggacaattatgtcatacgtaacgaaaattccataattatcttccctttttgcccgttgttccgcttttttaaacatttcccctaaaatttcgttaaaattctgccggaatattccgtcgacactttcatttgtttggcacccataagctgtgtcaattgccaattgtaaaatcatttcgttaattggcacttttggtttttcgttgaccaattttacattataattcaatctatgctcatttaacaattttggttcaaaatgataagtgaagagcttgtttaattttcttttatacatcatcaccgcactgtatttatgaaaataaaattgcgaaattttggccagacaattcaccgcataaattattgggccttcaatttcaattaggccatcaaattcaatttcatttttaaatacaaattttggcttcactgtgggaattccggcgtattctctgcacaaatattcgtacaaaatgtccaaatatttgcgatatttttggcattccgtccgttcattttcatcaaattcttttgctatttttacacatttccaattctttctcatataatacaaaatgccaaagtgtatctcatatttttccattgaatattcactgatttgtattttctgatcatttctcacaaatgcaattagcattttgtcgtctccctaattaaaaaatgattcgaccaattaattaactgttaattaactcactgatgaaattgcattcgaaatgtgaattagaaaaaaatgaatgataatatgaaaaggagttttcgaaaaagaacaaaacattatgttttcttaaattaaataaattgaatgatttaatgaaacataaatgcacattgattat

SEQ ID NO: 34346 - DNA, 792 bp, Heterodera glycines
attagagccaccccttggtctgcagttgtgagcaactgaagcgtgctaaaaaagtacacttcagtaccaggtgaataacacgccgggcttttatctgagggaaatgtgcccagcagacttattgtagagcttggaaagctcgattttttgaaatttcaaaatttcgaaaattttcaaaatttttcgagttaggcctaaaagtaggttttggggtttttgaattttaggattttttaacgatttttcccgggaaaacggaggccacttccaacacatagtttttcgagctctatcgaatggtatttttttcggaaaaatttcagttttttcccggaaatagaaaaattttttggcctgagcgggacatttgagtcccgggcccataactcgttaggggttgatttaatcgaaaaaatgccttagagctaaattgtagagcttttaaaatgctatcgaatggtgtgatatatggtcggaaatttttaaaaatttccgagctaggccccctagaaatttttggaatttttttttgtgttgaaaattggggtaaaaaatatttttcaggggttaattaaggtgctgagcacgaatatgacctttgttttccgtttcaaaatttttggaatttagtgttcacgtgaacagcacagtacaagtgaccagctgatgtacggtacaatgcgcatgggtttccagaaacgatgtccattacttatggtatggcatataatatttaaagtgcagatggggtactgtagggatcgcgtttgtactaatttaaagagacaaagg

SEQ ID NO: 34347 - DNA, 841 bp, Heterodera glycines
caataaaatttcaataaagttttatttcatcttctatactaccttgtgaaaattaaatttgtcaaattgcttagttttttcatacaaatcaaaatatgtcccgtctctatattctttttaattaatttggttcatatttatatcaggttttattgaatttttcatagaatttttgaccaaatgccataaaaacgaggctgtaatcgaaattttaccaaataatgacatatttttgttaataaatatatatatattttttaatttagttggacagagacaacagcgcttgtgcgaagccaaatgttgacctgttgatcatgtttgacaatgtgatttcaccagagcgggataacgacaatctgaaaatgaattcaaaccgttaccttttacttgacctattaggtacaattaaaatgcaattaaacttactaattacctattttatttaattagctaattaaattttaattatttttttaaggctcacttccttcggacggcctcgttcgtgttgcactaatttccgctggtggcccacgccttgaataccgtcttgtggacccgcaagaccgtgacgcggtggcgacacgcgttgagcgcatgcgaccgcttaacggtgcgccaaactatgcggcaggcatcgaacgcgcattggaccactacgcgagcgcagggcgtgacgatgcacgtgccattctgctgattgtggcaatggaattggcactgtcgactcgcagacacaacgccaaactgttgaaatgcggatcaaacaggtggccggcgctgagtttgaactttttctttttaaaaattttaattggttttagacatcggcattgat

SEQ ID NO: 34348 - DNA, 815 bp, Heterodera glycines
cacaatttccgcaactcttgcggtaatggaacatattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattattcacaatttccgcagctcttgcggtaatggaaaaatttttgaagaggctctgcggaacggattagcatcggggttacgagatagaaaattgtcctagaaagagatagccatttttctgagaatgattcacaatttccgcaactcttgcgggtatggataaaatttttgaagaggctctgcgg

SEQ ID NO: 34349 - DNA, 393 bp, Heterodera glycines
gcgccctttgaggccgcgaagcggccgactgtccccaaaaaattaaaaaacgggcgcgaagcgcccgtcctgagtccgcgaagcggccgaatgttgcccacaaaattaaaaaacaggcgcgaatcttgaggccgcgaagcggcagaatgtcccccaaacaattaaaaaacgggcgcgaagcgccgtcctgaggccgcgaagcggccgaatgttctctacaaaattaaaaaacgggcgcgaagcgcccttcctgaggccgcgaagcggccgaatgcccccgaaaaaattaaaaaacgggcgcgaagcgcccgtcctgaggccgcggagcggtcgaatgttctctacaaaattaaaagacgggcgcgaagcgctcgtcctgaggccgcgaagcgg

SEQ ID NO: 34350 - DNA, 951 bp, Heterodera glycines
  misc_feature (63)..(63): n is a, c, g, or t
  misc_feature (71)..(71): n is a, c, g, or t
  misc_feature (93)..(93): n is a, c, g, or t
attttttaaatttattttccgtcaggagcaagagcataattctgtattcatgcagtattaccnaatttcanaaatagaggctttttgccttgnatctaataaatttacattaaaattttcaatcgataactcgttctgttttacatttttttgaatagtttttttttacatttttctctaactaagaaattctcaaacacaaattatggtgcgttttgctgggcttcgtggcaccacatttattttactcgatggaacggaacttcctctagtcgggcttggcacatatggattgttgacccaaaatgacgtcgatgttgcagttgatacggcactattgagtggttatcgtttgtttgacactgcaaattattaccagaacgaattggagttaggaaacgcttttaaagttaatgagcattttttgtttcaatggtttatgtatgactttattttcagaaattattgcctaagcataatttgaaacgtgaagatgtttttattgtgacgaaggcaaacattcgctcacccaaggttgaggaaaatgcaattgcaatggttgaacattcacttcaatctttgcagacagagtataattatatattagagttcgacctggacttggatctagccctgcaggctcacatctccaggctattttgcagcaacaccaatttttgtcagaaaaaaatccaagcctggtttttttttctgaacctgagttatcctgaattttgcgcagtaaatccagactcaacctgggatccagtccaggctttttagttgaactttaatttacactatcattttgcttaagttacattgacttattgcttgtccattatcctaaagattggggtaaatcagacaacaattcgaggaatgctgaacacagaatgcaaatttatcaagtattagaacattataaaggtagaattgtgtacatacatg

SEQ ID NO: 34351 - DNA, 695 bp, Heterodera glycines
tgctggtgggttgagtcccagtgattgaaatgcaggtccccctagtgccagtgattggaatgctggtgggttgagtccctgtgattggaatgctggtgggttgagtcccagtgattgaaatgctgttgggttgagtcccagtgattggaatgctggtgggttgagtcccagtgattgaaatgctgttgggttgagtcccagtgattgaaatgctggtgggttgagtcccagtgattgaaatgcaggagaattgagtgccagtgattggaatgctggtgggttgagtcccagtgattgaaatgctgttgggttgagtcccagtgattgaaatgttggtgggttgagtcccagtgattgaaatgcaggagaattgagtgccagtgattggaatgctgtgggttgagtccaagtgattgaaatgctgttgggttgagtcccagtgattgaaatgctggtgggctgagtcccagtgattgaaatgctgttgggttgagtcccagtgattgaaatgctggagaattgagtgccagtgattggaatgctgtgggttgagtcccagtgattgaaatgctgttgggttgagtcccagtgattgaaatgctggtgggctgagtcccagtgattgaaatgctgttgggttgagtcccaatgattgaaatgctggtgggttgagtcccagtgattgaaatgctgga

SEQ ID NO: 34352 - DNA, 790 bp, Heterodera glycines
atttgcggcgccgatcacttgcggcgcccagccaaagttctcccccagatttgtttttcaaaacaacaatttaattctattcttttcaaaaataactaaaaaacgaaatttcgtttcgctctgtgctctttttttgtcatttttgggtttcctttcgtatttcaaaattcttttttcgatttgtttcgttttcgaaaataatttttgtcatttttgtgcatccctggtaggggttttaatataagaagtcccattagattcatcttggcaatgaaaaacgaagaaaagtatcagcaaaatcgcctgcggccatatgagattgatgcaacccgaggcattgctgagcgtccatgattgaaaaaatacataaaaaatgatgcagcaattaagcaaatgatcattgcatacgatatcaaagagaatcgcaatgacgctgatgtgctttcccacttgtacgcattacaatatcgtttagggatgaagggtttgaagcgtgggattagaattttaacgatgaaaataaaagaattgttgttgataaaaattttgtcactttgggtgggcgccgcaaatgtcggcgccgcaagtgtcactttgggtgggcgccgcaagtgtcggcgccgcaaatgtcgcatcatcccgaaaaataaagggccaaaggtcgagagaaatggaagaaatatgccgaaaaagtgagagagtaaaaaaatgggagagaaatgggagaaatatgccgaaaaagtgagagagtgaaaaaatgggagagaaatgggagaaatatgccgaaaaa

SEQ ID NO: 34353 - DNA, 1021 bp, Heterodera glycines
gttagatattctgggttgcagagattgtttggcgccagtactcctacacttatttgccgaacattcggttaaggaaatggtaaaggaagacaccgacgatcaagcagtaccaaaagggacaccgatgccaataatggaatcggactaaaaagggaataaaatgtttttaaaaaattatttatattaattagcgggacagacttttaatgtgaaaaatccgggcgtgtaaatgacgaaaatgccctctttgaccgtgacgggctgtttgttatacatcaacgaagaactttccacgcgaatttctaacgtgtaacgaccgtccgacagcccagagaatacaacgccggtctgatttctctgttaattaattaatttattttaaatttttgtttttagaatcaattgcttttgaattatgagaaaagaggcaacctcaaacagtgacgaaaagcaacagacacacaaaaataaggaaaaaaataatgcaaaaatcaaaaagtgtttgttgttggggtggtttcgagtgttgtgtttcactctcggacaaattgacttttataggcaatgtttgttatcagagtactggcaaaaagaaaaacggaaaaataggattttattgccggaaaaataataaggggcaggagtgaaggagatgggtggatgggcgttggtcaaacattgggtggggagcggacaaagtcgcgaaaacaaatttagcttgggaaagacaaatggatgggcaaaacaatttgtgcgggattaaagtgcaaaaggcaaaacaattttaaatggtttgtcggggagtgtcaacagacaaatggtcaaagacatttgacggacggcacaaatggaaaagaaacaaagttttttttgctggggaagtcaattacgtgaacatctattgaaattatatagagatattgtgtggtttgtgagaagcaatagaaaaaaatccgtaatttgaccgagacctgtcaaaaacccaaaatttagacaaaaaaaaaatatgcgatgcctgccg

SEQ ID NO: 34354 - DNA, 1270 bp, Heterodera glycines
aaattaataattaatttaaaattttagcctcagaatccccaatcacacagggattctgagggcttaacgatgtattaactgaaatctgatttcagattcgtgatcagcgtcataaataacccctaaaaactaatattaaataaataaggaaaagtttttaattaaagattaaaaatcacatgcattttaatttaaaattttttataataaaatactcgtttttcgttttattaattaaaaacaacgttgaaaattaataattgaatatttatttaatttgaaatgaaattaatttttttgcaaattcaaaaaataaataatgaaaatttttaattaaaaaaaattaatttaaatagtttacaaccaaactgttttaatttattaaatgcagtgaaaattacccaaaaaatgaacagaaaaataatgtacaccgaccggatccgaactcccccccccccccagaagatgactcagaatccccaatcacacagggattctgaggtcttgactatgtcaaaggtaaaatctgatcacgtattcgtgatcagcggcccaaataacccataaagacatatttttggatgatttttgattttcaattaataaaaatatgtaaaaacagcaaaaaatacaaagaaaataatttacacagtccggactcgaacttcgccccccccctcaaaatgatgcctcagaatccccaatcacacagggattctgaggtcttaacgatgtcaaaagtaaaatctgattgcgtattcgtgatcagcggcccaaataacccataaagacatatttttggatgatttttgattttcaattaataaaaatatgtaaaaacagcaaaaaatacaaagaaataatttacacagtccggactcgaacttcgccccccccaaaaaagatgcctcagaatccccaatcacacagggattctgaggtcttaaccatgtctaaagtaaaatctgattacatattcgtgatcagcggcccaaataacccctaaaaacatgtttttggaagatttttgacgaaaaaatttttcaactcaataatcctatgctcacccctttggtcccgaatccaaaatcacttttatttttataacaattcttaaaaagtgataaaaagtcaaataaatttatataatagacaaaaaattacgaatttttgaagtattttactcttctctaatgacttttcaaaaccaaaatataaattttttttctgaaaaatcgaaaatttcaaaaaattctggaataattttttt

SEQ ID NO: 34355 - DNA, 1212 bp, Heterodera glycines
gggtattattttctaaagtcttttattcctcaatgaacttttcattccccatttttcgcaccgtgaatgttatttttattgagttctgataccgttttgagtagaatagactagtaaaaattgcaaattttgaaatcaagtttcccactcctttctcccaggggtattattttgtaaagtctttttttccccaataaactcttcatctcacattttaggcatccgtgaatgttatttgtttttaattcagagctgtttcgagtagattacactagaaaaaatgtaaatttatgtcatcatgtttccctctcctactctaacaggggtaatacagtgtaaattagttttttcaaaataaactcttcaaaatacatttattacgccgcgatagttaccgccgggaaaattttgttaacagattttgtccaaaaaattacaaaattatgcgattttgagcaaattttgcaagaaaaatagggatttttagggtccggcggtgccgataggcgccgccgggaaatttttaaaaatttcagttcaatttattaacagaaattgtacaaaacttgctagttttttgaaaagaaaaatttaaaaaatttccgacttttcatcaaaaatttcggaagtcgaattcctaccccaaaaatgtcggaaatcggaagtctttccgtgccatacctggtgcctatcgacatctgcgagaaattttatgaaatttaatgcgatttggtaacagattttgtctaaaattgaccaaatgacgcagtttttgactcaatttctacaggattattaagaaaagcctatccggcggtgccgataggcgccgccggggaaatttcacaaattttgaatgaaatttgcgatgaaaaatgagttaactttaattaaatttattatttaatttatttaaaaatatttggcattctgtcttagaaaaattttcaaaaaaatcaataaaatcccgcataatcccgcacaaaaaatcaaatttgcggatcccgctgcgggattggaactcaaaattctttgcgggacgggatcccgcgggattaatcccgcaaatcccgcaatcccgcaaatcccgcattttccaaaaaatgcgggattgcggactgggatcccgcaaaatcccgcgcgggatcccgtcccgcgccgggctctactaatttcatcttcctttttttctacactattttgcaaattttg

SEQ ID NO: 34356 - DNA, 1008 bp, Heterodera glycines
  misc_feature (957)..(957): n is a, c, g, or t
agtcaattccccaatataaaataattaatgttaattactggtaaaattttctgtgccattttgacaaattccgtttaacaaatttattaaaataacgcgggatggattctttgtgattgcgaaaaattttgttttccatttcctgttcccggaaatttttttacctagctcttgtgctaactgtaatggcaccttcagccgaagcgtaaaaaaagaaaaagaaagaaaaaacggaattcgtggtgttgaaaatttctaaaaaaaaatattctggaaaatctagaagcttcattattcgagatcggcttattagaaggaattctcgtgaatttacttttgttgcaatttttcattctaagatcatgattgactttttgcccgttcccgatttttgtaagtttgttgtaagtttatgctttgttcatcaaattaagcattcttggtacatgttcgatagctcaattgtttactgttattctattactaagtttcaaaaaattaaaataaggtacaaaaaataaaaagtcagttttttgagcacagccctgacttttttttttgtaaatgaaagtaaattctctaaattttgcaaattaattgagtttttcatgtggtttcgaactgtactcagaatattatggtccaaaaaaaagttccagtgatttgtcctgctccgaccggcaggtggcgaaccccgggttcgggtgtcccttaaattttcataccctacaaaaactttcggtagcatcaattttggccaaaaatgatccggaccaaattgaatttttgcttttggatttttaaatacgagttttttagtgccacattttttttttcttaaaactagagatcggactgtacccggatccaggcctgtatttttcctggatccaggtacgggtacaggccatttttcggcaacctgtattttcctgtattaatttttaatcattattntttggcgaaatgtctgaaaaaatgatggaaaatttcaaaaaaatatcattt

SEQ ID NO: 34357 - DNA, 973 bp, Heterodera glycines
ggggacctctagagtccattcccggtagggatttaatagtgactttcagagcttttcattttttgtcaataactatttttcgtgcgttttcaaacacactattagtgctttattcacgctacaacagaagacaaaagttggtgtccaattcccggtagggatttaatagtgactttcagagatagccattttttgtcaataactatttttcgtgcgttttcaaacacactattagtgctttattcacgctacaacaaaagacaaaagttgatgtccaattcccggtagggatttaatagtgactttcagagatagccattttttgtcaataactatttttcgtgcgttttcaaacacactattagtgctttattcacgctacaacagaagacaaaagttggtgtccaattcccggtagggatttaatagtgactttcagagatagccattttttgtcaataactatttttcgtgcgttttcaaacacactattagtgctttattcacgctacaacaaaagacaaaagttgatgtccaattcccggtagggatttaatagtgactttcagagatagccattttttgtcaataactatttttcgtgcgttttcaaacacactattagtgctttattcacgctacaacagaagacaaaagttggtgtccaattcccggtagggatttaatagtgactttcagagatagccattttttgtcaagaactatttttcgtgcgttttcaaacacactattagtgctttattcaccgctacaacaaaaaacaaaagttgtgtccaattcccggtagggatttaatagtgactttcagagatagccattttttgtcaataactatttttcgtgcgttttcaaacacactattagtgctttattcacgctacaacagaagacaaaagttggtgtccaattcccggtagggattaatagtgactttcagagataggcatttttt

SEQ ID NO: 34358 - DNA, 1198 bp, Heterodera glycines
gaattatgcaaaggccgaaaagccttgaaaactgagactttggcatttgccaagcttaacaaggttttctaacgagtttaatggagggtaaccaacacgaacccccctgggactttccctggaagctaatttgtgctaattgccctcattataggatgatgagacaaatgtctattcgccgtggaccgttcgtgtttggccgggttccgctcacctttaccttccagtccgaagttgccaggcgtgtagtcggcgaaccggtcagtggtgtgccgttccgttgttggggaatgcctttttcagctctatcccaattaggatttttttaatttccaaaataaattttttttttttttaaattttcccgtaaaataaaatcatttttgctgtaagtgcaccgactttcgctctcgcatcggagtgacgtgccaaaatttgaccgagccgcgcattctcttcaatgtacctggttagtgttttgaattgttatgttttttgaaatttatttattttttctctaattgactatttttagttacaaattttgtctccattttatctttttcgatccctcaagactttttttgattttattacatgtccaaatgggtccgtcaatagcatgcttttcctttttcatgttctccgaacctccaactgtttttacaaaagactggattttttgggagcagcaggggggagtatttgttcaatggatcgggaaaatttgttaattgtttgcctgattatttttaatttaaatttggcactcgcttttcccccaggcaaatgttttactcctcggcctgacattgacgtgtgcgttgtgcagtttctgcctcgattggagccgctcattcccaccgcttacattgtgcgatttgtgaaatatttctttttacaaaattccatttttttgaaaaatgggcaaattttagcaaaatttttgaaaattttataattttcaaaaaaatgagcgttcaattacttttctgtatttccacataaaatgttgttgtcccttctgtcacaggtggcggacaaagtgttccgtactcttttccactacaaacggcgctttctcggcaaggctgttcagctgctgtacccgcgggcggtggcgttggaaatgggccatcacctgttgacgtgggtgtgcccgcctattttgggtcaaaaattagaaaaaattaaatgg

SEQ ID NO: 34359 - DNA, 960 bp, Heterodera glycines
attaaaaaatcaaatcgaaattcgatcatcgctttttcccccctgttggaggcgcccgtcccatctttggacgaagagacaatgcacacgacggacaatctgttcacgctgctgaagatggactttgtcactttcgtcgaactgttcaaaatgcagcccgcgttcgtcatgttggaagttgatgatcaggtaggcagagcacttgattaatgagccgaacattggtctaatcactgtgggccgatcattgggctaatcaatgggtcaatcattgggctgatcagtggtgatcagcgacaaatagtgggccaatcattgggctgacctattggattcatcattgggctgatcagtgggccgatgattgggctgatcagtggtgactagcggctaatcagtggccctgtcattgggaggactgatcagattcaaaagcattccgatcacttcgctcttcaggtccgtctggtgaacagtttggccatttcgctgcttggcctttgtgagcgataccattcttcgcgatggaaggccgaaacagtgctcaaattgtccaacggattttgcccaatttttattttctacaaaaacgaacaattttttggaagtgccgagtttaggttggaaatgcaatttggagaataattgggcagaaatttgtttgtacagaaaggccaatttggtgtactgtaggacaatgcgaagtttcaacagagtgcagccgaccattgaggagtatttgctgctgcgggcgattgccatgtctcattcaggtgactcatcaccataccgtcatagccaaatacatacgcatatgcaaacacaatatgcaaataacttttcccattggcgcgaaatacaaatgccaaacttttttttattttcagcttttgatggactttctgcgacggcgcggcgcctcctcaaaatgaggccgaacattacgccgatgcgctgctt

SEQ ID NO: 34360 - DNA, 769 bp, Heterodera glycines
ggttcggaattgatcgaaatggatgccggattcgtgatgagcgaccccgaaaaccccccgaaacatgttttcatgatttttgaaattaaaaaagaaaattcgaaaaatgttcgaattcgggttcgggattggaaatagaacgaaatggaggtcggattcgtgctcagcgcctcaaaacacccctagaaacattttataagaattttcagaaaaaatttaaaaaaaaaattttcgggaccaatgatcgacatgattgccgaccaagcctttagaagacccctttttacctcaatttttcgagttttaaacccggttcaaaaaccgggtttttggcacttccgcaactggagaactattcttgcatagctcgtcgagacgaatcgattggtatatcatttgtaccatttttttggggcctgactaataaagtacacccattcatccaccgatgtccatgcccatttctcagttcgatagccctccaaataaacattcattcggttttctttatgccccccccccctccgaattcattgctccgtcgaccttgggatggatggccactcatccgatgaacgacagtccgaccgaccatctgtccgccgttttctgctgtacaaacattgccattgttggtcatcccccgttgggaacattcacttgttcaatgataaaatgcatacggcgatggtttctgctgattgaccaactttttgtccaggacaattgccgaactttgtcactttaattttgaaaattaaaatgactt

SEQ ID NO: 34361 - DNA, 966 bp, Heterodera glycines
acgacgatttgtgacggaatataacaaacccagcgtggcacaggtgaatggttttgtaaaaagttttgcgtggcttatccaccaatttgttgctttttctgccaatttgacataatttctgttttcagggctttttcctcttgctgaccgcttctccggcaattctccaaatttaattcggcccattctccgctttttcagtccaatttcgctaaacactttctggcccaacttggccaaggttcgtgctccgcttggccccatttgcctttgttcgtttctctctgtgccgaccccgcctttgccgaagcatttaccgctcttaacggtgtccattgtttggccgaagtcatcgaagggttttccgacgaatggcacccattcgaaccgtaacatttcaccaaattttctgtttcaattttaatttggacagaaatgcacctccgctgttctcgcttatgcgttcccttctcacatttatgcagcaattccccgtcctttgcccttgggccgacttttccccgcaatttgtccataaaatggcacttttcgtaaatggacattcgaaattggagcaaaacgactcgcgagcactcgcacttggcactctcctcgttttggtggaacggtggtcagtcagagattggcgcttctttttcgactgtaatcaatgggcttaatccagcgaccatttgcacgaaagcataagggaaagactaagtgtcgagtctttgatcagacatttggacaattcggacgaacgcatcgccctcagttcactttcgctgatcaatgccatttacgaattggcagaccgaggcgaaagacttacgattatcaaagtgattggacggaaaccgcggggattccgacggaaaacgggaaaaagggcaacgaaagtgaaaaatcagtcaccgaatgtttttccccgttttgtcaaattctcaatgaacgcccattcattgc

SEQ ID NO: 34362 - DNA, 755 bp, Heterodera glycines
ttttcggggcagtccccccgaaccgatgcgcccagatttacggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggcgaaggcccaccacgaggccgcgaagaggccgagtgagtaccttcggtgcaggaaaattattaaattttaaaaattttttaattgctttttaaatatgccaaaaaatgtaggcttaacttttttagagaaaattcgatcactcatattttttgctaattgagcagaagcgtaccaaactttgcagggatactccccgagaaaggactaacttacactgaaatgagcgccgagctacctggatcaaaaaatttttcgaaaatctgagtctttcgtctttatttatttgcaaaattaattcataaat

SEQ ID NO: 34363 - DNA, 642 bp, Heterodera glycines
cgaaggcaaattggaatggaatgaattggggaaatgagtggaaggaattaatgggagagggggacaaatcaatatttggtccgttcaaagaacaaacccaatgacaacaatatttgaattatgggtcgccccaacaggctcttatacgatacttggaattttcaatctttttatttaatatacggtttaaaatcaatgaagaaaatacttttcaccttttctttaaactaaaaaaaatttgcttattaatgaaatccctcccacaaatcatccgaaacaacagggccaaattccaagaatttaaaaagaggatgatattggtcgcagaaataggcacacttttagtaaatcaaattgttaattttaaacaagaaatgttttatgcaaagattttaattttaaattgtccaaggattttattaatgtttttgcatatattattaacaaaaaaataaaattatttcattctaatgtttaaacatataatttttttacaactttcttttataacaaaaatagaaaaatataataacattaaacacttgttttgaaaaaattctgattaagcttaaaattaccgtttaaaataatgaaaatatttataaattgatacattgtgtgcctgtgccgtcgctcaactgc

SEQ ID NO: 34364 - DNA, 941 bp, Heterodera glycines
  misc_feature (889)..(889): n is a, c, g, or t
tttttaaattttcaatttttaaaacgaaattcccacatctttcattaattggtttcagtgcaatgctggaagttaatccaccgattccattttggcactcccaactcagcacattcacataggcagcccatgccatgtccttccatttgagacaaaagtgatccatttctccggtcgattgaaatccgagttgatcacggctattgattcggtcactgaagcattcccatcccggcatcatatgacgccaaaagtgtgttttgctcagtgccaatgctttggccatgtcctccgcctccgatgttgtgccatcctcgacgaccacttcaatcgcaccaacgacagagatggcaccaaaagtgatcagcaggagagtgatcattgaaggaacagtgatagtgatcagtgaattggcaaatttttacgcattctgtgcaaattttaaatttgaaaaagttagttgtattaattttttttgatcaacgggaatgtttgttctgttcaatttaattaaatttttgactattttttatttaattttacatttaattattgaaattatagaataaaataatttagagagattttatctaataatattacgattcaattgccatattaatgaatatatttttttacagaaaaagatgatagctattgtacaacaatacattaaggaaattcatacattttacatgtaataattccccttttttgaatagccaatttttgggcaataataatttttctagctaatatccacaattatttgcaatgttaatttatgacgcaagcaattattaatgtggatttttgcttgattttgtcgccatttttcattgtgaaatataaaatatgtgttgctgttaaaatgaatggaaatatattngattatataaatttattatatggaaatatttatattttcatccatctatgaa

SEQ ID NO: 34365 - DNA, 1409 bp, Heterodera glycines
tgatgaaatataatatataacgaaaatgcacatcgctgtccgtgtgctttgggatgtggtggacatcgagcggagactgagcacggcaccgctgggaaattggcacgggcgcaatttcaaaatttgaaattgaaatggattttcgaatcccaaatcctggcctgtgggcaagaaaaaacttcaaacaagatgaaggagagcaaaggataaagcccgttggaggaagacttggcaaaaaagtcgatggagggatgtgccgggctttaaaaagattgtgcacatcgtggaggatggaggttatcggtgatgaactgctcagtgtcatggaccagtgatttgaaagaggccgatttctcagtcgatgaagcgcccaaagcacccaatttttttttaattaggagtacggtacggtagttaattagtaaattgctaattattttttaaaataaacatgttcctcgaataaatggcaatttgcacaaaaaagtttcgaaaaattttgttataaatttaaaaagggacaaaaatagatttcaaaagatttataattaattaattacttcaaatttacgcataaaaactaaaaaccaaattctaagtaatcaatttttaatttaaaaaaaatgtaaaaagaaaagaaaaattcatacaaaaaaatgatcgtaattcatgtatgtttgtacatagattgtgatactttatgattaatttagttaataattaaattatcagtaaaagaacaaaataaaaagaataaagaataaaaattttgtagtatcataattaattaatttaattactgaataaaagtaattagattaaaatttatataaattatggatgagcaaagagtacaatttttttttgagaattttttgcctgtaatttgcaaaatttcattgactgtacattagcattaaaaaagttggtttacagtgaaaataaagcattttcactcacaccaaagcggagagcgaaggatgtcgccacaaaagcaaagaacactggggcagagaagcaaagaggatgagggataaagcaaaatagtgcacaattttcaggacagacaaacagagcaaaaacggaatgggcagggaaaagaaaaagatcccacagaaatagaataggcaaatctttgtttctctgtccctacttttaacccatcccatttttggaagaaaattgaggaatacaatatataaagaattgaaaattgtatgttgttgtgtgctttgggatgttggaaaacgagcggagactgaggcacggcacagctgggacggaagaggcacgggcgcaattttcaagatttaagaagaattttcgaattaagagaaacatgctaatgcctgcgggcacaatacaattcaaacgagcttcggcttaaaagcccgaggaggaagacttgg

SEQ ID NO: 34366 - DNA, 485 bp, Heterodera glycines
atcaattttattttatttttcatcggctttaagcacctatttaattttaatttttatccgagaaaaatgtggggatgagttgactgtggatgacctgcgactgcgccgaaatttctttggcttaatttcttaaacgtcccagccaacatttattaattaaattattaccttatatgcgaataagtacggtaattcgaatcttgctttgccacaactgtcaatttaaaaaatggcatttttttaatcccaaattttattcgctcactcgccactcaaagtcaaatttatgtactcgaaaaggattggagtgtgggattgcatcagattccagcagattcggttcttgaactcaaccgcaaaagtgaacggcgaagcgccactcagaccggactcttcttcatgtttgttgatttgtatactgtaattaaaaaaaagattttacgcatataacgaatattatggactaaatatattattaattagcc

SEQ ID NO: 34367 - DNA, 941 bp, Heterodera glycines
  misc_feature (28)..(28): n is a, c, g, or t
gtcttaattttattcgtcagataatttnttttctaaaacaatctcacccaatgtaaaatacgaatataataatagaagcattaagttataccatcaaatatgccatgatttttggaatgagtgaggtgccatgatatgtaaaaaaacaaatgttacattacctcatatataataataaaattatgaatatgaaaaatcggataaaaattaatacattaaaattaaaaaatattaaaaatatttaaaatttaacgagtgacaaaatatatattcttttatcatatatgtattggagaatcagtttgcaaacagaatgcctaatttgctgccgatacagaaggcattctaaatggaagcagtaaaattacggagcacaaatgttagaggttaacaaacatttaaaaaacataaaactaaaacaaaataattaatttaaatccaaaacatttttaaataaaaaacccccttttttgtcgaatttaagtagaagaattcaatgctgtataaccccaaccgtgatgatacaaaagatgcgcacaccaattaataaataaatacacgtcaaaataaatttctcaacacaaaaatgatgatcgaagataaataatatttattttaaaagctgataatataaaagcatatattaatatttattttttgtacctaaccatttatttttctaagcatttaaattacgattaaaattgtgtaaaactatttatattagtaaattttcatttccactggaatgaaagagcatttctaacacattttttcctcgtggaataaacagttcaaattaaataaagtgtaaagtatgttgatataatttctaaatctttttaaataatcaattagccaaaatccttgatccaaaaaatacaaaaaatcatttaaacttatatattcattataaaaaaagaatgacaaaaaaataagca

SEQ ID NO: 34368 - DNA, 783 bp, Heterodera glycines
gtgggccaaaccgaaattttgtgaaaataagccaatgctcatctaaaaattcgctagtagccataatgaagtaaaatgaaatttgtcttggccaaaacgacccgcactcaaaatttaggcttttttaaacaaagatggataatatcatcctcagcgtcttaggggcttaatgtcaatgataaagaagatgacttaaatcttgaattttgagtggagttggcggcgcgaaatatgttgagttgattggcaccgtgtcagtcaaagcggtggaaatgccgccaagacacaggccgttacgttttgccactattgtgccagtagagagcagaaataaattattttttattgaagaaaattagaaaatagaacacaaagaaatggtcagagaaaggagcaaaatggagggagaaaatgcgaaggcaaatgaaaagggaaaaggtgcggaaggaaatttccggaatgatggccctaattttgggcactttttcaacacaattcatgacaatctttcactaacagggtcccaaaaaattgacttatttggtggtacgcctgcggggcagtgcccataacttgatggatgggttctcacttactgcccataattatttcatcagcgtagaccttttgaaaggtcaaacgggatgatgtcaaacgggctgaccggctccgaaagattggccgacatttgcggctcgacttttgcggcgccgacacttgcggcgcccagccaaaatgacaattgcggcgccgacatttgcggcgcccacccaaagtgataaa

SEQ ID NO: 34369 - DNA, 807 bp, Heterodera glycines
cgaaattttttctgaaggcaacaatcaagaaattaatttattctatcgatatcaatgggacgacaaacgatcgaatcatcaaagacaacgttttttttaaattcgattcgctcgttaattcaccggaatataaccgtcatcgaaaaaaagagttccttttgactagcaatttctaacgatttcttcatgtataagcagtgatatttgtaaaaaaggtgctaggaaaatcgattagtgatcgctcgagagtgagattctgggttctagaaattctcatcgtttttttctcgttctgatagtgaggtggtcaaaaaattctttttcacaccaattctcgagtctcggggacaaaattcgatacgacccccgagcatcgctaaaatgaatgaccggccaaatgacaaatgatgtgtctgtcttctcgtctttcctctttctctgcctcactctctccgccactattacaccaaaatatcgatcgaaatttgcattgtcagagatgaaacgcgggcataaaaccgccttgagaggggggcggtgggtgttgacgttgatgtgccgcagcagcatcgggcagtgcaggtgcgactgccaacgacgaagccgcgttttggctgcgggtgagcaacgacaccgaccgagtccggcgcgccaggtgccgcagctgcgcctccgctgctgacggtcggcagcacacgcgcacgcagttgctcaaaaggaccgaccatttgggcacgcattttgatcagcatccgctccgggccagtgaacgcgcagcgctgcaattccacggcacgagcactgacg

SEQ ID NO: 34370 - DNA, 897 bp, Heterodera glycines
agagcggtggggaaaatttaaattaaatttaatatatatatataaaaaaagcaaaatatctgattgaatctagtgagatacgtgagcaaatttgaattttgattaaaaattaaatattccgtaggcccgcgtagaaataaaaaatacttttataaaattaattttttttcaactataattttgagaataaaaaaatatttattatccataatattaaaaattacttaatttaaattttaatataagtacaatcatattataatatttaaatttattaaataaatatttttaaatttacttaaaaacaattacccattttgatagttaaattaaattttagataaatttttaatgttgcatttttaaaattatagtccaattttgttccctgatcaccagaaatgtaatgatcagtaataaacttgtacatctgtacaaatgaatttggatagttgtagcgtcgtcgctactcaactcattgttattgagcgcggagggcagagagtacaacaaaaaaaaaaaaattggcgttacgtttacgcacgcgccaccgccaaataaatttcctttttttctctgcctttgtacagtttcgtgcgcatatttctttctcattttggctggccttgttaatgcctttttttctctaccttgaacttttattcacaattttcaattcgtctgatttctctaactgtatgcactatttcttttctgttacaatgtttcgtgcctttacatgtgctatatgtaacgctccctcatcgctagtcgcatgattttcgtgagaagacgaaaggtgaagcgcgcgcaattaaattctgctacgtttttttttcgattttcttgcggctgagatttactgctccggcttcaacttttatttttcaattttcg

SEQ ID NO: 34371 - DNA, 669 bp, Heterodera glycines
ggactgccccgaaaacaaaaaatcgattttttcaagtgtccggttggggtactcgaacaacttatggggagctaaaatccaacgccgaattaaagtacaggatatagggaatttattcccgaaggattcggtctccccattaatctgggtgcatctgttcggggggactgccccgagaacaaaaaaatctattttttcgagtgcttgggtgtggcactcgaacatgtatgggtagagataatgccaacttcagaattgaagtgcccagtagagggcagctattgccgcatgagtgtgcctccccatatgtatgggcgcgtcggatttgggggactgccccgaaaacacgaataactagatttttacccgcgcttgcgaggaggacgcgcacaattatggagagctccgatcctgcgcatgatgtagtagtacagactatagagaagatattctcgaaggactccgtctccccatatatgtgggcgcataggctcggggggtgtgccgcgaaaacaaaaaaatatattttttctagagtgcgtttgcggtactcgcacaattatggggagcaaaaatccaacgcacaattagagtacaggctataggagagctattctcgaaggattctgtctccccataaatctgagcgcatcggttcgggggggactg

SEQ ID NO: 34372 - DNA, 1071 bp, Heterodera glycines
  misc_feature (29)..(29): n is a, c, g, or t
aaagacaacaaaatattctgccgactttntgatgaaatatccgccccttgtgatcaaatatggcaaattgatcaaaattcaaattttccaattgatcaaaatgaattaaattcggaggatacaattaattggcaatgataagaagaacgactgattcaatgatcagcaaaaatatgaattttttaaaaattttacgcaaaaaaaaggaataaagaaatgggggaaatactcgacaaaaattcataataaaattgagcaaaaaattgctgaaaaaaatactgtgtcgtgctgggtcgtttcttaaatccgccaagtggtaggaaaataaaaaatgtcacacatataaattcataacttggcttaaatacaataaacttaatatttaatgataccacttaatagctctaggtattctctatttgaatataaattttgaaaatttctttacaaaatataaaaaagttatggttacaaaagttcataaagttatcctatttaattgtctcaccagctagcagctacctataatttggtgattttttatataacggctcagcaccaaatgaattagttggtgtcaatgcaccaaaaggtcaccagtccaaaacggcaattaataaaatgccactgatccaaaaagtcaccaaattaaaattaatgtactgattttaaacataaatgcaagtgtcaaataatgttttttgttttaaaaatgaatcaaattgtgatcagtgacaccgaaaaacccttaaaataagtctttatgatattaaaatttaaattaaaaaaaaaatgtttttatttttatttatttttaattttttgaagaaaaaaatttatttatttatttttcacaactttaaacagatggaaaaagcaaaatttttataaattttcttaattttgctattagacctatgaattattgtgctttatttgatttttcgccttttatcggtgcgttttccattttaagtggcatttttttaattttcgtaaattgttgctaattttcttattcataaaaatatgaaattattccaggtacaggtcgagatctactaaaaaata

SEQ ID NO: 34373 - DNA, 616 bp, Heterodera glycines
ttcaaggagcgaaggggggtggggaagggtgaagtgcccccccgcactactgaaaattgaaaaaaaaaatcggctcacaaatcgggcccgttggtcgtcgctgagcatacggtactccatgcgcaccaccctgcccaggctgaaggcgggcgtgcccgactgtcgccgtgcacgcggcaacggcaccgcaaatggtgccatggtcgctgcgaatggcgtcgacgacgaaccaccgcccaccgtgcattggtcgtgcgcggaagagacgccttaaaagttcaaaaaatttgagtcttctccagccctatttatttggatataggatggaggtgggccgacccgagcagagagcagctctttcagatatcagtccatgccccgaaaatttaaaaaaaatttctatgaaaatgtcaaaaaaaaaatttgaaaaattttttaacgatttattgagaaaatttacgggaaaaattactttagtaattctaacaaacttaaaattgctagaaaatattccaaaatatttctttcttgaatttgaatacaggttttttgggaatattgccaattaaattacttgtaaatattaaaacaaatctttgctcctacagaatgatga

SEQ ID NO: 34374 - DNA, 554 bp, Heterodera glycines
agaaatctgggattttttaaaatttttcagggaataaattaatagctcgtcagaaaaaattcataatcaaaaattctatggatgtgagagggatgaaaaaggaaaagtgcggaattccgcacaattaaatggggccgggcggcacacgaccaaaaattatgttcgccaagtcaagtgaaaacccattaaaaacaaacaaataaaaaaatgtttctgggaatttttcccgaaaattccgtcatttttgcacaaatttcattgtcctcctccgtctgcttccgttgttttttttcgttcaaaatttgcttcatgtttggcaaaatgccgcagcaaatgcttgttgctgttgctcattgtcaaaaatgttcggtgcacttgcagctcgtttaatctgttgttgtgtgctcagctcatcaatggttggcaatccgtcgcctttaaaattgtgggaaaataattattaattaatttttaaagttcatccatttttgaaaatttaatttaaaaaaccctttacgatcgcccggcagtgccgaaagacgcctccggggtta

SEQ ID NO: 34375 - DNA, 1005 bp, Heterodera glycines
  misc_feature (129)..(129): n is a, c, g, or t
gggtaattaatttgaatggtgtcgcgtgcctccgaggaacgggcacaagcaggtcatgttcaggcatgcgtaacgctccgccacccaccctgggcggcggttgtgccgccaactcggccaagcgtggcncggcggtggcaaggcagtccgatgccgtggtacggcggcggcaggtcgtccgcggtcacaatgcgaccctcggcctcggcctgaggggaattttcagaaatttatatgaaaaaaaagatttatggaagggaccagtcaacttaaaaaaaaatttcataaaatggatatttcggaacagttgcgtttgttctgtcgacccctttttgttgtagatttccgtgggttttcgaggtcttactgacacagaaaagcaatgtccatgttgttgaattctgacccagaccaaaaattcgaacagagttcaaaatccaaatttaaaaaattcaatgttattttgttggagtcggtctattttgttagaggacataccaatcggaaattgataaatcccactaattgtcagtacctacatttagaaaaaaaatggggtagaaaacgaaaacccgtaaaaagattaatgaaaaaattttcaatcaattccatccagcagaacggcacctttcgggcctcggcccaaatttgtgccaccattttgcatccgtgccgaacgtgcgccggcacggagtcacagtaattgtccgagttggctgtcacttgtggggggacaatgtgaggcgggggagacggggcagtcagcactgtgttgacggcaaaactgctgagcaacagcagaattgcgatggggaaattagtcatttttagtgttaggctaaaaaaataggcatgaaaatggaagaagattggtggtggtctggtaaaaggtaatgaagccatcctatttttggcattttaattccttttttgaggatttcagcgctagttaaaaagtcatatgtatattttgaattttcataactaaaagagtgacccttttgg

SEQ ID NO: 34376 - DNA, 781 bp, Heterodera glycines
ctaaaatgtgaataattaagggtgaaattttggctcgcggacgaacaactgagtagtaatggctctgagcctattacatctgaacatgttgaaactgcgtcgctttttattgttcctcctcctcccaaacaacgacgtacattacttgattccttgtcagaaatggcctcaaccagcaaatcttttggtaatttttaaaagattacttttattatgcataaaaatttaaagtgcaaatcgaatcgacatttgacgatgaattcaaaaaatattgttcggttgatttgattgggcaggaattggaccctttggattggtggaaaataaacgaaggactatttcccattatcactgcgcttgcaaaacgatatctttcggccccggcaacaacgattggaagcgagcaacttttcagtgttgcgcgtgatgtgtttgactatcgtcgatcaaaattgaaggctgaacatgccgaaatgctcatttttttgaacaaatcaattccgaaaattcgattttattgatttaaaaattttgcttttttattttttctttaataaacgtattgccgctcaaaatttgtgcataaaaatatttttgtgagtttaattaaattttcgaattactcccgctcccgcccgggactcccgttaaaaatggacgggatttgaacgggatcgggatttttacgggaatcccgttcgggactcccgtcccggaaaattttgaactcccgatcccgctcccgctcccggaattttttttttaccggactcaatttaaa

SEQ ID NO: 34377 - DNA, 1373 bp, Heterodera glycines
gtcctcaaattacggtgcttcgaccatcgaactcgttggctctggccaaacggtttggcgcgctccttcggtcattcatcgcgccgcttccgccattctcccaacttcgtaaagcgatgcgatttgccccccccccccaaaaaagtgcgcttttcatcacattttatcacctcatcttcaccagcacatcgcgcacatatttctccatttttactcctccgtttccttcttccacaaacattcactcttttccatccattcaatccctttttccctctttttcccttttttccctcactttttgtgccgatcatttcaaatttcttttcaattcgttttgccttttaaatgcttttcttctttttcgctcttctcattccgtggttggccacttcacaaaaagtggcaaatttgttgactaaattaactcataacttttctcagacacaaccaaattgcacaatcttgatatcaaacgatagcccttaaattgctttattagcttgctaatttcaaaaaatattattaagtttttcaaaagttatgacaattgttccagttttttgccttgaacttttgaaaaacttaataaaattttttgaaatttagcaagctaataaagcaattcaagggctatcgtatgacaccaagattgtgcaatttggttgcgtctgagaaaagttatgagtggatttactcacaaatttagcaaattttgcgcttttcgtcggtcgacccaccacggatattatcattgaacaaaataagaattattaattaattacttgttggttggccatggcataacagaaggggttgatcggcgagttcatgtagcaaaggaggtaactgaacagggcagaggattatggcattacgggccaaaaagtgccattcaatctttggataaaaagttggggactgattcaaatatcgattcaaatgaatgaccaatagtcagatgaatgtcctatgaaacagtgatcatagatttgaaaatgaaaagcaactgatcagaaaagtttcctgatcaatccgacgatggagtagtgtataaaaaagtgttaacaaaatgccatcccccattctccgtgcctgattgtgtacaacgcttgaaagcctgccgagctggaacagcgctcgcagaagccgtacaccgtggcaagcacataaaacggtgtccagaaaaggatgaaagtgccgagaatgactgtgatggtgcgcaaggctttgcgcgcgcggttctcagaacgcgactgggagccctgaggaaaaaactgcagaaaatgagaaattaatgggagagatatggtggtaaaatggagggattaaattgattgataatacgaccattaaatggggcaaaataatta

SEQ ID NO: 34378 - DNA, 662 bp, Heterodera glycines
aattactcttttcagcaatgaatataaattatcgccattgtaactgtgaaaatgactaatgtttatttggtctggcaccacacagatcaaatccaagtcggacccgtccaattcggagttcatcaaaaaggagccgttccttaggatttttgcttttggcactttttctaataaaggaacttttgaaaaataattttttagaaaaattactgtcatctgtgttcgcgattggaatattctgaacccattcctcaattaacttttggatttgtccgttgaaatcgccaatttcagcccttttgctttgcttaattgaatacggttcaatgaattcatttatctgtaatgattgcagaatacagtaatggattatgcataaataagatagtaattcagttgaaaattttccaattttttacctcttgtgacattttgaggtctttctccaaactttcggcacttgttctgatcagtcggtactgacttctttcataaacagatgacaacgaattattaattgcttaataaaatttttttttaattctcgtaatataaatattttctctaaataactttactaatttttattagatatttttctctcatagggttgagccccgcccccgcccccgtccacgggggcgagaaatttctcaccccgc

SEQ ID NO: 34379 - DNA, 846 bp, Heterodera glycines
  misc_feature (799)..(799): n is a, c, g, or t
  misc_feature (839)..(839): n is a, c, g, or t
taattcattttaaaattccgtctccacgctctttgatcggtcattatttcatttcagggcacaaattatacgaacatgggctaacaaattcggacaatcacgagcgcatccacctgatcatccatgtgctgcttgtggacgcggtttttgatcgcttggcgcgcgacctttgccgcaagacggcatttgaagtccaattccgcaactgggccgcgttggccaaacaaatggagttccagaaggaggagatccgcagcttcgtgtgcaacccgttgaacaatgtgaactgcttgctgactggtggtggtggtcttgtttggcccaggatttatggccaaattttagggctaattatcaggcccaaatccgcgaccgaccaatgggttgactaaatttgccaataaaggggggcgattttcggcacaaaaaattgtcataatttcagggatgtcccggcgggtgaagcgaaacccggcttagaccccaaaattcgggaacaacaactcggaatccattcccaaaaagtctaaaaatttatttgttcaagagattttttcaaaatttaaattcagatttaaaaaatgtcattttttaaaaaaattacattaattttttatccactcaaatacttcaagttaaagaacagaatgcatgatatatcattaaattaaaactgaaactttgacgaattaatctttttaaataaattaaattctcaatttttagaatttccatggggttgactttcgaattcgacccgcaaatgaactcgacctttgacgaaaacagagatgattgngaaccactggaagaaaagtcaagagaaaatttcatcatgnagttttt

SEQ ID NO: 34380 - DNA, 1030 bp, Heterodera glycines
  misc_feature (983)..(983): n is a, c, g, or t
aaattcaaaaaaaataatgaaattctttaagttaaaaaaaataaatttaaataatttaaaagaaatcttcaaaaattaattaaaaacattgtaaaataagccaaaaatacaaagaaaaataatcgttacaccgtccggattcgaacccgccgccccccccccccctcagaacatgtcccagaatccccaatcacacagggattctgagggcttaacgatgtcaaacgtaaaatctgatcacgtattcgtgatcagcgtcataaaatagccctaatgacatgtttttgaaagatttttgtcgaaaaaattttttcactcaaaaaccatgacccccctttggtcccgaatcccaaaatcacttttatttctataacttttttcaaaaaagtgataaaaatgccaaataaaatttatataatagagcaaaaaactgcggatttttgtagtattttatttttccagaatatcttttcagaaccgagttatgaatttttttctgaaaattcgaatttttccagaaattctggaataacttttttccttttttagatagaaattccaaataaagtccataaaattctcctgatttttctctatttttaaggctttattcctgtaaaattgatcaacccttcgatttgttatgaattttcaaatattaggccaaaatcctgagggccaaaaaattgccaaatattttcgaatttttaaaaaattccaaaaattctgaaacttaaaatagacatcatattcctactcagcaccttaaaaatacccagaaaaaaatttttcaccctctttttcaacccaaaaaaatttccgaaaatttctagggggcctagctcgaaaatttttgaaaatttccggccatataatacactattcgatagcattttaaaagctctacaattttgctctaaggcaattttggctaaaacgatccctgacgagttataggcccgggactcaaatggtccgctcangccaaaaattttttctattttcgggaaaatcgaaatttttcgaaaaa

SEQ ID NO: 34381 - DNA, 943 bp, Heterodera glycines
acaatggcatgaaaagtgatcagggcaaagtcaaacaattctttgaaaagtgatcggacaaagccaaacaatggcatgaaaagtgatcgggcaaagtcaaacaatggcatgaaaagtgatcgggcaaagtcaaactatggcacgaaaagtgatcggacaaagccaaacaatggcatgaaaagtgatcgggcaaagtcaaacaatggcatgaaaagtgatcgggcaaagtcaaactatggcgtgaaaagtgatcggacaaagccaaacaatggcatgaaaagtgatcggacaaagccaaacaatggcatgaaaagtgatcgggcaaagtcaaacaatggcatgaaaagtgatcgggcaaagccaaacaatggcataaaaagtgatcggacaaagccaaacaatggcatgaaaagtgatcggacaaagccaaacaatggcatgaaaagtgatcgggcaaagtcaaacaatggcatgaaaagtgatcggacaaagccaaacaatggcatgaaaagtgatcgggcaaagtcaaacaatggcatgaaaagtgatcgggcaaagtcaaactatggcgtgaaaagtgatcgggcaaagtcaaacaatggcacgaaaagtgatcggacaaagccaaacaatggcatgaaaagtgatcgggcaaagtcaaacaatggcatgaaaagtgatcggacaaagtcaaacaatggcatgaaaagtgatcgggcaaagtcaaacaatggcatgaaaagtgatcgggcaaagtcaaactatggcatgaaaagtgatcggacaaagccaaacaatggcatgaaaagtgatcgggcaaagtcaaacaatggcatgaaaagtgatcggacaaagccaaccaatggatgaaaagtggtcgggcaaaagcaaacaatggcatgaaaagggatcggccaaagccaaacaatggcatgaaaagtga

SEQ ID NO: 34382 - DNA, 1244 bp, Heterodera glycines
cgttttagttttctcagcctgaacaaaaaatttttttcccttgcaaaatctcgttaatctaaataagatttttaaaaaatccttatttattaattacttatactttcacaaaatgtgaatttctttaattaattaaaaaataataattattatttgagaattttctcattttaatttaaccattaaattttttcttatcttttttttctggaaattttcaatcaaatttaaatccatgtttaatttttctgtaaaataaatttaaaaaaaaaacatttttagaagttcaaaaaaacgctactccaaaaagtttggcctgaccaaacaaagcacaacatcagcggcggattacttcaatttttcgtcgtccatcggcgaagaaattttggacgaaaatttgcgccaagaaaaattgagcagtgaaagcagttcaaatgtgacgggatggagatgaaaccgaaaatatacatctaaaaattgaacaattaagaaatttgaacctaaaaatttgatgaaattttgtccattttttgtatgtaataatttttttttgtcttcttccaattttatcaatattttgagctttttccatcataaaaattatatttttaagaagaagaattaataattgtcaaattttaacgtaattcagcaaaaattctaaaaacttttttttcaaataatcaaaaatttctgcaaaatatttcatttcttaaaaggaaataattctgcaaatttttaatagaaaattaaacgaaaatcaattttaaaaataaaccaaatcaattaaccaaaattttaaataaaaaattagttcatattccttaataatttatgcgtttatcattattattaatttttttttctaaaaatgaacgaaaaattttattagtttaaagaggaacttagcactttttaattacttttattgattttgttggtaatttttgtgagcttaaaaatgcaaatttccaattattttttcattattttacaaaataattcgtataatgaattacttcggcaatcaaatggcatttaaatttttattttttataattttactcaaagcctcaaaccaaaaactgcttgaaaaaaccaaaattctcggggtctgtaaattattgaggaatagattgatattatagtagggcctggatttacatggacaaaaaaaaatccaaaatatggattataatatatacgaaaaaatcgcaaaatatggacgaaacatggacaaaaac

SEQ ID NO: 34383 - DNA, 953 bp, Heterodera glycines
  misc_feature (890)..(890): n is a, c, g, or t
gcgatggtgtcaacttccaattattgggaggaaaccaagtgcacgtcggctgacgcaaagaccctaacagactaaaacgcgcctaggtagcgaagctcacaaagcgcgaagcgctttttcccagcccagatccgacggttcacgcacccgctagttactatatatgttatattgacaaggagtttcgtttcaaaaaacaaaatctcccggccgaaggccgggagctccctgaaagtggtggaagggtcttacaactttttgaggagaatccgggaaaactatagagaaaaattcagcgcggacgactgagtcccggggaccgatttctcactttttcttgcagtttagggcccgtaactttttttctaaaactcggatcaaaaaattcccgctgtgagggcactccgcagaagtgtcctctataatccagtattttttattttttgatcagaccaaatcccggacctgtacagacacggagactcagttaatttttttttcccacttcagtaccaggtgaatgccgcgccagggtttgaactgagccagggggtgccagcggcactattgtagagcttcgaaagctcgattttttcagattttaaaatttcgaaaattttcaaaatttttcgagttaggcctaaaaaacggttttcgggttttttaattttatgattttttaacgaattttcccagagaaacggagagcacttccaaaacatagtttttcgagctctatcgactggtatttttttcggaaaaatttcgatttttcccggaaatagaaaaattttttggcctgagcgggacatttgagtcccgggcctataactcgtcagggatcgtttttagccaaaaattgccttagagcaaaattgtagagcttttanaatgctatcgaatagtgtattatatggccggaaattttcaaaaattttcgagctaggccccct

SEQ ID NO: 34384 - DNA, 962 bp, Heterodera glycines
gtgtgtgtcacaaagtaaacaaaaaatttaaataaagttttgacgcgattgtttttatttggatggaagaaatgaagtgaaaaaacagagataatagagataagtttcattgtaagaaagagtgaagaagagagagagatgaagacagttaggaacaaagagcggagagtaaaggagagagaaatgattagagaaacaggaaaaaagagagagaaagtatgggagtgaatgagacagagacaaataagagagagagagataaaaataagagaagcgagagagaggggggaaagagagagaaaagaggagagagagaagaggagagagagagagaaagaaaaaaggagagagatagaaaagaggagagagagagagaagaagagaggagagagagagagagaaaaagagaagagggagaaagaggagagagagagagaaagaaaaaagagagacaagaggagagagatagaaaagaggagagagagagaaaagaggagggagagagagaaaagagaagggagagaagaggagagagagagagagaaagaaaaaaggagagagaggaagagagagagaaaaagagaagagggagaaagaaagagaggagggaggagggagtgaagaggagagagatagaaagacgagagagagagagagaaaagaggagagagggaagagagagagaaagaaagagaggggggagagagagagaaaagaggagagagagagagaggagagagagagagagaaagaaaaaaggagagagaggaagagagaggagagagagagagaggaagagagagagaaaaagagaagagggagaaagaaagagaggagagaaaagaggagggagtgaagaggagagagatagaaagaggagagagagagagaaaagaggagggagagaagaggagagagagagagagaaagaaaaaaggagagagaggaagagagaggagaga

SEQ ID NO: 34385 - DNA, 882 bp, Heterodera glycines
aaataatgcgcataaaatatgcaccaaaaatcgtgaaatcccttcataaaaagtgaaaaatatgcacataaaattttccaattcgagggtgtaatttctcaaaatttcttcaaatttgttaaacataaagtaaaatcttcaaaaatggctaaatgtggtattaaaaatcattttaggagaaaaaaacacgatacagcttaaaatttactcattttagcgaaaaatcaacctgaaaagcaaaattttgcttatttttgacataaattaaccattttttgagaaaatttatttattcaatatttttcgtgaaaattttgctaaaaaattatttttttggaaaattttccggtttttgaggtcaaaaaggccaatttgtctgttgggggccgatctattgaggttttttggaaaaacgccaaaatatgcacataaaatatgcacgaaatgccaaaatatgcacataaatcgcgaaatatgcacaaatatgcaaaatatgcatatggaaatccatcctagaagcttcaagccatgctaaaaacatgtttttcatgcgtttcaggcctcccacagtccaggaaaaaatatgcatatgcatataattctatgccctagtgatcgtattttggagttcatttttcgcaacatttggccaatgatcgcgacaaacattcatggcttgcaattgtccaaacgaagtttccgccgtttgcgtcagttggccccgtcatttctcaacgactgtccatcgcttcactttgtgtcctattatgacgatcttttcaccgaatttccggccaatgacaatgccacggcatcggatagacaagcggtggccaaatggcttttcactccacttcaaaacgatgtgccaaaggtgttcaa

SEQ ID NO: 34386 - DNA, 499 bp, Heterodera glycines
cttaatgcataatcgcaaggctatgtatacaaattttccttgagtatgaaaaagattttttattccgaccgattgatccgtaaacaattaagagaaatgctaatttattaatacataataaactaaaaaggaaagtgttttggtctctcgatttggcgaattatattccccaacaaaaatgccatcatccttcattcttcgggcggcacaattcactgattcatcgtccgccggtaggagtgccggtattttcccacccgtttctgttgacaacatcggcgagccaattggcatcattccactgactctttgcccaatcactaaaataaaggacaattaaattcaaataaatattttaattttctaaattttgtggaaaataataattcaaattaataataattatttaattttaaatacattttccatttttgaatataccatttttattaaatttatgcgcttacagtgtcgagtcaatgggatggccccatcctcc

SEQ ID NO: 34387 - DNA, 993 bp, Heterodera glycines
gtgatgtcattatttaattggtattttctgactttacccgtgaaataaaaattatttacctatttaaagccattttattccaaaaaattctgtatgtttaaatttattacaaacttgtgtctatctgtgatgtcattatttaattggtattttctgaaaaatacccgtgaaataaaaattatttgcctatttaaagccattttattccaaaaaattctgtatgtttaaatttattataaacttgtgtctttctgtgatgtcattgtttaattggtattttctgaaaatacccgtgaaataaaaattatttgcctatttaaagccattttattccaaaaaattctgtatgtttaaatttattacaaacttgtgtctatctgtgatgtcattatttaattggtattttctgaaaaatacccgtgaaataaaaattatttgcctatttaaagccattttattccaaaaaattctgtatgtttaaatttattacaaacttgtgtctatctgtgatgtcattatttaattggtattttctgaaaaatacccgtgaaataaaaattatttgcctatttaaagccattttattccaaaaaattctgtatgtttaaatttattacaaacttgtgtctatctgtgatgtcattatttaattggtattttctgaaaaatacccgtgaaataaaaattatttgcctatttaaagccattttattccaaaaaattctgtatgtttaaatttattacaaacttgtgtctatctgtgatgtcattatttaattggtattttctgaaaaatacccgtgaaataaaaattatttgcctatttaaagccattttattccaaaaaattctgtatgtttaaatttattataaacttgtgtctttctgtgatgtcattgtttaattggtaatttctgaaaatacccgtgaaataaaaattatttgccctattaaagccattttattccaaaaaattctgtatgtttaaattta

SEQ ID NO: 34388 - DNA, 687 bp, Heterodera glycines
tttttaaaatttaaaccaaattgttcataaattcgtgaactctcaaatatctcattctttatcaatttcgctagcataattacaacaaaatcatttcaaagttttaggcgttaatcttcaggaaacaaagaaacccaatgtcgaattaaagcagaattggttttggagcatggatttgagtgcaaatagcctttttttgcaaaaaaataaataaatctaaatctaaaaaaattgtctaaatattgctaaaaactccaaaaagaccaaaacattttttatacggaaaaaactcgctctgattgaaaagaaaacagttaaacatgctgagcttttcatgcgcaaaattttccaaaaaagctttaaattatataaatcctaatcctaggaattaatatgtaaataatgtacactaattatcgaattttagaaaaaaatttcaaaaaataaaccataaaattcaaaaaaaggttaattttattcctttcgaacgtgaaaagattggtttttttcaacgcagaaattttttatttgttcattcagaaacagacgtgatctggcggtgccgacaccgccgtgaaaatttcttgaaatttttaatgagtttattaaaggcttttgaccaaaaattttccttttccatctgacaaaggaacatttccgacccgggactgcttcaaatccctttaa

SEQ ID NO: 34389 - DNA, 1410 bp, Heterodera glycines
  misc_feature (1396)..(1396): n is a, c, g, or t
acaaatcaccggccaattaaatactaataataaaattacatatattcatttttccaataattaaataatatttttgtctgttttatgattataaacaagagtgatcaaataaattcagtgattaaagtacatttttaaaaataaaatattttcatctaaaaatcaaatgaataacgtgaatttgagtgatttgggctaataggccaaggaacgccgcggcatcaattaagtgcgatttaatgttggactgaattatcccgaaatatcttcatcattcaacattgtgtagtgcctaatggaagcccattgtgcattggaattgcttgattagcatttgaaaatcgtttaaacacaaatggaaaccccgtttgaaatgcctggcgatattccgtactaaaataaaaaacaatattgtttaattattttcaaataattattcttaaagcttccttttttaggcacaaaaatcgcgaaataagctcttaaaaggcacaaaaaatcgcaaaataagcattaaataggcactaaaataggcaaatacttttttgtgaacgctttttaggtagcaaaacacgtcaaagttaaataattcaattgtaaataaaattatgaaattgtttaaagttttttcgacaagaacaaatttttaaaccagaaatttttattaagaaaaaattattaaattttgggatcaatttttgaattttcaattcttaggggtttattttctgaaaaataggcattataaaagtcaacgtagacgactcctcaaaccaagcggaaaacgcgttttttatgcttaatatattgaaattagtgcgcagaaaaaaagacatatgcctcaaaatacgagctctaataataactaatttaatttacgcttatttcattaaaatgtcgatgttttaatgaagtcggcaaataattaggcaaaaaattgaaacggaaacataacgaaaggggtaaagagactgagaaagtaaagcaatttcaaatatgtaaaatttagtattttctgaactcaaggcagttaaggaaattaattacccatttgatttattaaaatacgaaagaatggcattaatttttgcttggtacgagattttgctttcatcgaattaatttttttcctttatttcacgaatcacaaacacctgctgttgtttgtttcaatttaaaccaattccttccccaaaagtacaaaagactgtcattaattggattatcattttgaatgaaatgatttagaattttggaaaacaaaaaaatcttgcatttgtgaaaatgctatatactcgtgcattttgaaaactgaatcccagtcaaatcccaacgaaatttcactcaaatacacacaaaacgaatttattattaatcgagattatgcactgcaacnggtggttattttct

SEQ ID NO: 34390 - DNA, 1031 bp, Heterodera glycines
aaaccccgtaaaagattccgaattttctggaaagtaaaaaaaagtcacatttttgcttggccaaaagtgcacagtgcgccgatgtgccagtcgagcacacgaaacacgagcaaacagtgccgaagacagtcggacggctctgagccgggcccggcgtaaggcccactgaaattgggaagggatggaaaaacggggtaagaaaatgaaaaaaaattgaatttttaatataaattttagactcaaagctaacgaatgaaaacccaagttttgctccgttttatttggcggcggatttacgaaatttcggcacggcattttagcggaccgacttgaacagtcggatggaatgggtttccaacaataagccatgtccgttaacggcattccgctaatttaaacggtgccgaaaataatatttttgaaaaattcagaaaatgaaaactaaccgaatttcgtggtgcacaaattcgtctaattgttcagcaattgcgtgcacttcgtcaggcgttgaccaacaacagtcaaaatttgtctgaaattttaccgcttaaaaaatgccattgtaaaacaggtatgtaactccaaaaccttaccaagatgtccaagtattggtccggtcgttgtgccaattcccgaccggtgcctgcaccggcacgaaatgccatggcatgcaaaaactgtagtgacagttgaaaaggagagaatgtggcgtggtattctcctggaggggaggcattttttgattttggtccattgtttattagaaaaaaaagccggaaaagggaccaccagtaaaacccataaaaaagttcccggaattcggcaatttttacgaaaaaattagtggggttcgaaacacagaggaccggatctaataaaaaataacagaagcctatgctgacacgcatttgcttgcaaaattttgtgtttatcccgagttcggacagggcaatggtcaaaccggaatttgtatgaaccccatcattatccactttttattaggaaaagcgggacccagaaaatggggtgga

SEQ ID NO: 34391 - DNA, 848 bp, Heterodera glycines
tcgcctatgaccaaatggttcgcgactgtccgaaaacgtgcaatgtttgcccgggagtttgtgaagatttgggcaccgaatgtcccgaccgattgttttattgtgggagagaggtgggcagaaaaaacactattgaaactaattaagaaaagaattttaaaataataattatgaatgtgcatgttttgttcatctacggcagggacgtgccgaaggtagggaattgaccgtttcgttaattttcagccctacattgacctgatgaattggcaatgcccgcgaagttgcaaccgatgcggaaacagaaggcgaccacggagcagattataataaaaaggaagaaacagaaaactaattttgtgatcattcaaatttaaagcaaaatcggaaaaagaatagggcccaaaagcatcatttaactgtcaaaaagcatcatttattgaggaatattttatgaggttttctagctaaattttattaaatataaagggaaattgtggtccacttgtgccgataggcgtcgtagggatttttttttagaattttaatgcaatttgtcgtgtccagacattttcgtccagtacatttgcgcctatgtcaaaaatcggattcaaacttaaattttttcaaggcaatcatggaatgaaaaaatgtaatttgaagccggatttgtacataggcgtaaatgtctgtgccgcaaaggttctggtcggttttatgcgtcccatgaatcaccattttgtataattttattttttgctaaatgcaatatacaaaaaattatcctcaaaaaaggtgaatttattttttaatgccagtatttgaccttttcttggatttataaaatc

SEQ ID NO: 34392 - DNA, 1104 bp, Heterodera glycines
agaaaagcgaattcgaattcttccaattggcaaatcgccttgtttaattcttcggcactgaacgaaccgaactgagtgactttaaaatgtcgttctttttgttggtttgaaatgccattttttagtttcacaagtttactttcatcaatagtttcagcaattttttcccacaatgtgtttgttgatgagcttaattaactcagagttttatcaatttcagtttacaataattatcattttattacattaaattaattatttaaatttttgtttctcactcaaatgcaatttggtcaatgtcctcgtgaataaaatataatttgtcatgtacaaattgcaattcttcacttctgatgctcgcactttgcatgaaactatcccatttttcgtcaaatttgtccaaaatttgatcattttccgtccttttttcttccctttttatgaattttaatttcgtttcgatcgctcgcacaaataaaataatatttttcgttatttcaatgtttttgccgtccaatttctttagtaatacattttcaaaagtttctttcaccaccaaatcgtctaataaatctaaatttctttcttatttaattcctttttaaattaaaatttgcctcctaattttccgattccaatttctgccaatgtttttgtgccattttccccgccgttttgcccattttcaattaaattcgccttttttgtccccttttttggcgttttgccctcttttttgtcctctttttcctcccccaattcgttgcttcttttttccgtcatttcttttttcccttttttgttattacttttttccttttccttcccattttttgctccttttttcgttgctttttctttcttttttgcctttttgttttggctttgtcttatccatttttcgttttcttcgtataattccatcagttcgtccgtttccgaattttgtctgtaaatttcggttatttccttataaatttgctcttcttcgtcctgtccctttttttctcttattttttctttttctttattttttgaatttttccttagaatttcttccgttgtatttgcgttttttgcgcatttcattttcatttcaaattg

SEQ ID NO: 34393 - DNA, 849 bp, Heterodera glycines
ttaactgaatttttggtgcagagattaacgttataatttaggtctgattaatatgtagaataataaaaaataggccaaatgttaggctcgtgtgggaattgaacccacgcgtccacccaacccgggggcagctctaccattgagatacctttagaaacagccggactgagtacaacctgagcttgaactatcagatcaatgagaacacacaagcaatgcttgtaatttttccgatcgatatttcctttgccattatatatccaatccacaatgtgcttgtgatcttaattcgcgcctaccgatcagctttcacaaaagcggattttgtctcatattgctactgggccaatacggtaatcattaattgaataatttgaatttaataattcaaaatttagccgctttttcttcattcgctcgtcactgttttgttgtacatccgctttatcaacagaagctcgaaaattacgaaaagaagaaattttgtgaaaaggaatttaaatgaagtagggaaaacccatttcaaatttttggaggaacagtggaacagaaaaagtgcattttcaaccgattaaattaggatgcacttaattttttatgcattaaccattttttccaaataaagattttggtataatttataagtacttagccaacagaattgtttttctttaatttatatttaatacatatcgtggggcgacattcagttcgtttttttggggttgaaatttgtaaatcgagcttgggatcctcaaatgtggggacctcaaatgtcgggatcctcaaatgtcgtgatcctcaaggatcctcaaaagtcgtgtacttgaatgccgtgatcctgaaatg

SEQ ID NO: 34394 - DNA, 255 bp, Heterodera glycines
ttcttgagcagattgtgaacgttgataatcaactcaatgagctgaccttccgcgaggcagagatctcccagctgtataagaaagatcacccaacttatcgtgcgctgctggaaaaacgccagacgctggagcaagaacgcaaacgcctgaataagcgggtatcggcaatgccttccacccaacaggaagtgttgcgtttaagtcgtgacgtagaagcgggccgtgcggtatatctgcaattacttaaccgccagc

SEQ ID NO: 34395 - DNA, 1333 bp, Heterodera glycines
aaaaatttttttgggttgaaaatgggggtcaaaaatattattctggggtaatataaggtgctgagcacgaatatgatgtctattttcagtttcagaatatttggaattttttaaaaattctttattatttggcaattttttggccatctgggatgttggcactaatattagaaaattcataactaacctcagggtaagtcaatttttatccaacaaagcattaaaaatagagaaaaatcaggagaattttatgggatttatttaggatttctagcatcaataagaaaaaagatattccagaagttatggaaattttagatttttcagaaaaaaattgataactgcgttctgaaaagaaattagcgaaaagtaaaatactacaaaaatcctcaacttttttctctataatataaaaaacattttacatgcttatccgaaaagcacaacaaaaattagaaacgggcgcgaagcgcccgtctgaggccgcgaagcggcctaaaaatcgctgataattttttaaaaattccaaatcttttcacaacccgatagctaatctaggtagcgaagctcaagaagcgcgaagcgctttttcccagctaaatagccgacggttcacgcacccgctagttaatatatacgttatattgacaaggagtttcgttgctaaaaccattttctcccggccgaaggccgggagcgccctgaaagtagtggaagggtcttacaactttttgaggcgcatccgggaaaactatagagaaaaattcagcgcggacgactgagtcccggggaccgatttctcactttttcttgcgtttgttagcccataactttttttctaaaactcggatcaaaaaattcccgctggtaggattttaagttgaagtgttggctaaaagttaaaaaaaattccaggcctctacctataataggaagggctatagaagcgcggacaaattcagtaccaactttgtccacttcagtcccaggcgaataactcattagggtttgagctgagcgagggggtgccagcagacttattgtagagttcaataagctcgatttttccagattttaaaatttcgaaaattttcaaaattttttgagctaggcctaaaaaacggttttcgggtttttgaattttaggattttttaacgaattttcccagaaaaacggagaccactttcaagcaaccgtttttcgagctctatcgattggtgggatttttgaaaaaaattcgattttttcccggaaatagaaaaaaattttggcctcagcgggacatttgagtgccgggcccccataactcgttaggggttggttttatcgaaa

SEQ ID NO: 34396 - DNA, 1643 bp, Heterodera glycines
  misc_feature (9)..(9): n is a, c, g, or t
tccgatttntgaagtaaaaatcaaacaatgatgatcattctttgcctaaaaaatggtttgaattttttaaatattgaatgtcgtaattgacttgggtctaaaatttgaccatcattatcaacataatcctgatcagaatttttttttatagtaatctcgctattttgaatcagctcgactgccttttccccgggtttggctacttcatcctgatcaattcattacctgaactaatcatttccgattcttagacttttctcccctcgagcttccgccctctttttctgatcactttttcagcattttttcccgtctccgccaaaaaagggaagggttttgctacgcattctttctgatcagtccattgtaacattgatcagtctgtctcgaccaatccactcgctttacctctcctccccgcccccttcggcttgaactctcccaattccaaataggcaatgcaattttcccattttcgtcatacagtccgtcatccttcccgcctcccccccccccccctccaatccatcccaaaagcgtcgattggtccggaaagtgaaaccccacaagccaagcaaggacgacgagaagaagaggtgctctccatccgacgacgccgattgatttgtgtggggcgggaaagacaaacaaaaattattcccccctccccccgggggggggggggcttttcaatcatagcattttccggagaaaagcatcgtcgccgctgctcttcaaatggtcacagtgaaatgaatgaatctcatcttgaatgatgatgacgatgatgatggtggtcgttgatgattcatcgcccacttaaaggaattaaaccgcactaattgcccgtccctttcaattaatttttttttctactttctgtgctgcccacaaaatgatttgcagcagtttcttgtcgataagaatattatgagattgtgttgtgatgtccatcctaaaaatgattgattgaccgcttaattttacttttcataattatcgcctggggcataaaaaaatatttttttaaggtaatcattaatttaaaataataattccataaacgtacaatatatagtcgaaataaatattcgtacaataataataaatggacatatagaaaaggaataagagattatgctttttttagataatgttaaatgagcaaatgaaattaagcgcaataattattgtttcaatcttatttcagcaaaagtcaatagataatcttcttgtataagaaattatctaaatacaccccttaatatttggaaaatttaaaatattttttttggttgataaagcatatgatatgatcgggtagttcatcgtctgcccgtgcagaaatttcttcatgtttttttttgattacaatgctaatcaaatataatttctatgaggtaaatatgggaaaagtcaatgaatttcgtggagatgaaggaattttcatgaaaatgccgatgaaatgaaagtgccaaatctgtcatcatattttttctgtagaatcatcttttattctattatattccagaatttaacaattgctttttacaattcagcgtgttcctccggggaatttacttttgtattatcatccatgttgttcattcattcatcaaattcttgcagaatcttttgttcaa

SEQ ID NO: 34397 - DNA, 1040 bp, Heterodera glycines
atgatgataagcatattgtcaaaggaatgcacaaaaaaccttagtgatggcaccctcttcacagaagaagcgattgacgggagaaaattgaaaattggcacaagaacgaattgtatgggatgagatggacggggggagcactttactctgtcagaacgaacacatgccgaaccgggattgttttttgcttggatttgtccttcccctccccccttggccatgccgtcgtcgcttttctcaacaattggcaaacattgcactccgcgctaccaaaggctgctgctcattcacccaaactttggcaaaatgatacggaaagaagtgttgtgtatataaaatgggcggacgaacggaaaatgccaataatttttagcgcaaatgaaaatgaatgagcgaatgaaaagagtcggcatcgacactttggcctgtcacatatcaatcagtcccattcactcattgacaacaaaatgcctaattattactttcccattattattttatataactttcgtatgcaaatgtaaacaaaacaattggcagaccaaacatggcatttcccaccaaataaaaggttgtggggttcattctgtgtgtccctttggcatttgccccccccccgcctttttctcgttctgtctcctaatttataatgtgccaccgcggcgtccctttcttctgacaaccaaattggtggcattcgctgctgttgacaaacgttagtccttttcggcctctccatttcatctcaaattaaaattggtcggctccttcccaattttccatttatccccaaaatcgctcttttgattaggcaaattacttttccatttaatattctgttgatctgattaatttaattgttataaaaatgatcaaatttatggaaaatctaaaacctattgatctgaagaggggggggggatacatttgctttaaataacaatgcactttccaatttatgaatgtataggaaatcaattaaaataatttttattttattattttgaaaaataatttatgttaataattgattatttcat

SEQ ID NO: 34398 - DNA, 1016 bp, Heterodera glycines
  misc_feature (942)..(942): n is a, c, g, or t
  misc_feature (991)..(991): n is a, c, g, or t
caggtatatttgctcatcttaatttattcttggggatcttttgtttaaaaaagtcaaaaataaattcaagaaatttttccccggactacacgatcttttatcaccataatgacaaaatggcgccagaatgcaggtatatttgctcatcttattttattctgggggcttttacgtttaaaaaaatcaaaaattaattcctgaaatttttccccggactacacgatcttttattaccataatgacaaaatggcaccagaatgcaggtatatttgctcatcttaatttattctgggggcttttacgtttaaaaaagtcaaaaataaattcctgaaatttttccccggactacacgatcttttattaccataatgacaaaatggcaccagaatgcaggtatatttgctcatcttattttattctgggggcttttacgtttaaaaaaatcaaaaattaattcctgaaatttttccccggactacacgatcttttattaccataatgacaaaatggcaccagaatgcaggtatatttgctcatcttaatttattcttggggcttttacgtttaaaaaagtcaaaaataaattcaagaaatttttccccggactacacgatcttttatcaccataatgacaaaatggcgccagaatgcaggtatatttgctcatcttattttattctgggggcttttacgtttaaaaaaatcaaaaattaattcctgaaatttttccccggactacacgatcttttattaccataatgacaaaatggccccagaatgcaggtatatttgctcatcttaatttattctgggggcttttacgtttaaaaaagtcaaaaataaattcctgatatttttccacggactacacgatcttttattaccataatgacaaaatggcaccagaatgcaggtatatttgctcatcttaatttattctgngggcttttacgtttaaaaagtcaaaattaattcctgaaattttccccgnactacacgatcttttattacccata

SEQ ID NO: 34399 - DNA, 964 bp, Heterodera glycines
tcatagaaactattaatttaaaaaaacacagaaaatttctgtggaaatattaatcacctgaactgcgtttgatgccgccttaaaaatggaaataaattcagaaaaagtattttcctaataaaaaagcacttggaatgccgcgtcgcatgcaaagcatttggccatcgacgcaaaataaacggcgtcctccgcctgcgcgtccaccttttcggccgcccgcttcacaaggcctttggacgcctccaaatgcatggccatttcggcgagtttgaaggagacgccctcaaaagaaattgtgcatttgccgaagcgtttaaaaaattcaaaaaaaaaaaaaaattcgaacacatgtaggaagaaggacatttgatttaaatattggcgttccattttgatgttcattccccatttattattgatttacaactttgactttttcacaatatttcccgcccttttcccacgttcagtcattatggttttatcattctgatttcattccccatatttctccatccctctccaatccgtctcttctctaaatatattattttccttctccaaataagtaaatatatatattctccatccatcgccaattgacttagtgatccaaatccgaaccccggcattctctcccctcttcctttaatcgtacttggcgctcctggccgacattcgaactgcaccgccttttggaagacatcgaattgctcgccgattgccgacaagccagcaaagcacgtgaaaaagcagcgccgtccgcccactcaattcgccgaaaatggaagaatattttggtcaggcaagttttcgaaagagaatgttggcacaaggccaccgactgcgagaaagtcttgcctgtgaaggcaacaaaaaccggattttggctgaaactgcattcgggtttcggcagaaatgaagaaattgggaatttggggggcgtcagtgcattcccatttcg

SEQ ID NO: 34400 - DNA, 521 bp, Heterodera glycines
aatcccgctggcccaaatggtggggattatgaaggttttaatgaatttattatgaaaaagtggttaaaatttgtggcgttttttaggagactctccaattggcacacactgctgccaatgaaaaatttgaaaggaaaaggaacaaaaaatgaacaaatccgctgctgctgctgcacttggctttctctcattggctaacggaatgccagtccaacagggcatttgcgtcactgccaagtgacaaaacgacgaatccgaaaaattggccaaatgaagtgaaaacggtcactgatgggtgagcagcagggatgggccgaggtttcgcttttcgcatttcgcctttcgcattattcgcattttttggcgtttcgcatttcgctttttggcgcgaaatgcgacttttacacccctaagaattggattaaattcccataaaatttttcaaaattttacctataaattggctaattttcagtgaaaaactgtttataaatgatcaaaatttccattttttttccccc

SEQ ID NO: 34401 - DNA, 1709 bp, Heterodera glycines
cgcgtgtgccatggccacaaattctatggacaaaggtgggacgcggttctgttcaagaaaacagagcattttgggaattctggcaatctttcgactcccttctctgcttcggctcacttcgcctttcagcaggccgtgccaatctttccggcgtcgcctcctccgccaatagcgctcttttcggcattggcactgctgcggtacgtccgtcctcctcctcaaccgcgtccagcacttcgacgcccacccaatctaccactgcccagcggcgtccgattgttctgtcggcaaaagcatcgccgtctccgccgccgccaccgccgcttttgaacataaaaagtggcggaagaacggcacaaagggtggcggtgacaacaaaagaaaaacagaaaacgaagcagagagaagagagggagcacaacgaaacggaagacgaaatattcttgggaggggaaggtaaatgggcgaggggagaaagagagagagagtgtgtgttagagagagcgagagagttggaaaacgatggatggcggagtgacccattttatgccaaatttagtctcattgaatggtccaacaaaatttgtggagaatgccattgtgaagccgaaagtgccgccaaagcctgacaaaaacgcactgatcggagtcggacaacagcagcagaagaagcgaaaggaagaggtgggaggggacagagaatgaggacagattggaatttaaaatgtaacaattactaattgtcagatcaatcagaatttggtcggtcccttggagagcattctgaaggatgtgcgatcgatgaacgaggcattggacgtgttggagtcgccgaccggaaatggcggaatagcaggaagtaccagcagtcagaaggttggcacagcggggacagaaacggtcgcggagggagcagatcatcagcaggtagtataatcagatgatcgataagagtcaaacaatcatcagcaacggatggattaattaccgtgattggccaagagtgtgtgtctgtttcctatcttttccgatcgtttccgtctcccccttttcaccattgatcactgactgatcaattaccataattggtgtcattttcgtttgtcccttttccgatcgcttccctttcctccgtcggcccctcgcgccgtcgtcgtctgcccgatgccatttccgtggaaagtgacgactgtccgtccgtgcgcaccgttcatttgttcaacaacggcgacaatcgcgtgccctacacattgacagtgcgcgacctaagcggcggagtgtcgcagcagcgaacgacgacaagcgaagtgtgaggaaaaatgggaaaatgggtaccgtaactgtgtgctgacacaacaatatacagtagtcgtgaggagactcagtggtacggtagtggttcagcgacgtccgccagcagtggcggcttcggacgaagtcgcattgccacagcgctggaaggctgcccaatggcattgagtggcgggggcgggggacagcggcacaaatcgcttgaattggtaaaaaccattattttttattaatcaatgctagattatccctcccccccccctttttataggtccaccggaagcgactgccccctcagggcgccttctcttcgcaggaccattcaatctcggcacatcctttttaaatgacatttagtagtcaaaattgctttaaattgttaaggcgacgtcgcccga

SEQ ID NO: 34402 - DNA, 240 bp, Heterodera glycines
cggtgtcatctatgttactagatcggggatcgatccccgggcggccgctcgagcaggacctgcagaagctagcttgatggggatcagattgtcgtttcccgccttcagtttaaactatcaagagagggaggtgggtggcggaagaagaaaagggtggggggagtatgagtatgatggtcaatatggagaaaaagaaagaggaaggccaattttttcaattcaaaaatgtagatgtccgca

SEQ ID NO: 34403 - DNA, 1305 bp, Heterodera glycines
ttatatgaaattatagttgactaaaatatgggagggcattttgacgagagaattggcaatgaatgccgcgccgtccggcacaaagaaaagaaaaaggcactttttggcgggcattttccatgcccataaatttttttttcttcttctcttctttcccattggccataaatttggttgaaacaatgggcacagaataaattgaatgtgttggttaaggccaaggctttctttcgcccacgcgcaaataaatttttaatcatttcttataaaaaaaaatttcttaaaaatttatatggcaaaataaaagtcgaccccaattgtccaatggatacttttctgtttttagaccccccccccccgaaattttcaaattaaaaatattttccatagtaatttgtgacgctgatcacaaatatgaattacggtattttcgatggcactttcatcaaaaattcgaatttcggcccaaaaaataatccggagtaaaaattgagttgtggccggccaattggtctttcattatttatttctttgcagaatgaatgtggcataaaatgaagaaacattaaaattgtttagattaactataaatattttattataaaaatatgttttaatttagaaagcaaaatagattttacaattagtttttatttttattttaaaattaagatgcggtttttaagggagaaaattttaaaacaatttaattgcatttattgaattaaaaaataataaaattgaattttaaagaaaaataaaattattctcttttttagatgaatttcttctttttagaataaaacgcaaaaaatgttttcttttattgaaacttaatttttcgatttttttattttatgttacaacttaatttatatgtagaaatttttaggtaccaataggaggcgtaaaatcaaagagtttcagggataaaaaagtttcgaaataaaaccgcagaaaaaaataataaaaattattaaatctgtgtccttatgatatttatatacaaaaattatttgttaaagataatttttctggaatttataaaaaattggcatcgccttgagcaaagattcatttaaaaaacccaagggcagtggtggaaaatcaaaagcagaaattcaatattcgtgtgcttttgcaactcttttttttttaatttgctgattgtgtgtaaaattaatgaaaataaatcaattacttataaatagggctgggatttgtatgtgctaaaaatcctgaaatatgtaataaaatatgtgctaaaaaacaaaaaaaaggcctaaatatgtgttaaaaaatgca

SEQ ID NO: 34404 - DNA, 836 bp, Heterodera glycines
ttatttgttttttgcataattaattcataaatatttttttcagaaactgctctgaaacgcaccaaattttatttgcaagttattttaggcactcagatgctttcactatcaaaaagggagatgaataaaaaatctaaaaatttttaattgctttttaaatatgcgaaaaattttaggcttaactttttttttataaactggtcagaagcgaaccagattttgcgagagcatcaaaaagacaaggaaaagcactgctatgatgctaactccagtaattctgaatttaaaattttttattaatttttaaagcttcactattttatttttttagcaaaatcaattcataaatattttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattttttgcaaaattaattcataagtattttttcagaaagtgctctgaaacgcaccaaatgttaattaaaagttaaataaggctctctgatgctttttctatcaaaagggagatgaataaatattttaaaaatttttaattccttttaaacaggccaaaaagtttaggcttatatttaa

SEQ ID NO: 34405 - DNA, 1044 bp, Heterodera glycines
attgataagttgggacggatggacgggaaatgaaaaacgatcaaagcgggcggaagcgggagaacctgttgaaggaagcagaatggactcacggacgaagggaagaagcgacttcgttcgtcctttcgtccgtccgtttcactgtttctcccccccccccccgcccattttccccacttaacgcattggccaattacaatacaacgaatgatgcattttatgtgatcgataagcacgagaaaaatacgatgcagaggttaatgaaggaagttggaaagagtttggaagcaaatgaagtggaagaagaacaaatggtggcggaggacaattgaggggtgaagggatgaggtgatgagcaattgcggtttgagtccacgggggaggggacaaatcggaaaaatggccattgggggggggaaggagggggttatcatcatatcagcgagagaaaagcacgggaatgggaatgaatgcatggatggagcagcagcagaaaggcggtggttgcgaaagtttaaacacaaataaatggacaaatggacgacgggggaacaaatgagcaaagagtgccctccccattgctaatgcatctgctgactgatcaatggtgcctttggctaattgccctgatatgtttcccatcttcgttttttgcattcgtcgcgcttttccccggggcgccgttcgccgttttcaaacggaaaatttgggcgacaattgggggatgggctgccacgagtagcggaggaacatgaacagaagggaaaggttagcagcggagaacacaaagaggaagaagtagtcgaactgggcgaacacgcggttccattccttttccacctgaacaaacgaaacaaaacgaaaccattggccaaccgccgaaagcatttcaccgtcaaatgccttttccgcttctcaattttcttcgaaatatgcgcttgagcacgacgaattccttcagttgcgaattgacgggccaccaaaacgcgcggggtcgacgaaaagggctaaaaaaatggaaggcaattattcagctaaaacttc

SEQ ID NO: 34406 - DNA, 830 bp, Heterodera glycines
  misc_feature (53)..(53): n is a, c, g, or t
ctttagcccctcagccccgccccccccccccccctgcccttttaattggaagnctggaggacaacagcccatacattttcctttgcttgttctactcattgtcaaaaagtactaataataattccagtccatgatgagaccgtttttgggggttcgtcgaattatctctgtttaccgcacaatttccggtttacgacccttcgattgcgttcaacggacattgacagttcccatcgaagggaaagcgccgaaacgatgcaccgccgaggaagcagttcgggacatcgaatcaggttggttttgctgaaaaatacatttttggttaaggcggaataatttaagggtgatttatcggaaaatataacaaaactattatttgcctccatttcgtgattaaaccctcagatgaacacatttacttgcatcatgccatgtcgtgtcccaccgatttactgagggctttcggcaaacacatcgaaaagaacgatttgagaggaatccgtgcaagccatgccttaacttgcggcgaagtgagtgccgctaaaaccaaaaaccaataaaatacacaaattttgaaggtcccatggactgatgagaagctccatgaccgagttcggagtacgaccattttcatttgttcgaattttcggaaattggtgaaccagggttcgtatttggtggatggaacgttacctaaacaaaccaacaggaaaagccgactatttgcccgtctttctgtcccaatccgcgcgtctttacgatgaaaaagttcttcgagttgatactgtaatgcttttgaactttccaattaacagtaagagtcttccctt

SEQ ID NO: 34407 - DNA, 906 bp, Heterodera glycines
ttctcaatattttaatgttaatgctaaaaatataatattatctcaaaaaaatcaaaacttaaattgtacaatataaaatgaatattattagtaaatattaaataaaactttatttaaacatatagaaatgtcgcaatttgcgaatttttcccctcatttgattattgtccccaccattgccaatccgttgccctcatcgggatatttcttcccctccccgccccctttttcatcacataagcattgttgagatttcccacggtgataagagctttattctgcccatgtgtcttcccctggctcttccgtttttgctttccccttttttttcttctcacttgctttatctcctttgttttttcaactcgtcccagcttccgccccttttttgctattaattcgccttcagtaaataaagtgattaaaaccaaattcggtctttgcttttgaggttttccgattcgtaaaatttggggtaattatttttccacgaatcgcgacacaacggccgggaatgagcgcccatttccgaaccaccattggtctaatccatcccgatgctgtccaaactgtgagtaaccagcgaaatttccctgtcccagcccgtccccagggccaacccgataatgttttccagcgacaaatccaaaccatcatccatgacctggatgatgaagcaactgacgttagcgatttcttaacccaattaaccgacatgagtgaccgatggatgagcctccgtaccagcatgactggcaacgaacgaactgcggataacactatttatgatgacttcgttgccgcaaccccattcccacagactttgaatgaccttaaaaggtacagccgttccctccgagaccagcgccgtaaattggcaaaccgcaattccccatgcaaatgttc

SEQ ID NO: 34408 - DNA, 1071 bp, Heterodera glycines
taaccaggtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagcctttatggaagatattatgagatctcttgggtccatctcagctgtcaacgccgcgactgcatcgttattatatcagtcgatagaattttcgaatcgcttttaaat

SEQ ID NO: 34409 - DNA, 733 bp, Heterodera glycines
aaaaatcccaaaatatgtacaaatatgtataaaaaccccgaaatatgtaaataaaagtcggtttttgttcgcaaacacaaaaagaaagtgtttttcctgctatttagagcatggagaagccaggaaaaaaaatgtatttacataaaattgacatccctataaatcacccatttgttacaccaaaagcacccccactcacccattcatttgtgttggcatcgctgattttgattgttgcaccaggatcattctgatcacattttgtgaagttcatatcaagccgaatgcatgaatataagtcattatttgagcgttttggcgtatcttcatcaaggtagtaggtcatgccattcttatcattgcacatcaattccccaatataattcaagacagtgtttggccttacgcatatttcaatggacaaattaggcggaattaaaaaacaaatgatggtggtgacagtaatgatgagaaaagcatgctctaaaagatttctataaaattattatttttttaataagtgaaatgggtaatcactgagtaaaccgtgagtaaaaaagaaactatagatttattattttctaaaagaatgaaactaaaattttcaaaaatattaaaaaattaattttaaaatttatctttcttaggttttcaaaaaaacattcaaagatgtttgattgcattgagcattcttttggaattgtttaatataaacacaaattttagacatttt

SEQ ID NO: 34410 - DNA, 916 bp, Heterodera glycines
tacatcaaataaatcagccctttctgatcagtcatataagattcggtgatagcccggacaaagcccgctgatcagaacaaaataaacaaaacaaacacccaatcaggtcaggttatctgctgaccagaacagacagatcggttttatagacaaactgaaggaccaaaacagttgatccttccatggcatatttgtttcccctttattaatttttgaacacatggaagtggcatgattagtttgaaatgccggaggggcgcccagtcagcgtccgccacattactaactaataaaaacgctgtctgactacgatcatctgttgatcagaacgtttttccactgatcagttgctgcccttcccctgagaagtgaaagtcgcacccatcgcgaggcctccggtgatgtattgggtgaggggaaagtcgcaaaaggtcgcgccggccaatgccatcgcggagcaaagaatggcaccaacgacaaggccaagcatgtcgacgacgccgatgaagaagaggattttgtagcaggacagctgcagatgcttccaaatggagcacatgcaaagcgcgtacaaaaactgagcccgaaaagaaattattgcatttaatgggagaaacgaaaatatgtgccattttaggactaactgaacatccttagattcagtggaaaacttaatatatgtaaacacaattgggttagctttgaattcgtacattggggcgaataatgcacaaattacaaaaggaaaatgttacagtatccattttcatatcattttcattgaattttgaatgaatttaaatttgatttttacttctgacaccacggccaaaatgagctgcacaatggcgagcaaagggtgcgaattggccggcgctgaaattgtggtgctgacgttggcacatccgtactcagc

SEQ ID NO: 34411 - DNA, 1199 bp, Heterodera glycines
ttttattttaatgcttttaactgccctttataggcttttattttgccgtttttctcccctctctttctctaattttctctctgcaaatggcacttggcctgttagccaaccgatttgggcttttgggcgcctttgtcggcaaatacgctatttcgtctgtgctcatcactttggcactgctaatgccatcgctaatcaccgcctttttttgggttaaatttgaagttgggctcgacgaaggctttgttccagaaaacgcaccttcgaggagagaaatcagcgcacagaaggaattttttggagagacagtaacaaaaattaaaaaaagaatgagaattctggtaattttatgcacacatagaaccggtcaaaagaatggtatatggcactgatcggagtggccaaggcgcccgaggggaatatgctccaagcagattatttcggggaactcagtgcattctatgatcgggtcactcaacacactgtgatccgtggacctcggggttaaccatcggcgaacgccgtcaaatttggaaatgcctttagggaatttcacctacgctcaaatatgtgccgcccccctctgcgaaataaatgaccaactccaaaaattgatggtaattacatagtcagtggtgttttgtattcgctggcccccaagaacaatgtttggctgaaaattcttggccaagtgcaaatgcgatatccggtaagtcgcgtgttcggctacgacgtgaacattggcaaggtgagcacttctcgagaacaggcgcaagaacattggcatttgtctaaacagcacgtgttcgatcggacagtggacgaaaatggcgaactgatcggggccaaattcgttgctttttacttcgcatcttttagccgtgaagagcacagagaaaaggaattggaactgttcgaacaaacggtagaaaggtgggcaaattgtgcgaaggtgggaaaaagcctttgctaattggtaagggaagcggaaaagcacaacgcgcgaaaggacaggcgggtggagttaatcgcgcacgggtccaacacagtggccaaggaaatggccagaggggtactcgacgccgcaacaaataaactcatcggtgtgccattgtcaccctttgccaggaccgtagtcatcccttggtcaggtttggctctgtctgtgttctcctacttggccctgcactctttttgcc

SEQ ID NO: 34412 - DNA, 951 bp, Heterodera glycines
  misc_feature (938)..(938): n is a, c, g, or t
ttctgcgttggatttttgctccccataaatgtttgactacccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacactcgaaaaatcgatttatttgtgttttcggagcagtccccccgaaccgatgcgcccagatttatggngagacccgatcct

SEQ ID NO: 34413 - DNA, 1002 bp, Heterodera glycines
aataatgcaataaaaaatatacaacggaaaaagggatttcgtttccgaaatttatccaacaataaagaataaaatctataatctagtttttcttgatgctctttttatgacaaaaatttttttaaataggaagcaattattttgccttttccattgacatattcattcacttactccaatttttccccttcattatccttttttttgtgccaaagtgggcctcctaccatatgtaaatccaattccctggcatttttcacatattttataatcgacgtgccagatcatcgatatttaagccccacagcaattaattagaaaccgaataagaaggcattttcattatcgacgaggccaattcatcggtatttcagtccccaaaaataatcaactcatttctcctaatcaagtcttgagtctctggaaatttgttttgccaattttgggtcacgcccggagccgggcacggatttttttaggtaggaagcacggattatggctttttacgttgattttaaaagctaacatttttgtctttatttttataaagctaaaaatgtgcttcttaaatgaaaaatttttatctttaaatataaaatgatcatgcttgcattaggttaagtatctctctatttgtattaattgttcattcatttctttttcaccattgattcgatcagaaccggcaatattctgtacttgtgtctctttgctagcccttggaataggaaaaattcaaaaatttaaatttaaaaattataataaattacggctccgtcatctacgatttatggtctagcaaaattcattttaattgtgttttcttttgttttattttgtcaaatattacccatttttataaacaaatttgaagaaaattttataattttaccaaaaaaatccctgagaaaatttgtgaaacaaagctcaaaatttcacttctttgaaaaaagtaaattaaaatttatgtcaactaaaaaatacattataatgctcttttat

SEQ ID NO: 34414 - DNA, 915 bp, Heterodera glycines
  misc_feature (58)..(58): n is a, c, g, or t
aaacaacattttgagagagaagcgttaattaggtaaatgctaattcatttgattaatntgggctaattagtcaaggtcagatttataaagacacaagtgcaaaatttagtcttagccaaaaataaataatttataatggatcaaataaaaataatatttaaatttaaattcctaacttttttgtgatatttgagaaaatataacccagaaaagttgtattcttttttttcaatttttacaaatttttaaatttattttatatatttaaaaaaaattttgtgatttttctaaggacacttaaatatgtatcatcattctttcttctaaacaatctatgtacaaatccatttgttttgtatgcatttttttattttttggcgtttcgtcattgcgccaaaaaacgaaatcgcccacttttttggctgtgcttttttttgccgttgtgccaaaaatggattttcgtcccccgcggacaccgaccgacgagggattctatggcatatgtaaaagtcataagcagagagcattgaacaaattaagggtccgggtggaattaaattagggggggggggggggtctttatttttatatacgaatactttttaaattactttcatttaaaatgagagataaaggaaatttaattgacttatatttaaataatcggccgaaaaacctgaatctgaaggattccaacaattcttaaaagatatttataaaatcaaaatacgcaataactttatattctagtaccctatattttttatcccctgacacaataaatcatcaatggaatagttaaatttattttagatactagaaaaataatcacatttaaccccgagaattaagttatattaattccgctaatataattggaatttttatgaaataggaagaaaagttaaaaatgca

SEQ ID NO: 34415 - DNA, 1565 bp, Heterodera glycines
aagggcatcacagacctgttattgctcaatttcgtgcggctgaacaccgaaaatccctctaagaagttgtgcccacagaagcaatgagccaactatttagtaggctagagtctcgctcgttatcggaatcaattaaccaacgcaaagcacatacgactaggaactttatacaaatttaaaaaagtaatattttgtatatgcatttaatcaaatttctactttctttataaatgttagctaattagtcagcgtctatttattttctgtaaaaatttgcctctttatttaaaattaaattaatataatttcatgaaataagtcactaaatgtatagagaatgaattaacgtggtcgattggaataaatggaaaaaaaagcaaagtcaaaacacaaaaccttaaagcactagccgattgaaataaatggaaaaaaaagcaaagtcaaagacaaaaccttaaagcactagccgattgaaataaatggacaaaaaagcaaagtcaaagacaaaaccttaaagcactagccgattgaaataaatggaaaaaaagcaaagtcaaagacaaaaccttaaagcactagccgaagcaaagtcaaagacaaaaccttaaagcactagccgattgaaataaatggaaaaaaaagcaaagtcaaagacaaaaccttaaagcactagccgaagcaaagtcaaagacaaaaccttaaagcactagccgattgaaataaatggaaaaaaaagcaaagtcaaaacacaaaaccttaaagcactagccgattgaaataaatggacaaaaaagcaaagtcaaagacaaaaccttaaagcactagccgattgaaataaatggaaaaaaaagcaaagtcaaagacaaaataggaactttatacaaatttaaaaaagtaatattttgtatattgtatatgcatttaatcaaatttctactttctttataaatgttagctaattagtcagcgtctatttattttctgtaaaaatttgcctctttatttaaaattaaattaatataatttcatgaaataagacactaaatgtatagagaatgaattaacgtggtcgattggaataaatggaaaaaaaagcaaagtcaaaacacaaaaccttaaagcactagccgattgaaataaatggaaaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaataggaactttatacaaatttaaaaaagtaatattttgtatattgtatatgcatttaatcaaatttctactttctttataaatgttagctaattagtcagcgtctatttattttctgtacaaatttgcctctttatttaaaattaaattaatataatttcatgaaataagacactacatgtatagagaatgattaacgtggtcgattggaataaatggaaaaaaa

SEQ ID NO: 34416 - DNA, 1353 bp, Heterodera glycines
agtttaaaacattgatgcgaaccaaactaaaacgtttatgaaaattttgcagcaatggagagattttcgagaaattaattaaggattctttcaaataattcaaaaacgacaaaaaggaagaaaagagtaggtttcgtaaataattgtattaggctgaagaacaatgaaagtgaaaagaaatgaggggacgaatgaatgaatggccaatccatccaaaaaaggcattctcatacaaaggataatcgctcagttggggggggggggagagaatgcgcgaagacagcgggggggggattgaaaatccaaggaaagaattgggcaaatgtcgttgaaaattaatgaaaaaagagttctgaattgtgcttatttggaggggttgagtcttagaaatcaaactaaatccataaaaagtacttagaggcgcctattggtactacctgaatcttcaaacaccaaacaaaaaatggcccattttcggacaaaattttcgaattatgtaaaaaatattgagtgacggaataaaatgaaaggcactgtcaaaatatttgaaagaaaagcaaaatgaaaatgccgaatatgcattcccaaaacgaagaatgacccgttgaatagagagaatggcgaagtatcagttaaacggactttgcccaaagcaatggaaagccaaaaaaagagagagagaggcgagggagagagaacgagtggagaaagagaggaggagagagaggaaggagagtgaaggggagagaaggaatgatggccaaaggcgaaaaaattgaggggtatggaaagggagaaaggaggatgacttttgggcaatttaggaggggggggggggtcatttggtgtcattacgagtcaaatgcggcaaacacaaaaagtcaagcagttcaccaagcccctttatgcatttccaatttgttgcgcttcaatgagagcaaaagccctcccctgcgcaagggtcatagaagaaatggcaatgttcaaacaaagaaattgatacggtggcaaagcataaaccatcctccttcacagtttatttttattgcacaaaccaagaaaggatattatgacgagatgaaatcggatcgcctttcccttttgggcactcattcccccccccctttttggcctttgtgcaacggcacaataccgccgccgtttaggggatttgaagggtcaaaagaaatcgacgggtgatcagtgaacacccaccagacaatcatttggcccaaaaatcccacgtttttttttgagggggggggcggaaagcaaagaacgaacggaacaattgaccactggcgcacatataaataacaacaaacacataaatgctaatgatccttctctttg

SEQ ID NO: 34417 - DNA, 939 bp, Heterodera glycines
acaaagacagcgaattcctttcccaagaacggacaaaatgtataatgaaatgaatggtattgattctaaacaacggacggcagaaaagtgaccagtggactgcataaatatgaacaaaaactcagaggacagcttagcacacagatggggcgaggtggaccaattggttggccgaaggacaaaaaaaacaatgtttttttccttcaaattttggtcctttaaacctctcaaattgggaggggacgccacagaaaatgcaatcatcggatgttccatttttaaaagctttcttaaagggtgaaaagggttaacgaatattttatcggttgtacgaggagaattgaaaagaaaaggaacctttttgaaaaaatttggaaggtggaaaaatgctttttatggggggaggggtgaacccagcaaatccaaagcgcacaagtactgaaaatttctcgagatttgagaccaagtgacccaaaaatcgagattgaatccgagacttaacccagggagtcgagaccgacttgactcagagacaaggacttggtcccgcaactcgagaccctaacctgtcgagacttatctcgagtcgagactctggaacagcactaggatacagcatcagtaataatttatcatatccagtacaagaatgaatatttttacctgctgtgcagagtgatgggagccgggcgtcgactgtgagggcgggtacgggctgaggaactcggagttcggactgtgcagacattccgctcccgtggcctgcccatcgcctgagcggaaaatgcaataaacatttacatttaatttgcaagaagaaaattcaatgcaaaataaagaaatgaacaattggtaggaaaatcattcacaccttcggcacaccctccgcccgcggcattcccgccacagattgacatgccgacgaggcccggtgaaggc

SEQ ID NO: 34418 - DNA, 992 bp, Heterodera glycines
ttaatcgcaatttaattatttcagtaaaaccaaatccctctttatgttttctttgctttggcaagtgtcagcttttcctttgtctattcgttcacaattcaattggcaccatttgcattgacggcgcatgaacagaaaaatgaattttgtaactgacgaaagaaatggtggtggcaccaaaccccccaccattagagtttttacacatttttgaaaatagttaaatttctaaacaatttaaacaaaaaaaatcagtaatttgccgaaaatatgggccacctcttgaaactgttgacccaatcagggttcctttgttcgttcaaaaacgcaattgcttgggttggccatctttgatcgatgagaattgacggtgaaatgagacgacgcaaatagtccaacgaccaccatcgacaaagcccaagtggcgaatgtttgacacaaaaattggccatatttcaccagcaaaaatgtcccaaatcggctggcgaatccacaaatgtaattcagtgcctcttttgtcgaaaatttggtgatttgaacgaagaaagccatgacagagtgatcaatgtacctaaaatggatggaatgcttttattcccatataaaagtttctttggctcttgtggagtttagacccaatactgtaaatttagttgaaacggaaatttgatttttaccaaatttgagtttggggttcgaaatgagtcgaaacggaaattcaaagcgaattttgctggacaacggacggtcggacaatggaaatggcacagaattgacagcgccgataagcacaaataattgtggtgccgttgttctgacactgaccttgtgacgaatttcgattgctctccaaattgtcaattcgctctcgtcatcaacatgtttgtccacaaacgcattgaaacgtggcgaaagcaatgccaatttgaggccgagttgaagacggtcaaaaaaggaaatgtcatcaaatgtcgttgcacacacgcatctga

SEQ ID NO: 34419 - DNA, 374 bp, Heterodera glycines
gccggaccctaaaaatcctttttttttcaattttactcaaaattgcaaaatttggccattttgtggacaaatctgttaacaaatcaaattaaaaattacaaaaattttcccggtggcgcctatcggcaccgccggcccctcaattccccaagttttttggaaaaagcgccgcaaaaaaatcaacgtcgatttttcatgctcagaatctcacaaaatgcttatttcgaacaaaaaaatagctcaaattgatcatggacagtcaaaaatataacatttgaacattttaaacgtgttttgaataaatttgtaaaaatgaggcttttcgacccaaaatgaggctttttaaaattttcatctggcaaccctgattatat

SEQ ID NO: 34420 - DNA, 888 bp, Heterodera glycines
ttcctggtgctgctttttggcatatttttaacgccagctgcagtgaatggtgaaattgatacgttcaaatatcgtccatattttggcgaacctgtgaaccatcattatcatcatagctcggcagaggtctctgacctcggggccggatggtaagaaacagggaattaaaaattttttaatttaataaataaatgattttcgatatttttaaaataaagtgtccatttttcattattacaaattcaaaattacaatattatttacaggagaataatacagattaattaaaacatttttaataaaattaatttttaaatgatttaaatttaaaatttcagggatttttgaacgaccaaacgctgtttgatttacacgtcaatttttgctgaaaacttgattgtttcacttattattcattgataaataatgatttaatgactttcatcatatttaataatttaataatcaaatttcaaaaaaaatttctcgagcggcgtcgcctggtggcaccgccagacaattcttattttgtgaaacaaaataaataaattttgaagttgtttatatattaaaatttattaattattgaatgctttaattggagtaaaccaaatcccgtcttggcaaatttggactttaatcccacgtaaataattaatggaagagagaaaataaatttttcctttatagtatgttcaacctttagaaatttttcctaaaaatttggggtgatctgggaattgaacccaggacctctcgcacccaaagcgagaatcataccactagaccaatcacccgaatgcttttcctcgggggcatacgcaatttatgatctcataagcgcgtatttacagcaaatgtggaacggttaaataaacagtcattttt

SEQ ID NO: 34421 - DNA, 1058 bp, Heterodera glycines
taagtgaaatggcgtttgaaatataaggatgcgttttgtttatgttctaaaaaagtatgtcctgtaatgaatgcataaccgatacctttgggattttgtaccgagcacaaaaaaatttttattttgcattttttatatgttaaaaaatgcgctgatcaagaatttgaggtatggatgaaaatcgtagaaaaaatccaatgatttagcaaaatgcaatctcagattcatgatcagtgcacttttaaaaaacatgtacaaatcaaagaattttattaaacaaaaaaattcgtaatttttttctgttgtctttttacgtcggatacaaattagaaataattatccagtaaggaaataaaattcaaatacattaaaatgctcactttctgcacttggacaaccatcgcagcttttgctccagcgccatcgccttgcttcaaaccgtctgcaaaaaaaataaaatttcaattgcgacgtacggttcgaatttttttaaacccactttcaactatgcggacacttttgtccattccgatgccaagaaatgagctgttggtccggaagtagggcgaatcagcgttggtgaagcggtgttcctccggacgcatcagataaatggaggacgcactgtagtgcatgaattgtccattcctgtcaaatggcagagttagtgagtgtaaaaaatatgtgaaaattgggcgaaataaacgactaatgaaaattgggcatagaccccttggtattttacggcacaaaattttttttgtgacggcacctttttgtggttggttcacaatttacaaaagaaaaaaatttaaaacatgaagttgtaagtccgtacagaaagatagaaatcacattcagagagtgctaatgtcaagaggtgttccccgcgccccgtttttgtaaaattaaaaaaaaaattttttaatttttgagcgatgttttaaattttttgacgaatcacaaagttttacaactattttgactaaaaagttgcggaagttcaattaggaaaatttttcatttttttaaaagaaatttcgtttaaaaatctttcg

SEQ ID NO: 34422 - DNA, 978 bp, Heterodera glycines
acttttatgccacctaaacattgttgcgggctcaccactggcgcttttttctatttttttaaattttgaggcgtggcctattttcataactttatttttatggggtttcatttggaattttgaatttcttttattgtgatagctttatattatgtcttttgtgcaaagtttgaagataaaaagctaaggaatttttggaaatatgtacaatttcaactgttaaaaagatgaaaaatccacacaaaaattcaataaggtttttagaccagcaaatgatatgagaatgacaaaaaaattttatgaccttaaaattccttaatgtgtagaattttaagttaaaaatgtaaaaagaaaagaaaatttaataaataaaaaaattattacattttatgagaattttattattattgcagaataaaatgaaaaatattaaagtacgcaattagcagataaatctttacttttgtatatgcctaacttaaacaaataaaatttttactgcaaaacgaattgcataaaaatgttaagtcgagattaattaaattattcgtttatcttataattattatttctaatatttaaacagagaattaaaaatctttttttaaagaacccctttttttattccattaaagtattttgaagattatataacttaaaatttaaagaatttgttgaatcttaataaagttaacgcaagtagttcattattttttattgataaaaaataaaaatgaaatataactcctattagttagaaataattgtatgaattaaatggaaataaaattgacaaataattaataaccaaaaaacgcgaaatggacattattaataggcacaaaaataggcaaatgaaaatttttcttaacactttttaggtagcaaaacacataaaaaacttttaaaaaaaacttaattttaatttgtggttcaattataaatgaaattatggaaataatttttaaaggttttttt

SEQ ID NO: 34423 - DNA, 754 bp, Heterodera glycines
cttcattttaattatattttttgaccaaccaaattaatcccattggaacggaaaagaaaaaattggaacaaaaatcatttgatgaaatattatggggaaaaatgggaagaaaaagaagaaaaacaacgaattgaagagagaaaaaaagagaaataattggcaaattccataaaataaaagaaaaaataaagcaaaagggaagaaaatattcagcaaaaaaatggaatcaaattaattcgaaaattgcgaaaaaattggggacaaatcgtcaatatatttataaatggaggcaccactcggcacttttcccttgcctaaatcatgcgaccagcaaacatcatcgcccaattatttgtttgcctccccgacccctacgcctcactccccttgggaaagggacacgaacggcattagcgaatcggaacggcaatttgaagagtgagtggagagactcccccaccagccaagagtgagtctttgacacaagccaattattttttacggtccaagtcaattaacttttaatcattaaaattatatttgtaaccaaaaagtgacatgaataatcaaaaggcgtcagaaattgcacttttattaattgggctcattagatcctttacctaggcaataaatgagttgggcaacaattagttacttttcattttcaacatttgttaaaaagccatggtgatgcattttaatttaaatttgttacaaaattttctataattcatataagaatttattggcatat

SEQ ID NO: 34424 - DNA, 880 bp, Heterodera glycines
cgacctccgcccgctgttcgggggggggggtctcgtcactctttcgtccccaactgcaccaaccattcgtccccaactgcaccaaccaatgctgacacacacacacaaacaacgggccgctgctggaggggcggcgctcgcccgtggcgcgaagggttgttggccaaatgttatcgattaactgggagggaatggacgaggggaggagggcgagcacagaaaatgggggggggggggtaaataaatgagggaaagaccgaaaccaaagggaggggaatgactctcgccaaaatgcgagtgaggggaacaaggacaccgagaaattgaaaacgaaaggttgagaaaagacgggtaatgatgagaggggagccggggggggggggggaagcgggcgggcggagataatgaaaataacagccagcgccggaggggagggagaaagaacaacggcggtgtggggggggggggaaaacatctcacacggtagatgcgcaagctcacaataaaattatgatctgtaaaaggcaactaatacaatataaaacctaagcctatgcctaagactagacaaaagaatctgatccttttaaagagattttgagcacaattaatgcatacatgcctccaaattagcccaaattttattacgtatttcttgggagtttggtcaatattttgatgattttgtgtttgctgacacaaaactccaatttttcgagatctgattatttaataaactcaattttatgttgagataaaattctgaaaagattcatactaagctatcttttgatactgatcaaaaaagtcttttggatcaacttgatcagatcactccttcatggggatttgaaaagtcaaaaatgccttgataacggga

SEQ ID NO: 34425 - DNA, 701 bp, Heterodera glycines
ttgccgtttttaccctgctcaatttgccaattccccccccttaggcgatagtttgggccattgcacttcccccgcccttttctttgactaactgccggcccgacaatccaattccctcccccccccgcccttccctttcgcctaactttcgttttaaagacacactccccgtccattccttcaacttcggtttaaatttgctcacttcaatccttcatttaaaaacacgaacattccctaagggcatatttcctcaattttgcccggcattttccgtctttttgtccctccctttctcaaactgttttctttccaaatccgattctctgttctgtgcatatttatgtttctcgcatctcttgatttttgtcgagaataaaggcgctttatgcgctggggcggggggaggggggggggggatccgcaatttttttctctataatataaattttattttaaatttttatcacatttttaaaaaaagatataaaaataaaagtgattttgtgattcgggtccaaagggggtggacaggatttttgattgaaaaaattttttcacaaaaatcttccaaaaacatgtcattaagggtaatttgggccgctgatcatgaatacgtgatcagattttacgtttgacatcgttaagccctagaatccctgtgtgattggggattctgagacatcattttgagggggggg

SEQ ID NO: 34426 - DNA, 958 bp, Heterodera glycines
ctgctcaacagtaataggaattccaactgcattctcactctattacgccgatactaattgttctggaatttgtttctctgcgcgtttgtttgtgaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaactgcattctcagaataattacgccgatactaattgttctggaatttgtttctctgcgcgtttgtttgtgaaaaatttggaaaattggctatctctttttctgctcaacagtaataggaattccaactgcattctcagaataattacgccgatactaattgttctggaatttgtttctcagcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgtgaaaaatttggaaaattggctatctctttttctgctcaacagtaataggaattccaaccgcattctcagaataattacgccgatactaattgttctggaatttgtttctcggcgcgtttgtttgggaaaatttggaaaattggctatctctttttctgctcaacagtaataggaaatccaccgcattctcagaataattacgccgatactaattgttctggaatttgtttctcggcgcgt

SEQ ID NO: 34427 - DNA, 920 bp, Heterodera glycines
agttaatttgaatggcttgaaaatcaaaatttccatgtaaaatttgctaattaaaatacctccattagtttattgaggcgttgaattagagaacatatttccaaaaggcgcggaacaatgagttggcataaccacaaaattacttattatacaaaaattaacgaagttttctttctgtatcccaagaaaattgcgggccgaaaaaactcggatagggagttcaggacggtcaactgaaaaaaaaagttcgggtaggatttcgagttggtaaaattgtacgggcaggttttggcatgtgccaacaaaaaaaaaagtgccaggggtgagttttatttacatatttttacttaaatgcctgaagaaagttataacaaatcttgtgccaaaaaattgccatggtagcgcaataaaaccgttcaagcactaatttgaatgactaatgaccttcgtccccctcggtttcgctttcgttgtaaccattgtaggcggcgccaccgtgagatggagctaattgtgccacccgaagaagtgacaacagtaaagcaatccagaaaatttggttgcgaagcattctgtttttgtgagacaaataatttaaaaatggacttttttaacaaatatttaatatatttattttttttattatttacgaattaaattatcttaaataattttatatttttattgaaaataattttattgcttatacattttacaatatttattataaataaatttattatttttatatatttgagcaataaatgaatgaaatactggtagaaacataaaagtaagattacgtgttaacgttttgcgtaagcatatgggcatttatagaattaaaattgattgaaaaaaattatttcatatttgcatattttattataataatgaaaagattatataaattttacata

SEQ ID NO: 34428 - DNA, 982 bp, Heterodera glycines
tagtagcgacgaccctaatttttctggatttctttctgggcgagtttggctctgaaattttgaaaaaacgtctatctctttttctgctcaacactcaaatgaactccaaccacattttcggaatagtagcgacgaccctaatttttctggattttctttctgggcgagtttggctctgaaaattttgaaaaaacgtctatctctttttctgctcaacactcaaatgaattccaaccacattttcggaatagtagcgacgaccctaatttttctggattttctttctgggcgagtttggctctgaaaattttgaaaaaacgtctatctctttttctgctcaacactcacatgaattccaaccacattttcggaatagtagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggattttctttctgggcgagtttggctctgaaaattttgaaaaaacgtctatctctttttctgctcaacactcaaatgaattccaaccacattttcggaatagtagcgacgaccctaatttttctggattttctttctgggcgagtttggctctgaaaattttgaaaaaacgtctatctctttttctgctcaacactcacatgaattccaaccacattttcggaatagtagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggattttctttctgggcgagtttggctctgaaaatttgaaaaaacatcgatctctttttctgctcaacactcacagaattccaa

SEQ ID NO: 34429 - DNA, 698 bp, Heterodera glycines
atgttggaccaatttaacatattctgttcattcacttggtggcaaagtgacatcgatggacatgtcgaaacagtcgggcctgaatcactcgaagcttaagccaaagggagggataaagcaaaggtcggaccaggtcagcctcgtcgtgccattgtcgtccctttggctcgggtgactgaactgcgggttggccaactgcaaagtgatcggactgataattgaccagtgctgaccgataccttaatggattcggtgcattcttcgcccgtcaactctctgcagcatgggccccgccgggcatccttcagccgagtgatgaacagattcttgctgatcaccgcctgttgttgcgagtgatcaaaaatgcagaattatgtttaaattctttttatattttacctcatatgatcgttcgcccactttccgcacagaacccgtcccaatcggcacgtccctgtcgttgtacaccaccgtatttccattcttgtccgcaaccaccttgaaggacaagccctttcttccaccctcttgtactgtctcttcctttccttctccgactctctcatccccctgcactatctcttcctctatttctttctcccctccctctctcttgcctttcctgcgctttttccctgtgcgtcgtagcattgtgatatccccggcgtctccgccgtgcaataatacttttccgcgcg

SEQ ID NO: 34430 - DNA, 716 bp, Heterodera glycines
caagaacacagatattaaacaagcacaatccgcacaggtaaagtctttgtcagactacaatccttcgaaggggcaggtccttttacaggaatgcagaaaataaggtaggtccagatgccatttctggtgcgaatccaccaccatagcatgtcagatccgcaatcacacagaggggcaggccctcgaacaatgctttcagatccacaattccgagaaggggcagctacatgcactcttgaaatgtaactcactatgtatttcagatacacggtcactaccatagcaaatctaaaactctatgaatggaagggccaggtcctagaacacatatggtcaggaccacattcccccgaagggtcaggtccacgaccaatgctggtcaggaccacaatcccccgaaggggcaggtccacgaccgttatgatcaggaccacaatcccccgaaggggcaggtccatgaccaatgctggtcaggaccacaatcccccgaaggggcaggtccacgaccgtttggtcaggaccacgatcccccgaaggggtaggtccacgaccaatgcgtatatcctacgttacctctcaccagtccactggtcttggcaaagtgcgggaccagcttcgccccggatgttggccggtaacgataaggaaacctttgtaaaccttttggaccacaatcacccgacggggcaggcccacgaaccacaatcctcaggggg

SEQ ID NO: 34431 - DNA, 1073 bp, Heterodera glycines
  misc_feature (215)..(215): n is a, c, g, or t
  misc_feature (228)..(228): n is a, c, g, or t
tttttgaaaaaatctttaaaattttacaaattgtaaaaaaggataaactggttctgacatccatttcagccctttcaaaccccggagccgacttgaaccaaaaattaaacatcaagttttaacaattcacatttataagacaaaaaaatggttcaaattcacgaaaaaatatgtccttatgttcgcttaaagtgtttttatatcgagtttaaatntaaaacagtgatntacaaataaaagtgagacaatatcttgcgatagtttagaagcattcacatttagtattagtaattaaattttatttagttcaataatatttctctttctttaatttttttatttaaaattaattatttttctgtgctaataattaattatattcatttttcaatttttcgtaaatagtttacaaactgtatctattttatcattttttgacgcatgacttttatttggcctttgattaagtttcaattttttaatccatttattttgtgtcaattttccccaattttttcaatagttttgtttgaaatattcatttattattttaaattgtttaacaatcgaagggtccatgcattaatgaacccgggttgcagcagtccctgactttttataattttggcttgtcataattaatttattttatattttattgaaaccgtttttcgttaaattattcgcttttcatactaatgtagcgcaattttttttatataaaaaagtaaatttttatgcaaatgtttatttaatgccttctcattggcaacgttaaatatacatataaatttcaaaatatgatttttttataaataattttttgttttaatagtaatatttaaaattaaatactttgttaagaacatttttttatttgaaatgatttcgtcatgtttaaagacaaggttctattatttaaggcattacaggacttaatgaatcgaatttcttgaatttttttattaaatttttgaatattcacttttaaaatttgttacattatttattaattcgagtatatatttctaatacgacaagctctcctgcataaagaggttaattaagttggt

SEQ ID NO: 34432 - DNA, 776 bp, Heterodera glycines
cggcacttttgtgccattgttctttcattgacaccatctttggcatttttattgcccgtcacgcgtttcatcgatggcatttgttgtgccggttgcagttgttgcttttccgttgttgcggcgcatggttgtgctgcggtgcccgcgggcgttgttgttgccgtttttggcgacgcttttcgcttcgaaaccactgcagtgccgtcgctatttttggcataatttttgttgtctttggcagattgttgttgttctactttttctgttgctggtgctgctgttacttttttctacaaaaaaataaataaaattaattttttacaaaaatctaaatgaaaaaaacctaaaaatattattttttagataatcggtttggaaaattaagctcaaaaagcatagattagcttaggcataatctgctccgttgatattaaatttgagaattttggagccaattttttttgataacaaaagaaaatggcgccaatcaattggcgataattgacccaaaattctgaaatttttactaaatttaattggttatcaatttagatcccgctaatttgtttccccctcacaactgtcggtgccgtcgttgtcgcgctcgtcctgcgcttcttccccaacttgggactgtctttgaccccgccgccgccgcttttgagcggcgacgcttgctgtgccgtcgttgtcgctgctgccgtgccatcattgcctgtcgccagcggttgttgcgacttctccgacagcggtggcggagacgacatttgctcatc

SEQ ID NO: 34433 - DNA, 949 bp, Heterodera glycines
  misc_feature (907)..(907): n is a, c, g, or t
cccctctgccacgctgggaacatttgtatggtacaacatttctcgcaaaaaagagagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccacgctgggaacatttgtatggtacaaaatttctcgcaaaaaagagagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccacgctgggaacatttgtatggtacaaaatttctcgcaaaaaagagagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgngaaaaatttctcgcaaaaaagagatagccatttttctggcat

SEQ ID NO: 34434 - DNA, 644 bp, Heterodera glycines
  misc_feature (585)..(585): n is a, c, g, or t
tttataaatcccaaaattagtaaaacatcgcttaagtttgacgaaaaggcattcatttctcgggcttaatgggtgcgcgcgccaatgaaatccgccaagaacacttggccatttttgttgaccgcactgtttttgttgtccgcattttcgtattcagtgctaattttttccgtcatctgtgcccaatttttgacaatttcctcgcactttttgcgaatttcaaagcgtttcgtaagctttgctcgcttccacattacactccttgaaaaaagagcaaattttaggcaattcatttaaagaaagtattaaagaaacaaacaaatcgcaaatgttcttggccatgcactgtattttatttccaattttgacattagcaaatgaaggagaaggctgaaaaattttataaaattatttgaaaaaagaaatacttgtttatgattccaattactgggcttttgtggaactaaaactttgtttttcatcttattaacaaatcccacaaaaaattaataatacttaagaaattgattgggctcataaaagttgattagaccataaaagttgtcttttctcaatttctttgcncaaaattttttttttcatttgaattttccctattggtcattttgattttggcactttcg

SEQ ID NO: 34435 - DNA, 767 bp, Heterodera glycines
  misc_feature (45)..(45): n is a, c, g, or t
gagcgaaaatccaacgcagaatttcctcaaggggagagggaaggnaagcccgaaggagagaggactcttcaaaaagcagggcgcagcggagcggggggacggccccgaaaacaaaaaaaaaccgagagcaacaagaggccgcaaggggcacgcaaacaggaaaggggagcaaaaacccaacgcagaaccaaagaacaggccacagggaagccaggcccgaaggaggcggacaccccaaaaagccgggcgcagcggaacggggggaccgccccgaaaacaaaaaaaccgaccacagcaagcgaccgccgcggggcacgcaaacaaccagggggagcaaaaaaccaacgcagaacgaaagcacaggcaagagggaagccacaccggaaggacgcggacaccccagaaaacagggcgcaccggaacggggggacagccccgaaaacaaaaaaagcgagcagagcaagcgaccgacgggggcacacaaacaaccacggggagcaaaaaaccaaagcagaaacaaagaacaggctacagggaagccaaacccgaaggaggcggccgccccacaaaacagggcgcaccggcacggggggactgccccgaaaacaaaaaaatcgattttttcaagtgtccgtttggggtactcaaactattatggggatgcaagatccaacgcagaattgaagtacaggctatagggaagctatttcccgaaagattcggtctccccataaatctgggcgcatcggttcggggggactgccccg

SEQ ID NO: 34436 - DNA, 655 bp, Heterodera glycines
tttgatttactaattgtaagtgtcggggaatttgagcaaaagaagttaactgataaacagataaaacacacaaatgtatgcatatacaggcataaaaatgtaaaatgtaatcaatttaaatttgtcaataacggaattttctctcaaaattagggaaattttgtatttattcgttcgtcaacaataaaaaaaaacagacggccaatgtcgaaaattggctctattccgccatattttggtcgtagttttcactcagcatggcagtttccatcataattatggacaaaattgggtgccaaaatggaattatcgacttttggccagacgatggcatagcggaaaatgtaaaatgagccgggagctttccgttgtaggcgattccctcatcaggaataaaaattgactttatactagagttgagcgggaccgggaattttgggcaaaacggggaccgggacttgccgggaccgggacctcaatttttttcgggaccggaaaattagaaaaattcaaaaaaattttaaaaaatccaaaaaaaatttttaaaattgaattttaattaatttcaattgaaacaatacaaaattaaatttttattttgttaataaaatccaaaagttaaagctaaattaaattaatgaaaattttcaaacaa

SEQ ID NO: 34437 - DNA, 1239 bp, Heterodera glycines
  misc_feature (1196)..(1196): n is a, c, g, or t
  misc_feature (1219)..(1219): n is a, c, g, or t
tcatccacaattctgtccttttcaattttaattttcagtgaatggtgccggtttggcgatggtaagtcggccggggcgtgggaagtcggcgatttgttatcggacactaaaatttcgaacagaaatcaaaaatacgagtgtctcgtcggtcacattaaattgcgatgaatttgtaagatattatttcccttgttccgctaggccaccatggacatcatcaaattgcacggcggcgaacccgcaaattttttggacgttggtggcggcgcaacagttgaacaggtggtggggtcgggtttttcatcaatggtaaattggatggaaagctgaaaaaattgagaaattttctgaaattttgcattagcataatacacacacacacacacacttattgttagaactatcgtggcaaacaaatgcataatttggttaacaacgaaaaagttttggcccaaaaaattattcatccggagatgtttttttggtgtgtttttcctcccgaccaattaaaaaaaacaaaaaacaatatttttgttttttctctgattctgagatttgctccaatttgcgccaccgaataaattttaattcatttgaatttggtccaaaatttccaaattttttgtctgtgaatttaatttaaatgctttatcccttccttttttttgcaggtgtacgaggcgttcaaaatcatcactgcggacgagaagaaggtcaatgccattctggtgaacattttcggtggcattatgcgctgcgatgtgatcgcccaaggcattatcaaagcggcggtcggtgaattcgcttttttctctttttttcttacaattcgccataggaaaataaaaatagcaaagccacgggaattgctcaattttctgataatttagtgcaattaaataacaaatctcgccaaattattttcatacggcactatccggagcaggacataactccgccggccgaaacttcgccaagaaaaaatttcaaacagaaatttttcaagaaaaaaatcgtagaaagatgttttctaagaaaatttgaaggaaaaaaattttcagcgattttttcaaaatttgatgatcaatactaagttttttcaaaaaaaaattgaaggaatttttttaaagtttttttctacgaaaagtttctaacatttttttcttgaaagattcctaagtttgaaaaaaattctncgcggagttttgtggagcactgngcaccatcgagccattaaat

SEQ ID NO: 34438 - DNA, 867 bp, Heterodera glycines
gtttttggggaagccgatagagcttgttaagagctttcgatatgataccaatattgttggatttggtaaacaaagaaaagagttatgatgctctaaacttggttcagactaaaccggccagactaaactgtcccagtccgagaaaaaattgaaaaactctcgcctctcgtcctctcgcctctcgccaactctcgtgtttttggggactctcgcctctcgccaaactctcgctctcgtctttttggggactctcgcctctcgccaaactctcgctctcgtcttttctgagacaagtcacacccctgatacgtaacatgcgaattttctaatgattaaattacaattaaaaatacatccggaaaatgtgttttctggtaagcaaattacaattaaatacaccgtaaaatatgaattttccaatgattaaattacaataaaaatacatccggaaaatgtgttttctggtaagcaaattacaattaaatacaccgtaaaatatgaattttccaatgattaaattacaataaaaatacatccggaaaatgtgttttctggtaagcaaattacaattaaatacaccgtaaaatatgaattttccaatgattaaattacaataaaaatacatccggaaaatgtgttttctcatgagcaaattaacacatacgtaaaatgcgaattttccaatttaaaatagcagggacgggggggagaaccgtaccccccacctcccccccccccccaagagtccaaagtgctttccgccgccaaaaaattctttctgattcgtgcattacagaccgagaggcgtcgaatgatatatcattcgtcgaattcggaagaggtacacatattcttcaattttaccaa

SEQ ID NO: 34439 - DNA, 1023 bp, Heterodera glycines
  misc_feature (27)..(28): n is a, c, g, or t
aaaagggggcaagtcttctggcagacnncatgttaatgtttggacgagtcggttcagttcggacgaaagggacaggggggagattctgacaaattgtctaattggccttaattggcagtgccacccttcgcaatggaaggacaagaaaaacaatacacattcattgaaaatcaaatggcggacattttctgtttggtcggcggagacccaaagccgaacatcgaatggttgtggcagaacaaagcattggacacaaactcatcaaaatatggcacttttggtggtaaaacatttaaaattggaagaacaatccacgaaatgccatttttgaagatggaaatttgcgaatttcgaaagtgaaggcatcggatgacggattttacacgtgccgagcgacgaatcgggcggggaccgaagacgtggtgattagggtgagtgagtggtcgccctgagagatagccgatccatgggcggaggagtgatcagcagatgatcacttagaaattagaatgacctattgatcgatcaaactaactaatttattgattagataaatgattggattgccatttcccaggtgcttgtgataagtgcgccagaaatgagtgacccgaacactgaagagcatttgtcggcaacggtcggcgaaccgttcgtattgcagtgccctctgctgatgcgaaaacccttgccactaacgaacattcgctggacattcaatggcacttttgttccatcagatgccgatggattgtcggaagatgggcggcgaatgcgagtgccaaaggcgaccattggtcattccggggaatacaaatgcgtggcgaagaacgaggcgggaggggcggaaaagcgatttgttgtcgcaataatgggtgaatcttttgtaagacagagtaagaggaagtggggaggggaagagaagaggaaagaagagagagatagtgtgagagatggaaagagaggagggagagagaggggtggaaagataggaaagggaccgagtgcgaaaggggagagtga

SEQ ID NO: 34440 - DNA, 1127 bp, Heterodera glycines
aaaggggtgggacaccccccgggaagggggggggggaagcagttacttgggcatgaattgtttcattaggcgtctccctttcctcccctggcagtgttagcggatgacaaagacgcgccctgggaggacatggacgccctcaaaatgcgtttccgtggcctcaccatgccgcagtgtgggcatggcccgggtggtcggatgcgttcgcagttggccgaattgctaaggcgtcgcttgggctttggccatgccatcgcccgtgactacggtaatcaccgattttgagatggaatctttcattcattcatttccgtttagccgaaaatctttgcgaatttttcgacgcctttcgcaaagaattcgacttgaaaagtacggacaaattgcacgaagtgatccgtcttcacagcgtgcacaattacttccatcccggcgacaatttcaacaaattcgagcagttcggccggaaacagcggttcgactccgccttctttcagcaattaatggcaattttctttggcgggtaatccaacggaacacagaaagtcattcccactgaacgcactttaacaaggctgagaaaaaacataaaatattgttccccaatttggcatttctttccctttttggcattttccgtttttctcgcccttgtaattctcccccccccccccattttctgtgcaatatttttgttttcattcgttgcattttccatcctcctcttctcccccccccctcattttcctcatcttccggttagttttacgatagaattgtccttattctgctgcccattcattcccattggtctttgccctcatttgtatttcgtccgataaattctaaagtaattaatttgattgattaattggtcaattacccaattcaaacgaaaaaaggcattgggcgaagtcgaaaaaaatggaacaccaaaaaagtggggaatggaggagatttattggaacaaatggataaaaggaaaaagaaaaggacaacagaaaagtcgaaaatggacaaaaggacaaaagacggacaaaaggacactcattacattccaatttaaacaacatttccacatacaatcaatatatacatacacaaaagagcaaaaaaaaacccctccc

SEQ ID NO: 34441 - DNA, 1079 bp, Heterodera glycines
attccttcgattgaggaggaaaaaaggtggcgccggaaaagcaatgaatgaaccggcacaaacaaagctgggcacccgccccattgcgacgacagcccattttgaggcgggaggacggagagcgaaagtcggcaccactgagacagccctggacaagcaaatcggtggacatttcgcggtatttccataaagcacaaaggtcgccctcacaatgggaagcgcatcttttgagaaggggggggggagagaaatacgggcggaaattgtggaaacgcacttaagggaagaagcatcatcagttgttcgacagttaaagcatttaatagcgaaaaaagggagaaagaggaggaaaagtgtgaaaatgaaggcaaagggaagaaagaatggcatttcaagaagcacaggccgagaatgggaagaacacactgaagggaagtcgagaatgggcggagagcggagggggggggggagaaacaatgcccccgagggatttttttagacaaatagacacaaaggaaaagccttttcaccccctgcttgactttctccaagtagtcacgttttgtcactctgacctcttctcaattttcacccgaattattaattcgaacaaatttggcccattcgtgggaaaaactccttggatggataaggtggcgaagattgaattaaaagtggaaaatataaaatatattttgaacaatctaatttctttgctctcacaagagtttcaagtgatattaaaattcggatgaggttttttagctaaattttgaaaatataaatgaattggtaatccgtagtattcgatagacgcctcagggaaattttttaatggattattgtgcaaaattaatattagggcttgtaatcacatgcattttttctggattagaaatagcctaaagcacatttttgctttgtattcgtgacataataattatgaacccataattaatattttttaaatttgtacaaccctcaaatagagacaaatctgaaaactcgcaaatcaggatatttttactcttcagaaagtcaatctccagtttcaggacactttaaacactgctattcaa

SEQ ID NO: 34442 - DNA, 1039 bp, Heterodera glycines
aaagaggctagagcactaagaaatagtgttccttcccagagagtgcacatggtaaatggaaaagaagaggcacaagatgaacttctcaacttaaataaataattcaatttatatatgttcttttctcagcaaataggggagtaattaatatgagctaacaataattaaggtgtttatcaaggtcccttatcacaaatataacctttttgttctcatcagatatcatctctgacaaagactcaactaaatgaaatgaatttgatcagattttatgcaattcattgcctttatcccctcctgctgactgacttgtttcataatttattttattttttcatttaatttcaaagcagaaattatgttaaatttatgattagatgaaatcaatatcaaaataaatgttacataatgatccagggactggatttgtatggattttcatatttttttgcacactcattcggcctaaaaccacctaaatagtatttttagcttggtttgatgcttctaggatgccttgttacttacatattttccatatttcagatttttttccatatttccatatttgacatccatatttcggcattttcacaaaaattcagaaaataccacccatagatggaaaaatttttggaaaatacgccctaaaatcgaaaaattttgggaaaatttccaaaaattacacaaaaaatttttcattagcaattcgtgtaaaattgattttttgcaaaaatttactaatttttgtttttttttctaagtaaattcaatttttttagtaaagaaaaataggatgcctcaattatcaaattttataattcatgtattacccatatttcgtccatattttgcgaatttttcgtcaatattataatctatattttggatttttctgtacatataaatccggtccctattcataaccaattcaactgacaaaactttatcagttaataatttatgtgaaaagaatggaaaaataaggccaacttttgctgaaatatttggccaaaaatgggacaatgaaaaaatggaa

SEQ ID NO: 34443 - DNA, 551 bp, Heterodera glycines
aaaagggggggggagtaacatccgtactaccgtattatctctaattatcaccccggggggattattgttcaacctcctcagaaagggggggggggagttttaacattaaaaactcattttttgatcgggaccaattgggggggggggggggttgcatacaaaatttggatgggatttgcgaaagaaaattggtttatctttaattgattttattgtaaatttatttagtttggcattctgtcttttgtattttcaaaaacaatacaattcggatcccgcatatcgcgcaggttccatttttttcgagacttttcttaaccatttttttttaaattcaattaggtacatattataattccaaaaacacataaaaagaaatttgtaagttttttctctccataaattgaatttttcactgccgtattgctgcgccggtggcccctatggtggctcggagatatttttaaattctttttgtgaacgaatttatgggggttaggggatgacgtaagcgtcaccgagcaacatttgagaaatttgaacgtactgaa

SEQ ID NO: 34444 - DNA, 1245 bp, Heterodera glycines
aagatttagctttttatgcattcatttttgttttttgtttttattaaacagagcatagagctttgtttttgttttgcttaattgcctattcaattaggaccactaataattgtaataatttttattattttcaaattagtaacatctttttccttatttttgttcaccattcctcattggtatcggacttgtttccatgacctgttcataaagtgccttgcgcattagaccgagcacaaaaatgccgaggctggtgcaaaggtcagcggcagcgagcaatgttagcaactgaaagaaaatttgaatgaattatttcttcaacatataaaaaagaattttaaaatggtaaaaatatgcaattattcgaagtattaaaataataaaaaaatcaaaatcaaaatgctcatagaagaaatttaatcaaaaatttaattaaaacaaaattataataaactaaagaaataaaaagttgaattaaattcatttttaagaagtttgctgaaatcttgtatccttaaattttattttttattaaagaataaataaagataaattattttaaaaaataaatttgttgctttaatgaattaaaaaaatatattacctcattatggcataacatttgctttgaactaatgaagacaaaaagtgttatgacacaaatcattgaagagaaggcgccaacctcacaaattaattaattttttttaagttaattattttaattatttttacaattatgtcgatgctatggaattggatcaacgaaatcagctcactgtcgtcataattagacggtcttgcctgtattggatccatttttaaatgaaaatttgtcttaaaattaaatttaaaatattttaaatttcaggaataaaaaaaatatgcaataaaaattttgaaatatcagcaagtaaaatacaaaaaattcggaaggattttgtaaatgttttcaaacttaaaaacataaaaatttaaattataaaatccagcaaaaatgcagatcaatgaattacaaaaatttgaaaattgtcaaattaattctgaccaatgctcaaaaaaataataaaattgatgtatttgtaatataaatttgtcaaaatttttaatttaaaagattagccatcctaaaaaattttttcctaaaggcactttttatttcattgaaaaaattagggattttaattacgaaatgaattaaaaaatcttcacttataattattaattatttacattgccattttt

SEQ ID NO: 34445 - DNA, 851 bp, Heterodera glycines
tttgaagctgttggatatacgttaatattatgaaatctctgtccagctttgaatgaattttctgaatttttattggcgctaaaattactataggatttgctattaaaaatgattatacacttaaaaattcatctttatgttagcaatatttatatattttgctaaaaattgtaacggaaattgaggatggaatttcgtcctctgtgtgcatcaaacattcattgcgaaatgctcaaaaatttaaaaataatttcaaactaattttgcctatctgtttacccgagtaaataataaaatttctttagcatattattcaaagcttttttgtaaggttttctttttgttctgcggttgtttggcttagaaaatgtaggaggtgaatagagattaattaattaaattttcatcacagttatttgaagctgttggatatacgttaatattatgaaatctctgtccagctttgaatgaattttctgaatttttattggcgctaaaattactataggatttgctattaaaaatgattatacacttaaaaattcatttttatgttagcaatatttatatattttgctaaaaattgtaacggaaattgaggatggaatttcgtcctctgtgtgcatcaaacattcattgcgaaatgctcaaaaatttaaaaataatttcaaatgaattttgcctatctgtttacccgagtaaataataaaatttctttagcatattattcaaagcttttttgtaaggttttctttttgttctgcggttgtttggcttaaaaatgtaggaggtgaatagagattaattattaaattttcatcacagttatttgaagctgttggatatacgtt

SEQ ID NO: 34446 - DNA, 958 bp, Heterodera glycines
  misc_feature (11)..(11): n is a, c, g, or t
agtgtccgttntggggtactcaaacaattatgggggagcaataatccaacgcagaattaaagtacaggctatagggaagctattcccgaaggattcggtctccccataaatctgggcgcatcggttcggggggactgaccgaaaacaaaaaaatcgattttttcaagtgtccgtttggggtactcaaacaattatggggagcaaaaatccaacgcagaattaaagtacaggctatagggaagctattcccgagggattcggtgtccccataaatctgggcgcatcggttcggggggactgaccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattattaaaaatttttagattttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggaagtagcatcatagcagtgcttttcttgtcttttgatgcctcgcaaatctggtcgctctgatcagttataaaaaaagt

SEQ ID NO: 34447 - DNA, 1241 bp, Heterodera glycines
  misc_feature (39)..(39): n is a, c, g, or t
ttggggtttgccccgttttgcttcacacgggatatttanatgattgtatcccttgcatttatattttcagcactgggagcctttataaacctcctctgcccgaagcgccaacaccgacacaggcaccgcccgactcatttttggccaggagtcagcgacgccctcgccgtggcatttctcgcgcagaatccctcggctatccatcggttgaaacgtttggttaaaaaatactggacatcgctattaaatgagtcttattctagcatattacagcctaactctcactctggcaaaaattaaaaatttcccgtcatttactataggtattaattttaaaaatcttccattttcgtaccaaattttgagttacttttgaaaaaatgttgaaaatatttattagataaatttccaatttcaagaaggcatcactaccttgtgtaaaacattccttctgctcagaatcgtcgtgtccagctgtactgctcgcccttccattggcaaggcatgtggaatttcccaccgccagtcggtgcccaggaggcgacactcaccgaattgggtcggacagtcgcccgtttgcccttggagccgcaacttgcgcgtttgctgctgttcggcatcgctttgcgctgtattggccccgttattacgctggtggccgcactgtctcaccgtgacccatgtatgcccgaccgatccttgcaaaaacccaaaatcaaaaatttttcaaagttgtaatcgcatccactgatgagcagaaacaaatggccaacatagtgagggacgaattctccaagatggattacagtgaccatttggtaaatcacagagggtggattagttgtactttatctctcttccttttcgttcatcagatgcttatccgtgcgttcaatgccttttcgagggttaacggctcctgcagagaacaatggtgttgggcccgactgatcagcgagtcggcgatgcgaatgatttgtggaattcggtaaagcaaaaatgatttttcaattcttaattgtcttcctttaggcatcaattgttcattgagcttcgtcgtcttcatcttctgccttctcgcatgacgaatcctgacgacaacatgaacaatctcaatttgttcgcctccagttggcccatggtccagggatgcattgtggcgggcgcttacccaaacattggcttcgtccgatttggctcgaaactgaatcgaattcgcaccatgtaagccaaagttatta

SEQ ID NO: 34448 - DNA, 1418 bp, Heterodera glycines
gttcacaaaatataaaaatcacttggcctttatttgatcattatttttcaaatccctttcaaatacagtcaactttggcacgggccaattccggttgtttgttggcaaactcactcacaaataacggggaatggcacattttaatttctatttgtactccggttttgcaccccacaaaaaaagcaaatatatttatttgtaaatttcattacagtttttcattattctttacttcttttcaactgtgccgactttgggcacttcccccccccccccccgcccccaacagctgtaccattggttgaaatgccgaaatgccaaaacaatgaatgccacctttatttccattaaacgtaggttttgcactccaaaaattctatttatattttcaattattcatttatctctcgtgcctatctaatattttttgatttttaaaaatttttgttcccaaaataaaaaaatcacttggcttatttgctcattattttcaatccctttcaaacagtgctcactttggcatgggccattttcggttttttggcggcaaactcaccccccaataattagtcacagcttaaataaattccatttcaaatgtctttaaattcggctacattttccttcctaattataattgcgagcaaaatcactttgccattattggtccattcattatttctaaattattcatttaaacagtgccgatttttgacactctttcccccaacaatcatggcacaaaaaattccaaaacgatgaatggcacattttttcccatatgaaatattcatttttacacttcttttatcgctttcttcttgggtcttctgaactaattataactcttggaaaaatcatttgtacatttgtaattccgttttgcaccacacaaaacattattatttacattataattactttattttttattctactttcttcttctgtcactctttcatcgttatttccattgaacttattttgcactccaaaaattctatttatattatcattatctatttatttattgtttcccaaaagataaaaatcaattggcctttattggcccattatttttttccattaaacaatgctcactttggcatgggccattttcggttttttggcggcaaactctctgccactgaacttcggttttgcatcccacaaatcatatttagttataaaataagctttttttctccttttttcttccttcactctctcgtgccctctcgatcattattcttttctattcaaactagggttaagccccgagccctcggggggcaaaaagtcgggggtcggggacctcgggggacgacatgtcgggggtcgggtcggggaataggtccaaaaaacgtctcggttcgggtcgggggccgggaggctcggggtcgaggcttaaccctaat

SEQ ID NO: 34449 - DNA, 960 bp, Heterodera glycines
ttttcagaaagggttctgaaacgcaccaaattttatttatttgttagtttaggcactctgatgctttttctatcaaaaagggagatgaataaaatttttaaaaatttttaattcctttttaaacaggccaaaaagtttaggcttaacttttttttcagaaactgatcagaagcgccccaaactttgcagggatactgaaaggaaaagaattaacctgttttatcacattagcttgtcatcagtttttataaaaaattttcaaaattctgagtctcctattattttatttatttttcaaaattttgaagggcggggggggggggggggaaaattcaattgattgcgaaatttttggaaaaattggcgccaaaaattttccgcttccatttgcttcagaaaattggtcatgcattgctttatcttaattgataaaaaataaattattatctaattgaaattattttaaattgacctcaaatttatatttaaaactacatttctcgcaaattggtaacattgaatgatttttaatttaatctttcgaaattttaaattagaaaaaatttataaaaataatagaaatattcaaaaaaaattgagagaaaaatcaagctatttgtgaccatttttttaaattttgatgtgatttttacacccataagcaaatgcaaatttccaagggcattcttggaaaaaggattttcgaagtgacaagggccatttccaagggcatccttggcatccaaggacggattcttgtaaatcgagattaagctgacagaccaatttcaatttggtcgagcattttcttccatccaattgtccttgtttttgaatgctttatttcgaaatgatttttgctcttcaaattgaatgcattaaatattttttccaatgcttttcctcccatttctgtttgttgtggcttttttcttttcccttccattcaaacccgaaaaa

SEQ ID NO: 34450 - DNA, 818 bp, Heterodera glycines
ttttgttgtcgcaaataaaaattccaaaattaaatttgttaattttaataattttcatgtgaaatcgtttgttggcaaaggcattcgcttgccaagtggaaggcacgcattggtgatggaaattgtgctccttgagcattattatctgatcaaaatgaatggcactgaattgggccaaaaattttggccaaaagaatggtggaacgaattccaatggcacggtgtcaattcggtgaaggtgctgtgctcggttttgctcagaaaattacgtggaatttttttagggcctatgatttttcggttactaaattaaatttctcaaaaaatgctaacttttctttccatcactattgataaaaaaaatttcttagcaattgtcatgatgaaagcaaatttttgcgcaaatttttttttactttttttttcattttcaagtgtccattataatttaaaagatttatggcgaattaaattttgttaagaagcaaaaaatattataattgattgattcattgttattaaatgccggcccaacttttcaacatcgaaaaattaaaaataaggtaaagaaagtttaagaatttcaagagaaaaaattaaatttatatacaatcaaaaaattcattaaaaattaagtcagagaaaaaaaaaaagattaatttaattaattaattctttttttttaaaatcctcctcattcgtcgtttcaattcaaaaaagtcaccgtttaagcactgtaaatagcactaaattttttcaaaataatcatgaaaaaaagccccaaaaggaaaactcagcaccaaaaattggaaaaaagc

SEQ ID NO: 34451 - DNA, 869 bp, Heterodera glycines
  misc_feature (125)..(125): n is a, c, g, or t
catcacttcattttccaatcaacaattacttgagttcacaaattcttttatttttctgagacacttcgacgacataatttctttaaatttaaatttctcgactacaatcaacaaaattctggatntattttctaaattctggtgttaatcagcgaaacatattccgacaattccatcaaaaacggccgacacgcggagaagaccgaattctttagaggaagaaggactaaacgaaggacaaaccgaaagggataaaaggctttggctcatccatcaaaaaaggcagttgcgtaatatggatttagacgccctgcggcgtcgaattgtgactctcgagcaagagatgcgtgaaaatggtggaactcgctctgggctcccaatgccgaccacatttgacgggacgactgatttgcaggattatttgaagtcctttaatttaatcgcgaccgcccacaattggacacccgcacgatttgtgcaagttctcccgctgttcctcagaggatcggcaagggcaacttacgagaacatcgaaccggatattaaagataattggcgaagtctaattgatgccatggcggataagttgaaacaaatgtctccaagtctgacagcaagacagaaattggcacaacggaaacaactgactggagaatcgctggaagaattcgcgcaagcgattcggaacctcgtcttacgtgcttatcccgacaattctctcgagatggactttggaaatttggtgctcggtgctttggaaaatgatgtgaaacaagcaaacgaagtccgacttcgacaattccgttcgtaaattgcgcgagattttttcgagcgaatatggcaccacgactgaaggaaagagtgatgta

SEQ ID NO: 34452 - DNA, 750 bp, Heterodera glycines
cgtacataatcgtccacgacttttcgtcactttctctgtatcattttgagtttgcctgttttttgtcgttttattttatattttcacttgccataattcagctccctgccgccagttttccttctgttcgcgttgtttaccacaattcgaactccgattgccattggatagttcaggcggacatttccatgagtcaaatcactccgtcgttgagttacgaacgccgcctttcccagcatttacgagttgcacttaaactcaagctcagctacccctcctttctgcttcagtccagcattaagtgagtgatatcatcgatgctaatttaaatttgagagttgccctttatacaaattcttaaaatgctgcaaaaaaaaaattttttttagatttcgagcatttttgccaatttatggaaaaaacttaggaacaatttatttgctagtctttatattttaaactttgaaattttaaaaaccaattcacgcgagatactgccaaatccctgtgcgggatccctaatttttcctcgcacaaaaaaatgagattcatcttcagaatccgcaccagcatgtccaccttcgaattctgcttcgtcctctgtgacaatcaagaggatatcgtacaggcctttgtcagtggcgttgtatttccatttattgcctttaatactgcccggtttatttaccgacgactgagaaatggaaagacaaggtaggaaaaaattcaaacgtactattttaagtgtaa

SEQ ID NO: 34453 - DNA, 1212 bp, Heterodera glycines
  misc_feature (567)..(567): n is a, c, g, or t
aacttcaagcatgacccatcctcaatcggtcgctgcgcatggcattcgagagcacggcgacgaagcatcgtgtgaagatttgctgtacaacttcgaggacgagctcaagcaaatgtccaaggcgtgctttgaaaaggagcgtttattcgaaaaggaaatacgccgacgcaatcgcttagttcgtaatcattaagtatttttatatatctttttaaaacgagggatacatctcatttgttttggattaacaaaattttaaggaacgttttgcgcgatgttcgactgaaaattcctcggcgggccgtgccgaggacgacgacaattcccagcacggaaacaacgagtccaaactgtcacagcaaattgttcgccgccgttctcaacagcatatcatgaatctgagagtctcgttgaagtctgaaaatgttgatcgcgactggacgcccaaagagccggtgaggaaacgacgaagcgggggccgtcgtttcttcggatcgaggtgagcattgggcgtgggatatttgcttatcgtaggtcattatgggatcgctcggcttcaccttattncaggggtaggaagccaatgtcgcgtaaggcgcgggatgtgatgatcaaactgcgcgaggtcagcatgcgacttggcggtgctcagtatttcaagaagcgcagcaacgaagccatttcttgtgaggtaaaatgtggtggtaattgctgggcaatacgaaatgatttactgatcggaggctgtcttttaccccatttatcatatgacagctaaaatatacaataaaaatcactatgctcccttgtcgcctttcctcattgtttttcgtatttatttcccctttttcagaaatgtggcaaactcgtcatcaatcgtctgtctgatcacgcttactctcacttggaggggtgcgacctgttcaagtgccaacagtgcaacttggtattgtggaattcacttggtctcccactgtgttcacatttatgttgtcttttagggtcacttttcgcgtgagacgattgttcgtcatttgaaggactttcacaattcgcacgaggctccgatggacaatcgccttcgttttgcacaagtgaccatcgttttgacttggttttaatttaaataattttactcaaggaaatcaaagattccattcgcgattgttacccacaactttttatcgatgcaccgatcccgacgaaagagga

SEQ ID NO: 34454 - DNA, 905 bp, Heterodera glycines
  misc_feature (880)..(880): n is a, c, g, or t
ccattttgaatcccgaacccggattcgaacaaaaagtccaaaaattagttttcaaaaaattcacatttatgcaacaaaaacaactcaaatgcatgaattaactcaaataagctcattcacatgggtaaaattgtgaaatatgcagccaaaaattgtaaaaaatattcgcatggtccccaaaacgctgacgccaaacaaattcgggaaaatatgtatcgtcggttgtgtttccgaattgctgtttgaaattacgttttaactttttccacatcgattcgacattctgagtgtgggcaaggcggttagcaggattgacaaatttagcgaatgattgacagtctaatgggtgttgaggcaaattgggaatgccacggtatgatcgccactaatccgatacaatagtggtccccgggaggatatattgttggataagtgggataagacggttcgctccacgtgatccactggtaccataaaaacgcgttcccagctggagtcacgttcgacgccaccgaatagccaaatttcctgcttttccagaacacgcccaacaacattttttcttttcacaacaagcgtctcgtcgatttctacgaaacgtcctacaaaagagacaaaacaaatggaattggcgaaaatccgggctgccaatcgtatttggttggcgcacgaagaattcagcgcaaacgtcacggcagaacctatcgaatttggacttagagaaaccttcaaaaaacgttcagaccaaataccccgtttctttgcgacaattctttgatttacatctccaagttccataaggacgaccttcctttgattttatcgcgccattacaatgaggacacgattgacgagcgtgcagaagacccaaactgtcagncaagcatcgaaatgctgaagctgcg

SEQ ID NO: 34455 - DNA, 886 bp, Heterodera glycines
  misc_feature (8)..(8): n is a, c, g, or t
  misc_feature (801)..(801): n is a, c, g, or t
tctaattntgttccaccaaacaaaggctgattgattgattgattgtttgattcttctactgtcattggacgaactgacaaaagagaacagcggacgaacaccggactccgacaattggaattttgaagaaatcgactgcaagtaattggacttggaatgagcgacttgcttatggcgtgtttgcatacaatataacaccctcaaacgtcaccggattttctccattctcgttaatgtttgggaaacatgccaactttccgttggatgaagccatcggttttccgttaacccggtctatacaatagtcgaccgagggtgaattttgggtggaactcgaagtgtacgggaacagaacacgagttctgtgaaaaattaactctgggagagcttgacccggcacttggcactgcagaaattggatgtgccatagtccaaacgccattgcaggctttgatggccgttttccttctgagaggaggcaccgtcccgtccatgtcggctgcccgcaattttatcaaaatgatcctcgaaggcggcccgggaatggaaatatgcctttttaacgattccagcatgtcgacttcttcatcaccttccctccttacgtacatgccaaaactgctcaatatgaggaattgttcatgaaaatgcgctcttttattgaccaggcgcattttcgttctattagcaccacggaaaatggtcgctcaattttggaaatcttccgtttcggcaactccttcaaccaacaccttatttcgcctgagggagttttaaaagacgctgggattcgagcactanaagcgtggctttttacccaatccccgtttccaggggataaggctttgaatatccgcactgtaaagtccgtcatccaaaagccctc

SEQ ID NO: 34456 - DNA, 696 bp, Heterodera glycines
tgccggcactgtgcatggctttgggcccgaaatttgggcgcgcttccgcacggacccattcaaagtgccatcagtgcttaacgcacccattgtatggcaaggggaaggggagacgaagtgcaaaggcaaattcgaaggtgatcccggagggggcgcacactttgcatgtcgagtggcagggagtgcacgacgcacacggccgagtcgcgggatacatcgtggagatacggacgagcgacgcaccgcagtggacagaaatgggcggagtggtcagtgctaatccaaactctgctgacgacacttttggcttttccaatggccccacattttcaggtccgacatgagccgagccgcaggacatacaaaacgcgattggacggattggagccggacacgctgtattttgtgcgcatcaaagtggtggaccatcgccaacgcgtcagtgacgcatcgcctgaggcacaggggcgtacgggctgcgcaccgccgaccttaccgcccacaaatgttgagttgacatcgcctgtagactggcgtcatgtgcgcgtatcgtggcagccgccctccaaagagagttggctgtgctccgccattcgctaccgcatcgaatacaaaaacggcactcaaccggcgcgggaggcggaagtgccgacgtaagattaggtcgcactattacaaaaggagttgcttaattaa

SEQ ID NO: 34457 - DNA, 208 bp, Heterodera glycines
tgctgcaattttcacttcacaaaaggggggaaagccaaaaatggaacgaaattcaaaagttgtgggacaaatggaggcgaaaatttaagaggaaatttaaaaatgcaaacaaaatgccaaatttcaaaaaagtaatggaagaattgaaggacaaaatggaacaattgagagcggaaaaggaagaggaagacaaaaaagagggaacgaa

SEQ ID NO: 34458 - DNA, 667 bp, Heterodera glycines
ttgatttctgaaaaacaaatctcttacagcggccaaattgtcggagcccggctgaccgcccggcaacacaaccgcgtcgtaccgcttgtcaaggacgtccttgaacagtgcgtccacccgcagcttggccttacgcgccagctcaatttgggcacggtcctaaaaggcgatgaaaaattatgtaaaaccatttggcattcggtgcctttttattttaaccggatgaggggggggggggcattcgggcaaaacgacaaattcaaattcgaccaattcttaaaattacagacccgaatttgggaattccatgtttctcgaaacatttttaggttcagctttgagtcatgattggctttggcacggtcaattgtgaccgatgaaaagcctgtctcggcagggtctgggtcgtttcggcgccagcgccccagtcttcggactataactgtttttttttctttgctaaccaaatccaaacaatcttgggtatcattcgaaagcttaacgtgcttagaagctatttcaaagctattgtttcgcgattatgaacaattagccaaaaaaccacttttcgctttttgtataatgctaaagaggagcacgtgaagagctttcaaatgataataccaacaatgttagatttggttgacaaaagaaaaaagttatagtc

SEQ ID NO: 34459 - DNA, 690 bp, Heterodera glycines
ttttagatttttagggccggtttcatcgggaccgatttcccgatctcgggatttcgatcccgaactgctccccacgaaccggcccaaaaaatccaaaaatttaatttactactatattaaccatgctctatttaatggcatcaattttagatttttagggccggtttcatcgggaccgatttcccgatctcgggatttcgatcccgaactgctccccacgaaccggcccaaaaaatccaaaaattgaatttactactatattaaccatgctctatttaatggcatcaattttagatttttagggccggtttcatcgggaccgatttcccgatctcgggatttcgatcccgaacttccccacgaaccggcccaaaaaatccaaaaatttaatttactactctattaaacatgctctatttaatggcatcaattttagatttttagggccggtttcatcgggaccgatttcccgatctcgggatttcgatcccgaactgctccccacgaaccggaccaaaaaatccaaaaatttaatttactactctattaaacatgctctatttaatggcatcaattttagatttttagggccggtttcatcgggaccgatttcccgatctcgggatttcgatcccgaactgctccccacgaaccggcccaaaaaatccaaaaatttaatttactactata

SEQ ID NO: 34460 - DNA, 1291 bp, Heterodera glycines
  misc_feature (21)..(21): n is a, c, g, or t
aaaaatttagaccaaagaaanataatttttgattttaaaattgataataattattgaaaatttcttacaaattcataacaaaataattaataattagggacgtcaattttacgtaaatacatatttttccccggattctccacgctctaaataccgtatatcgctctaattatagcccagtctctattaatcccgcagtctccaattataccccagtctacgaggtgttttgaaaaataatccctctatcataatcccccagtctctaattgtccccccttttctgaggaggttgaaaaataatcccccatgggctataattagagcatatacggtagtaggaaaaacactttcttttttgtgtttgcgaacaaaaattgggacttttatttacatatttttacatatttcggggttttatacatattttacatatttcaagattttatacatattttggactttttcggactttttcatacatttttttacatatttttaggattttttatagaaattttcggaaattctcaaaaaaatctaaaatttcggcaaatttttcgtacatatttttattacatattttgagaatttttgaaaatttataaaatttctatgaaaaataaaaattaaccaaactaatttttaaaatactaaaatgtgattctaggcctatttaggtcatttttatggcattttgtttcaccctttccgaagaattttttttccaaaaaataaccattttaaaaattttatttacatatttgggacatattttgggtttttcttacatatttcgggattttttttttacatatttatgtacatattttgaccactttttgtacatatttttgacatccctattaataatatttattataaaaagtttggcactcgtacttatttggcagaaaaacccatttttcttatgaacccgtggatgctctatccacccaccaagtttcattcagaaatcccacggacacctggggaccttcctttgtgagttcttactttgcagatacagcaacaaaaacgaaaaattaatcccctgaaaatcgacttaaaattcttaaaaaatgatctcactttttcaaaaattaaaaaaataggccaaaattctaaaaacttcaatttcaaaaagcaaaaaatttgacattttttatcacctaattttccatttttaatacctttttgagctttttaaagttctttcaaatctatcattgttagaaagcgatcaaatgataccaaaaatcgacaactgtaaaagattttgctgattcca

SEQ ID NO: 34461 - DNA, 1100 bp, Heterodera glycines
tatctaaatatacacatataaataataattaacatatgtaatcttatccaaaacctcttcccctcgtgccctcttcgctgagttgtgaaagtccaggatagcaacgcacatcaattcgtgtgtatttgtttatgcgggcatcaattgcctgcttaaaagcctttgagacgcgtctccaacggacctgaaaaaagcaaattaaaataatatatttatattatgttgatatttcctaaaaacttttgcctatccgataaaaataacctggtcaaagatggagcaatgagcaatgatatgagaagcaagacgatattgatcgctggtggacggactcgaggaaacacggggcggaagaagacgacggatgccatcgaaaaaatatagcggaagagtcaatgccatttttcaggaaaaggcagcgagcgaatagggagggaatatgtgtaatttattcaatttacaaacactaaaaaataaaattgaagaaattgccaaattttaatttgcaattctctcagcaattgtaagagaaattgaatggtgcaatttttaggagtcggcgacagttcaaacagagttacagaactgggacttaaccgttcaatatgtacctaaaaagcaagaatgttcaaaattgtcgcgattgcttcctctaggctaaattgtcaattcccgttttctgtttcagattttaaaaaaatcttaatgccaccaagcagcacaccaataacggtctgtaatttcgaagcaaatgcttttatcaaaatgtcgctctattaaaaaccaaattattaaatgattgtcaaacattatgccaaattgattaaaattaatcactaaatttaaaagttttgacgattttccccaaaagcctcaaaatttctcatagccataaaaatcctcaaatcctcattaaaaaagaatcctcactgacctatcaaaaccacaaaatgaggataaattctcaggtctgggttaaatggctataaaaattataaaacaaatttgggtcgaatggtattgtgggttttaatattgttgacgaaatgtccatttggaaaaggaaggaaccaattgaactgttaatgggagtaaacacg

SEQ ID NO: 34462 - DNA, 654 bp, Heterodera glycines
ttgagtaccccaaactggacactatgaagagatcttccttttttgttttcgtgggcagtccccccgaaccgatgctcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgactgcttccggaatagcttgcctatagcctgtactttaattctgcaatggatgtttgttccccataattgtttgagtactccaaacggacacttgaaaaaatcaatatttttgttttcggggcagtccccccgaaccgatgcgcccagatttatggtgagatcgaattcttccggaatagcttccctatagcctgcactttaagtctgcgaaggatttttgctccccat

SEQ ID NO: 34463 - DNA, 619 bp, Heterodera glycines
cgtattgaaatgacccgccccctccgatcaccccacactcatacttttttcgcttcggctcaccacggaattaatcaaatgcttttaactatttttggaattttatccaattcaatgtgagctaaaaataaatattatttgggcatggattaaacaaattgacggcttttcgccaattaatttcgattatcgcgtgactggaaattgagacgggctaattaaagaattgaggatttaaaaagaccctttttacagatgtttgcattgaatattaagcaaatttcattatttcttcattttttcgttctaatgatggccttacaattttttaatagctgtcaacaaaattttagtcatttcaatttttaaacagaaagcaattgctcaaattaaaaaaaataacacgtgctgctggtgtaaaatttgttgacagcttatcaattcgacggaaaagctcatttttgaggcacttagaaattcttcgtttgatgaattaaaacaaatccgtgaaataatttgggagacaaagatttcgcgttaccaccccataaagtttaaagaaaaagatcattcgggtgctaattggggaattggagcgttgatcacgaaatttagctgc

SEQ ID NO: 34464 - DNA, 889 bp, Heterodera glycines
acaacagcaacaacaacagaacgatttgcgccaaaaagctaacacggcgatggatttggtggagagtggactgctagctgattcgttgcgtgaagaaggcgtgcagagggctgagctaaagcggaaggcgaaagtcgcgctcgatctgattgatgccggtttgaccggcgatgcactgcatgaggagggacaacgttggaagaaggccaaaactgcactcagcgttctcggaaacatgttgttggccgattcacttccggaaaagaagactgcggagctcccgcttccgccagccgaaaaaattgaatcactgccacttccaccactcgaaaaaatgaaaacacccccacttccacctgccgacaaaatgccttcgccgctcccaccatgatcaaaagtggaaagtgatgagcaacaattctacgacagcatttctgcggctaccactatgatggacagcgcctcaatgcagcagcaggcgccgctcaaaagaaaacagctgactccaaaaggcaaaagcaacaatggtatgaagaaggcagctgagccgcagcatcatcacaatgtgggggacatggacaagactcttgacgaattttttgagagcgttagcgcagcgacgaccaatttgtctatataaattgttgtttcatgcaattgtattgaattttaattaattcattaatacgaaatgctgaattctttctccaataaagatatttgctttaaattaccatttggattaattatttccggtccctcctcctctggtaaaacccaattcctattgaaatttgttgccgaatgcgatgaactaattacaccaaaacccgcctccaccctttactggtttggtgaaatgaagccagctgtacccattctgcaaaag

SEQ ID NO: 34465 - DNA, 1136 bp, Heterodera glycines
aattcattttaaattgaaacatgatattctttaattttttattcaaaatttaaaaattatttttgataaaattttcaccaaaaaataatttaattcaaatgaaaaatttttatttattattaataaaattaaaaatattttaaatgaataaaaattgaaaaacagaaaataaatggtagaaaattaatgtacaccgtccggatccgaacctgccccctcccccctcaaaatgatgcctcagaatccccaatcacacagggattctgaggtcttgactatgtcaaaagtaaaatctgatcacgtattcgtgatcagcggcccaaataacccctaaagacatgtttttggaagatttttgtcgaaaaaattttttcactcaaaaatcctgtccaccccctttggtcccgaatcccaaaatcacttttatttttgtatctttttttaaaaatgtgataaaaaggtcaaataaaatttatataatagagcaaaaaattgcggatttttgtagtattttactcttctctaatgacttttcagaaccgagatataaatttttttctgaaaaatagaaaatttccagaatttctggaataactttttttgtttttgcggtataaatttcaaataaatctcataaaattcacccgattttttgctattttttatgctttaaatgagctgaattggaccattttgaggcgagttatgaattttcaaaaaatcacttaaattctcaaatccaaaaaattgacgatttttcaaaatttttttacctccctccaaaaaatccaaaacgcaatataaagtgcatattcgtgttcagcacctcaaattagcccagaaaagtattttttggcaattttaggagcaaaaaaatttttcacgaaatgcaaatccatggggtcccccctttggttttgcatttaaaaattcatttttattttatatctttttttatattaaagataaaaatatgggataaagcacattagatagagcttaaaattctctacaaaaatgctctaagacaatttttcgctaaaatcaacccctgacgagttataagcccgggactgaaatgtcccggtcaggccaaaaaatttttctatttccggaaaattttgaaattttcaaaa

SEQ ID NO: 34466 - DNA, 682 bp, Heterodera glycines
ttgaaggctgtgtatcatttgagcggtcgtagtcgtcgtcaacaaggatggggaaaggaggggtccgtcaggaccctccatttgggcggcgaatgatggaaaggatgcaagcaaacactgctcccccgggctttcccatccatcttcccccccccccctgagggcacaaaatctatgaaattccccgcaatgcgaccctcttgctttgctagtagaactttctcttcgctctcttggtctctccacccttcacgctgcctcatcttgcaatgcccttctcacccattctccgtcagtaaactgctcacgacactcgctcgccctcataccgtgcgcatcgatggacccgtatggagacactgccttttatgagctcgcggtacgtatggaaattacaaagattggtcatataccctcgaaatatatttgacccggagaaggaccagacgtcatccgccgaaaggcccccgaacgaatttttcgaccataacttttttctttctcaaccaaattaaacattcttggtattattcgaaagcattcgaaaaatgctattagcctgcaaattttccaaaatttttatttatacacaaaaaaatcagagccaaaaaaagttcgaattactggggttttgagttccttctggccataacttttttgaaacttaaccaaaatttttgag

SEQ ID NO: 34467 - DNA, 1307 bp, Heterodera glycines
atctactcaaaacggttcagaattcaataaaaataacatcttctgtagcgaaaaaaggggtttgaaaagtttattttgaaaaatagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattttgaaaaaaagactttacaaaataatacccctgggagaagggagtgggaaacatgatttcaaaattttcaattttttatagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttccaaattttcaattttttctagtctaatctactcaaaacggttcagaattcaataaaaataacattcacggtgcgaaaaatgggttttgaaaagttaatttgggaaaaaaaaaacttaccaaaataataccccctgggagaaaggagtgggaaaaatgatttcaaaattttccaatttttttagtcaaatctacccaaaccggttcaaaattaaaaaaaaaaaaaattcccggggggaaaaaagggggtttgaaaaatttttttgttaaaaaaaaaatttaaaaaaaaaaacccccgggaaaaaggggggggaaaaaaggatttcaaaatttttatttttttttgtaaattttcatccaaaagggtcaaaaattcaaaaaaaaaaaatttcccgggggaaaaaaggggttttaaaaattttttggggaaaaaaaaaattttaaaaaaaaaacccccggggagaagggggggggaaaaaggattttaaaaatttttttttttttttttttttttttttcttcaaaaggggtttaaaaattaaaaaaaaaaaaaaattccagggggggaaaaaaaggggggggggaaaagttttttttggggaaaaaaaaaattttataaaaaaataaaacccgccgggggaggagggggggggggaaaagagagtttttttaaaaatttttttttttttttttttt

SEQ ID NO: 34468 - DNA, 918 bp, Heterodera glycines
caatcggcggggcccaatcgacccccaccgacaaaacgtctcattttggcttaagcgccagcttccagtttatttatcggttcatttcctccaatggaacaaaagttgttttttatttcctttttgtttaaataatcctatcctaaatcgtataatttaattttgataatttttccaattactgtatatttgtgcagtgatttgtgtgcaaataaatatacacccacaaatgatcgtatgctatggaatatttgaatctttgaaccgatcagaaaaaactttggatgaaggtttttgttgttcgtctcataaattttttgtattcaataaatcatatataccgtatatgttctatagcccatggggattatttttcaacctcctcagaaaagggggaataattagagactgggggattatgatagagggattatttttcaaaacacctcgtagactgggggataattggagactgcgggattaatagagactgggctataattagagcatatacggtatgggggggggcacggctaattacatccatgcccatgtctgccccagggcaacaacatcaatatcgcttaagtttttaagcatcatgatggcggagtttcgaacagattcagctcaaaaatagtcattttgaatcttcacttagtttcatgtctaactttcttgaatgcctgccatttactgtttacattttgcgtttctatgatttcaaacaggggttgagcgcgaccgcggcaatttgaattcgccttgctgcgcgacccgcgggatttttctgtccgccggatttaaaaccgctaatttctcgactcttattacaagaaaacaaattggcgttgtaaaacgtgccaaaagcaacagcgatgtcctatgcaatgaaaagacattttttatcttcatctg

SEQ ID NO: 34469 - DNA, 899 bp, Heterodera glycines
ttgaactgggagtccaaattgactcggtgtgtacagtttcactcataaaagtgaattatttagcactaggaaattgttggacgggacgcagccacgctttggcttttattcctacggacatcactcgctagtccatcactaagcattaggaaattgttggatgggacgcagccacgccttggcttttattcctacggacaccactcgctagtccaccactaagcactaggaaattgttggacgggacgcagccacgccttggcttttattcctacggacacctctcgctagtccatcactaagcattaggaaattgttggacgggacgcagccacgctttggcttttattcctacggacaccactcgctagtccatcactaagcattaggaaattgttggacgggacgcagccacgctttggcttttattcctacggacatcactcgctagtccatcactaagcattaggaaattgttggacgggacgcagccacgctttggcttttattcctacggacaccactcgctagtccatcactaagcattagggaatagttggacgggacgcagccacgctttggcttttattcctaaggacaccactcgctagtccatcactaagcattaggaaattgttggatgggacgcagccacgccttggcttttattcctacggacaccactcgctagtccaccactaagcactaggaaattgttggacgggacgcagccacgccttggcttttattcctacggacacctctcgctagtccatcactaagcattaggaaattgttggacgggacgcagccacgctttggcttttattcctacggacaccactcgctagtccatcactaagcattaggaaattgttggatgggacgcagccacgcct

SEQ ID NO: 34470 - DNA, 591 bp, Heterodera glycines
tcctccccgcccttcttccttttcccatccttcagtccaccaccgatcatcttccatcgatcggcccatcattgacggctgaagagagacacaacaaagatgatgatttccgaggaaaagcatattccaatccacacaaaaattcaagtggactttccccgcctctccccgctcgttgcccccagcgcgagggccgatgcgggcggctgtaaaattttctattttgtttcgctttatttgaatattaacgctgaaaaagacaaaacaatttcatcaagtaaaatatctcgaaaaattgatatccctttaaatcagactaaagtttccatttcaaattcatctgctggcgcttcggtatgcgtgccgttggtgttcttttttttgtatatcagaaaaataataattccaatgagaatggaaatggtaaccataactccaacggtgaaaaaaatttttcttaaattgcaaaatataaatacaaaattctctaatcgcttttgggcaatgatttgattccaaaagacacccaaaaagcgttaaaaattatcaattatgaaaaacctattacagcttcccccccccccccccccc

SEQ ID NO: 34471 - DNA, 918 bp, Heterodera glycines
aaataattccgactgtggactaccacttcaaatgaccgctaaggagaaatattcgaaaatatttattgaactctcaaatttattgaatcttcagttttctattggaatattttaggcgacgtcccgtaaataattccgactgtggactaccaaataaaatgaccgctaaggagaaatattcgaaaatatttcttgaactctcaaatttattgaatcttcagttttctattggaatattttagacgacctattggaaataattccgactgtggactaccaaataaaatgaccgctaaggagaaatattcgaaaatacttcttgaactctcaaatttattaaatcttcagttttctattggaatattttaggcgacgtaccgtaaataattccgactgtggactaccaaataaaatgaccgctaaggagaaatattcgaaaatatttattgaactctccaatttattgaatcttcagttttctattggaatattttagccgacgtaccgtaaataattccgactgtggactaccaaataaaatgaccgctaaggagaaatatttgaaaatattttttgaactctcaaatttatttaatcttcagttttctattggaatattttaggcgacgtcccgtaaataattccgactgtggactaccaaataaaatgaccgctaaggagaaaattcgaaaatatttcttgaactctcaaatttattgaatcttcagttttctattggaatattttagacgacctattggaaataattccgactgtggactaccaaataaaatgaccgctaaggagaaatattcgaaaatacttcttgaactctcaatttattaaatcttcagttttctattgggatattttaggcgacgtaccgtaaataattccgactgtggactaccaaataaa

SEQ ID NO: 34472 - DNA, 803 bp, Heterodera glycines
gggtattaccctccgaaaatgatggggcagtgtggcccaccacggtggagcatactgaacatgacgtggtcggacgacctttgcaattctgctcctgctgctgctcaacttgtcttgccccccccccccctccgattgtcttttttctccgccgacccatcgttttctaaaatctttttcaatgtaattttcgggcaacggttgttgtgcatgcttttacaccttttgacttaaaaaaagatatagtgagaataaaaaaagaaagaaaacgaaattggggaacgacggacggagaaaaatgtgcaaaaaaaagcagcgaaatcagcaggagaaaaagcggaaaagggaaaaggcagaaatgtcaaagggatgataatgacttgactcatctcactaattggcattacaaattgacgattattaatgggaaaagaacaactgataaatttcccttcaccatcgatgagcaaaaattttattacaaaagttctcattaaaattaatggcactcaaaaaataagcacttaaaaatatataattaatattaaaaaaactcttaaaaaataaaattattaattcattttattaaatcaatatacaaaattgattattcaaacgtatattacatatttacatatgccttttatgtataaaattacaacaaaaatttcttcgtctcattcttctatataatattattttatcgaatttttcattccttaggcgttgaataaaaaacagtattaaaattgcgcaatgttttggccaaaattgtcgccactttttgcttttctgctgatcat

SEQ ID NO: 34473 - DNA, 139 bp, Heterodera glycines
cgaaatggtccgcgccgaagtgaccccgacccctttttgaggggaccagagcgtttgggcccccgtttttgggccccggggtcgtttgggcccccgcttttgggccccgggtcgtttgggccccaacccaaaaatagaa

SEQ ID NO: 34474 - DNA, 1119 bp, Heterodera glycines
  misc_feature (1099)..(1099): n is a, c, g, or t
atgtccaagtggagtggcgaggctggcggctgcgtttctcccccgcagctccatcgaccagctccatgtggtgttgacacgttgctggggttgctgcgacgcagccggtgtttctggctgctgctgagccgatgttgttggctgcagctggagcagggcccttgcgtctgccatcatccgctgccgttcctgtggtgcaggtcggtcgacgaggcgctgcatgagcaaaggacacttaccgcagcctgctgtcctccggagccgcgttccggatcgctgctgctcttcgcagaccatggttcttgtggaagctgatggaatgcatagacacatttataaagttgggatttcaaaaaaagtggatttattttttgaggattaattattataattaaacagattaccattgtaaaagacgctgatggaaatgaaggatcggtgcagtacaccgaagcgcccagctacacacgcagacaactcaaagccaaatcctcatgtgcatcggtggcaagacggtggaattggttttcttttcgaaatgcgtggccgatggcacgggcaaggatgactggaagcgattggccgcgaaggtttatcactgaattagaattttttgctgaaattttccttaaaaatgcatgcattttttcgaaattgaaaaaatcatcattttttggtgaatctgttaaattttgctacttccccccccccccctcttcaccggtgactctcccctcttttaaaccggccccctacgacgaacgaggagagagggggcggggtgggcaggagcacctcgtctctcgtgctacagccggatccctccctttaaacaaaaaaaatttgaacgcaaaaaaaatttttttattcagctgaccgaaacgagccccagatgggcacgaatgcgccgcacgccggaaaattacgcgctgctccaacaaggctacatcaacacggcactgaaaaagccaaaaaacactgaaaaaacaccgcaaacagttgcttagggtatgatttttttttgaaaattttccggtgggggggggggggaaaggagccccgacatttgcggaagccctgatagcttaaacagcactanaattaagaaaaactgtcttc

SEQ ID NO: 34475 - DNA, 718 bp, Heterodera glycines
tgttgaatggagggccagggagggggggctccacgggggggcggggcggcgtgagattttgggctatcgacgtcattaaattttttgggagaattttttcaacgaaaattgcgagaaaaatttggcaaagaaaaaaaaaattgtttttttttgcccttcaatttgtttcccgccgggacaaactattgatacaaactttttttttttgtacccattaataaacattaaaaattgaaaacttactgtaatcgccgtcgtcgcccagagtgcgcacaattcgaagcccaaaatggctgttcaattcaccgccaaagttcatgctgcaggttcctcgtgcacaaccgaacgcacattcaaccggcttgctcaggtcaacgatcattactccgccggtcatgttgttgatgtacgtaagtgcaatgctggacacgcatctcaatgcaggaactgaaaaattgaaaaataaatatacaaaaaaaaaaaaaacatctcgaccgtatgtgtacaaatttccaataactatagcgctaccgtatgtccaatacaaactcaaaatacggtagcgaaatacggtaatttaaaaatgaattatttttgtagtaattataaaaataaaataataatttaaaacaataatttccttacctgacgggaaaagcgccgcgaagagcaaaaaggccaatttgagcccagctttgaacatgatgctttttgattt

SEQ ID NO: 34476 - DNA, 669 bp, Heterodera glycines
attctgacattctgattccgatcaatagaaaaaattgagttaatggacggaattctggatttccgaacccctgggggagagaaggagagagttgaagcgccaaaaattccggtaaaatgcaaaaaatgctaagtatttcttcaactctaggctgaaagaaaagtccattgggttcatttctaccattgctggaaggtgctgcttaagagtttctgacccaccccccgcgattttggtcccgaattattttttagggtctcgattttctcgaaaatgctttcttgtcctacgcccaatgtttagcagcggctcattcttgaatttaggcataaaaaattttctgatctgactaaatatatttgggcctaaatctcgaaagtttctcaagacatcgctattgacgactatatagggaaggaatgtttcagtcttgagcagcacttattaacagggatatgtatgtgccgtcgccctcaaaagattttggaaattgacattccaagcccaaaaattgccggaaatcggcaatcggatagtccgagcccaaaaattgccggaaatcggcaatcggatagtccgagcccaaaaattgcgccggaattcggcaatcagaaatcggcattacgacatatccctcttatgatagcacattttttttcatttacatat

SEQ ID NO: 34477 - DNA, 961 bp, Heterodera glycines
ttatgctgagagagcggttggaattcccttgactgttccttacaggaagagatagccattgtccaaatttcacgatcaaatggcgctgagaaaaaaattccagaacaattagtatcggcgtcattatgctgagagtgcggttggaattcccttgactgtagccagaaaaagagatagccatttttccaaaattttcacgatcaaatgcgctgagaaaataattccagaacaattagtatcggcgtcattatgctgagagtgcggttggaattcccttgactgtagaccagaaaaagagaaagccatttttccaaaattttcacgatcaaatgcgctgagaaaaaaattccagaacaattagtatcggcgtcattatgctgagaatgcggttggaattcccttgactgtagaccagaaaaagagatagccagttttccaaaattttcacgatcaaatgcgctgagaaaaaaattccagaacaattagtatcggcgcattatgctgagaatgcggttggaattcccttgactgtagccagaaaaagagatagccatttttccaaaattttcacgatcaaatgcgctgagaaaaaaattccagaacaattagtatcggcgtcattatgctgagaatgcggttggaattcccttgactgtagccagaaaaagagatagccatttttccaaaattttcacgatcaaatgcgctgagaaaaaaattccagaacaattagtatcggcgtcattatgctgagaatgcggttggaattcccttgactgtagaccagaaaaagagatagccatttttccaaaattttcacgatcaaatgcgctgagaaaaaaattccagaacaattagtatcggcgtcattatgctgagaatgcgggtggattcccttgactggagaccagaaaaagagataggcattttttccaaatttttcacgatccaatgcgctgag

SEQ ID NO: 34478 - DNA, 420 bp, Heterodera glycines
  misc_feature (10)..(10): n is a, c, g, or t
  misc_feature (12)..(12): n is a, c, g, or t
  misc_feature (17)..(17): n is a, c, g, or t
  misc_feature (19)..(19): n is a, c, g, or t
  misc_feature (32)..(32): n is a, c, g, or t
  misc_feature (41)..(42): n is a, c, g, or t
  misc_feature (44)..(44): n is a, c, g, or t
  misc_feature (48)..(48): n is a, c, g, or t
  misc_feature (52)..(52): n is a, c, g, or t
  misc_feature (65)..(66): n is a, c, g, or t
  misc_feature (86)..(86): n is a, c, g, or t
  misc_feature (134)..(135): n is a, c, g, or t
  misc_feature (139)..(141): n is a, c, g, or t
  misc_feature (176)..(176): n is a, c, g, or t
  misc_feature (182)..(182): n is a, c, g, or t
  misc_feature (185)..(186): n is a, c, g, or t
aaaaaatcantnaaaantnaaaaattcaatcntcataaaanncnaaantcancttccattccaanntttaccctctattatattancaaacaatatttattttattaatttattaaataaaaaataattaattnntttnnntaattaaaatataaatttattttaaattttatatnattttnttnngggtcaaagccaactcgtacaattttaaattgacgtggccataactttttttagtcagccaatttcttaaaacttttttatcattcgaatgcttttcatgtttagaagcgatgattaagcagaagctaagcgattaagtcatctcacaaaaaaggatataatttataaattgcgaaaaagtctgcttttgtgagaatttttaatgttctttaaaatgtatctttttgtgagatg

SEQ ID NO: 34479 - DNA, 853 bp, Heterodera glycines
  misc_feature (12)..(12): n is a, c, g, or t
  misc_feature (24)..(25): n is a, c, g, or t
gtcagatgaaanattctgtttatnntttttgaataggaaaatttccccccccccgaaggatgtcaaaacaaatttgcatttgttttcttgtttcctaattattttttggaattctgcatctgctcatcacttattggacatttctctaagaactgaaagtgaatgtccacttgattgtggaagacgtgccattcagcaggaggaacgagtaatgctgcaacttgactcaatagggaacctaaaatatagcaatcaaaatcaaatgtttatttgaatatttttattggttcgaaattttttatattatgtaatttcattaaattttgcttaattgaatgattgaattttctaccaaatttttttttaagattttcggtggcaccatcgtcgaacaagatttgtggccctggacttttctgctttcagcaacagaatgtgatggaaaaaacacctattgcactgcacaatatatcggtgagcccattatttaattttattttttcaatttattcatttgtcaatgaagaaaacctgaaatgagcattatttcgcacaaaaaaggcaattaggaaattctgaatttgttaaaatttaaatatttcttgcctgccgttggcaaaaggatcgtcggctgggatgggttacatgcaattccgatttcggaatccgtttaaaattagatataaacattctttaattactactccggccttattttttccgcgagtcttttttaatgctacttttgctaaccgctttttttgcggcgcgccgttctcaaaaaaaaatgtttaaagcatccggaaatttcttaagaaaaatacactttttcaaaattttccattttcattaa

SEQ ID NO: 34480 - DNA, 658 bp, Heterodera glycines
tatttgaatttaataaaaatttatttacctatttatttccaaaaacaacaagcggtaaaattatatatacggtaaattaaatcaaaaattttttccattggtcacaaatttgccagtcaatcgtttccttttcccaccgcacccattcattcagaacgcggtttatcgggcaacggaccaacaacattttccgagccgaaccatgcttcatgcgccatttgtcgacccgtgaaagggacattttttccccggtacgtttgttaaacaatttaaaaggggccacagtgacgccaagggccaaagtaaatacaatcacataattgacagcagaagtggcattttcgaaatgctaaaacaaaataccaaaaatattacaaaaaactgactatattgcataaaattattaacaccgttttaagcatttctattttttgtctcacatttccagataaatcagcacagacgacaattttggcgaattgtccggccgaggcgacaaaagccagtgcgccagtgattgtccatcatttgcggaggaactgttatcgggcggaaagtcggggaagaagtggtgcccaaaggggacttggacaacgcgaagcgatggacaattggcgaaggatgggcgttcgtcaataggcaaatcaacgaaaatgtg

SEQ ID NO: 34481 - DNA, 1139 bp, Heterodera glycines
tttgttaaatttataaaaggagtcaaaaatataaagttaataaatgttttgttcgaattaattataaaaaatgatttatttaagcaatttgaaaaattttctgatttttgactcaaaaataagatttttttatttcaaatttctcctttataaatttttctatatatttttaatttaataaattgattgtcctttaaatttgtgcattaaaaatatttttgtgagtttttaattaaattttcgaattactcccgctcccgcccgggactcccgttaaaaatggatgggattttaacgggagcgggatttttacgggaatcccgttcgggactcccgtcccggaaaattttgaactcctgatcccgctcccgctcccggaaatttttttttaccgtactctagtatttagggagttagagttaagtaagtaaaaatggtcattttagaggtaggtatttttgatggctgatttaaagaaaaataaaagagatacagatccagagaaatagtgattaaatagagcaaagttaggactataagaacacaaaaatataaaattttaattacaaaaattgaattattggagagccgagactgaaaggggtctccaaaaacggcatttttcaagaccaccaagtaacataatgttttaaaagtggttttggaaattctgaatttaattaaacaaggtaaatcgggtatgttgagttcgaatatggtcttagatttggtctctgggatcgcaacaaacctgtagctcgaacttcatgcatggagttgagcagtaaaagctcaggtttaaaagataggtcccgtttaaggccatattcgaattctactggtctaaattgtatagaaaaactaagattttgttatatcagctttggtttttgaccataaaaaattcgagaaaaattagtgggccaattttcaattttggcatggtcgggaaaaaatgcagaaaaatgtatcaatcaaataaaaagtgaaacgatagtaagatataaaagagggcaccatgaagaacaaaataaaaaaagaatcatttaaataggcgcagaaataacggagttttgaatttttaaaaattggaaaaaatttggatatcaaaaattatgttccaccctaagtatatactt

SEQ ID NO: 34482 - DNA, 602 bp, Heterodera glycines
cattttaattcaaattttttataataaaatactcgttttattcattaaaaacaattttgaaaattaataagtgcatatttatttaatttgaaatggaattaattttttacaaattcaaaaataaataattctttaataaaaataaataaatttaaaaaaatttataagaaaatcttcaaatgaattaaaaacattgaaaacagcctaaaaatgcatataaaattaatgtacgccgtccggattcgaactccccaaaaaggatgcctcagaatccccaatcacacagggattctgaggtcttgacgatgtcataactgaaatcagatttcagattcgtgatcagtggcccaaataacccctaaaatcatatttttggaagatttttggcgaaaaaattttttcactcaaaaatcctgtcacccccctttggtaccgaatcacaaaatcacttttatttttgtaacatttttcaaaaaagcgataaaaatgtaaaacaaaatattagaagaggtacaacagtgattagaagaggtacaacagtgattaaaagaggtacaaaagtctaacttgttatgagatgtacaaaaataatttcataattt

SEQ ID NO: 34483 - DNA, 818 bp, Heterodera glycines
tttaaaatttggatttgacacagtttaatttctgtaatctttttttggtgttaatgatgtcgtcaaatgaagaagaagaatccggcggttcaaatgatgaccaattttcgtaagtataaatttattgaatttttataaagaaatgcctaaattacatgtccaaaagtgtggtggcctatgtcggaaagggccaaatgggcgatggcccagttttttggttaagtgtcctttctcatttgttcgaatccaaccaaatttttattatttatattcttaacaagtaacttgtgctctctattagcctgtaaaatttcaaaaaattacgttgagtttcaaaaaaaaacaataaatttgtgccaaaaatgttcggaaaagcagttttttttaaattttatcttaacttttatttttatgacacaatccgggactatgtaaaatgtataaaggcttacattttgttacaaaaattgaaaacaaattttttattttttttgaaaatattagctctccgatcagtccggttagccccattcaaccgatgagcaccgattggagcaacgcaattgacgcgcaggaaatgggcgccggaggtgttggaggagggatcagcagcggaagcctgcatgagagcctgcacgaactttcgcgttggaaaatttttggaaaaaaaattgatgcttccttgcataccttatgaaaaatcgcgtttttagggcaagcgctcaataaaaaattctcaaattttctctcttcaatgcttcctaatttggctccgtgtaatcatctattgaacattcatagacatttggataactcta

SEQ ID NO: 34484 - DNA, 754 bp, Heterodera glycines
caattactaattaaattaaatggaatttgggttgcttcacccggatgaaatcccctttatgggcgacctatactgactttcactactgatgctgatcatgccaaaatttataccccccccccccgccactgtgcgcatttcatccgacccaacgcagtttatggacaaattttagttcaagaaatcactaaatttatccttataactagggctgcaaaaaatatggatataaaatcgcgaaatatggccataaaatatggaccaaaaatcgcaaaatatggacataaaattgcgaaaatctcaaaatatggacataaatggcaaaaacgtcaaaatatggacataaatttttcaaaattgagtgtaaaatttcttcaaatttattggttgaaattgcatatgagatatatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttattttgacataatttattaatttttaagaaaatttaaatttattcaatattctcgagaaattttggcgaaaaaatgattttttgaaaaattttcggtttttgggctcaaaaaggctaatttagctgatgggggccgttct

SEQ ID NO: 34485 - DNA, 1053 bp, Heterodera glycines
  misc_feature (919)..(919): n is a, c, g, or t
  misc_feature (959)..(959): n is a, c, g, or t
  misc_feature (1002)..(1002): n is a, c, g, or t
  misc_feature (1009)..(1009): n is a, c, g, or t
  misc_feature (1013)..(1013): n is a, c, g, or t
tttggctcggctgaacaccgaggcggaaaacaatgttttttacaaattgaaggcacacaaaaacaatctgatagtgaaagtgaattttgatcaaaaatgttcggaaatgtttaaatttcttttttcacgtcctgaattgctcaaaaaaattgctggaggtgagaaatatttcgtagatgctcattttattgaataaaatgcaaaaaaacaacgttttaaaaaatgtacttaattttgaccctaaaaacttatttttactactgatttacttatttcggaacattttcgatgcttcccgagtgaatataatccattttttacactgttgataaagagaaattcccttatattcctgctgctggtaaaaaagttgcttgatatgaaaacataagaacagtagcagcaaattgtccgatcatttatttttgtgtgttcgtaaagagaaagtttggcccaaagtttgcctcaatttgatcagcaggcgaaagcaaagaaacgaatgggaacaactgctgctgctgctgctggaggtgatcaatcggaaatggaacggtaatggcggcggtaactgaaaataaaaaatgtttttttctttattttttattcgccatcaaaaataaaaataaattacgaaaaataaaagtcgattgttctaaaaattaaaaacttgtccattaatttaacaaaaacatatttgagcgtctttttggcttggtgaccttttttccttttgatgattgaaaaaatcgaattaaaattaaaataacgatagaacatatagatatttccgatcgaaaaatcttagtttaaatgttttatactttggttaatagttctgtgtttctaaaatttttaaaaccaatatcaaatcgaaaatcatttgactttaatttaagaaatattaattttgtttgtttanattcaaataacccaaacggtgtcccattttttgtgagaanaatttcacgagttgtcaaataaatgccaagaccgaacacatcngcatgcngtanatgagtgtgccacatttcaaattttgctggtaaccattat

SEQ ID NO: 34486 - DNA, 342 bp, Heterodera glycines
  misc_feature (5)..(6): n is a, c, g, or t
tctanngagtcatttccgcccaaaatgacattgtaaaatttctttcgtttgtttctttccttctgtcattcatttgggcattaattttttgagcaccgtttggtaaagttcggaacggcggaaacgcggcaattgatcattctcgagtaacatgtaaatttcctggaattgtgcgggaatggccttccaaatggcactataaattgtttttttgagtgccttatttgccatttccacacttttgaagtcgggcatttgcgctttggtcgcctcgcgcaatttctcaaaaaaaaaattaaatgaaaataattaaatttccaaatttattttttatttgttatt

SEQ ID NO: 34487 - DNA, 1222 bp, Heterodera glycines
agtttaaatgtgaattatttccatttttatcattaatttgaaatttgattgatcctccagtcatatttcattagcatatcctgctcaaccaaatgatctaccgtaacactagggttacggcatttgtgccgaaattgggaaaatgggccttaaaagccaaatttaaggcgggggaggggtaaattcaggaagactaggaacaaacatattccctactaattatcattcagtccagcttttatctcaccacagagtcggacgcgtgtccagtcgttggaccccgaaacaatcgctgcaaatgcgcgcttctttgacggtgatcggagtcgggtgccgagaagggcgatcactgtgggcgttggcaccataatggaggcaaaagaggtgttcatcccggattggatcacaaatgttgcttattattgcggtcatgatcaaacaattcgctgacttcgacccttactttaatcaaattcccaaatttgatcagtctgctgatctcaacagattattcattaccctgagattgatcagttaagcgttggttgataaggtgccacagatcgctgataaaatggcaatttaaaggaaatgattttccatttaatttcggctggacatttcaaaacattggtctgtcccccatttttaaggtgcttttgctcgtgaacggagcgcacaaagcccgcgcattgcgcgccgcgttggaaaaaggcatttcgcacatgtgcaccgccagcggtgggcgaagggggcgaccggtgccaaacgcttacctctgaaaatatctaaaatcgaatgcccagattactgttgttgtgcgcaatatgttcccataatgtgcgcaaatagggtcatgttgaacaaccgttcgtacacacacaacaaaccgccaaaatcttaaggtgagccaaaatttattgaagaaaaggcgcgggaatttgacgagtcgggccaagtcttcgacgccaaaaatgcaaacggagtgccgccatttgtgcgaggggcaaaacgcgtgcggagcccataaagcctccctgtgtcaaaagaggaggaaaatgtaaaatatttgtagaacccgctcagcagactatggcactaatacacatttatatgagggagaatgccatattttttctgtctgtgccattttgggagtcggtccaacatttatttaagtatttgccatacttttaaaggttaggtcaatagaatataggtc

SEQ ID NO: 34488 - DNA, 943 bp, Heterodera glycines
agagagagaaaagggaatgcagagagagaagagaacgcgatacagaatgagagagggggagagaaacaaagagagagagagacaaaggaagggagagagaggggggatgagatagagagggaaggaaagatagatatgtagagagaaagagagggaggggtggaaagggagataaagagaaatgatattactattctaaaaacaaagaaggattgatacaaacaattgggatgaatgaataaatgttttaaaaaaatcattttaaatattgatattactatttaacaattaaaataaaaaattttattttgaaaaataaattaataaaatttaatagtattttacttaaatgtataaagtttcatttaaatatttctactaacaataatgataataaaatttttttataacaaattaaatatattttaattgctattggcaccaaactaattgtaagtcaagcagataaaaaaacatataaaagcaatttgttaagaatgttaccaataatataacaacaacaaatataaaatattttttaaataaatttatttaagtttctaagaacaatgaagaattttacatttagcaaaaaacaaacatttttattcatgatggacactgtctaaattaaatgactgaataacttacacctgcacatgaaatgagattaaaatagaaaatgaaatgataagagaaaaaagagaaacttccgctaattttaacaaagaacggggatatgcaaacttgagattaaagaataaaaaaaatgatatataataatcattttatatttttttattctctatgttccgttttaccttcattgttctttaaacttaccaatcttttttaaccaaataatttgtgttcttataaaatgacgtatagcaattaaaaatttatagaaatggagaaaaaaaatcttattaagttaatatta

SEQ ID NO: 34489 - DNA, 560 bp, Heterodera glycines
ctctttctctctctcttccttttacgccccgcccctcccccccggtgcgacgggccaatcgtcgcctcccatcctcagcctttcaccattatctccccttcccacccgacgtgtgggtgccttccttccttcattcattccctccttatcatccctccctccccctccttcctccccaaaggtgtcactgatctcaccccttcctcttctcccccccccctctttttccccctttcgccccttgaaatatttcccgctttttttagcacttttcttcaacgacacatggctaatggctaacggcgccaacaatttcctagagggctcttcattttccgcttggccccatcttccactgggcaaagatgaggaaaagctgagcaatggtacggcgccgtcccccgtgtaaccccccaccgctttacgtcccgatactccttgcgtcccatctttacactccgtagccagctacggcctcctcgtccacttcctcctgcatctcgacaccggccaacgactcatctttggacctaccgtcctcctaccctcctcttcccccg

SEQ ID NO: 34490 - DNA, 885 bp, Heterodera glycines
  misc_feature (33)..(33): n is a, c, g, or t
  misc_feature (631)..(631): n is a, c, g, or t
ggggacctctagagtcagcagaaagtgctcctntttcgagtccaaatctggagttcccccctcgtcaaaaaccaagggcttccttctgctctgtccccgtgtcaaagctcaaaacaaaagaataatcaatgaacaaaagaatcgctgcgccgccattctctgcccaaaaagatgaaacatttgttagcattaatctccccccccctctcatcagtcgcattgcgattctcaagtccgctcagagtgagctcttccgcagaagtatttgttttccctgcctgagacaaagtaataaaaccgagcagaagtgtgaggacaaatatgaaaaaccgaggaggaggaggagggagagtaatgtgttaaatggaccactctttcaaatggtcggcacaccccaaaagagtgggaaattggaaaagaaaaagcccggctgatagcctcaacaaataatgaataaaaatttagaaagtgaaggaaaaatgtatccttccgaatccgtagaaaataaaaataaaaaaacaagaataaatggaggaaaatacaaaaccgaatgagtggataatgggaaataaatatgtgaaataaggaagaaacggtactcgtgtagtttacaggctactttaacatacanttttcaaatcccttatataatggtgttttagaaattaatgaaaatgagttttaaggggttttcaaggtcgctgatcacgaatccgggctcagatcagcgctaccattcattacatgagctgtacaggggacaagaattgataggcttcctgtaccaataatactatcattggcaagatgcccatgaggatatcatccatacactttttaaattttatacttcctataccaaggttaccctcatgggaaagatgc

SEQ ID NO: 34491 - DNA, 1170 bp, Heterodera glycines
caaattttctgactaaaaaaactgaaatcaattattttcgaattacgtttgcaatgctatttcacaaaatttctatggatgttgtgggcggtccggtccataagcgaaaatctaaattttcttaaaaaaattttaaattaatgttcttacaattatggattttcttttattaaatatttaaatgctaatatatctgcgctcaaattttgtatagatatttcattatgtcaataactggccaatttatgaatatttatccgtttttctatttctcgaaaataataatttttatttgttttttatttattatatgtgtttttgtaatttacgtttttcaactagaattggaataaacattaaaataataaataaatttacttattttaaagttttaagagattaaaatataaccaaggtttgcaaaagaaattcatataatatgttttatgcttttaattataaaaaaaatattgccacaatgagaatgattaaaattttattaatttatttttttaacattttctgaaactatacaatttatattttatttaaaatgataaatattttcagattttgtaatgaaatttttttaatatatgaatttaagttaaattattgatataccattctttttattcgcattaatatttcattttaatgatattaattaagtataaaaatactttattctgaaatttatctttaatcaaaccaaaatatcctcgcagtgtttaattttttgttgttttagattattaattattttttaatattttcagagaacgaaaaaatgccaaaataggaaaaaactgataaaatgctaattttgagcttttcatgcaatgttcgcaatttaaaaaaattgtttttaataaaatatttatttttatagtttgccaatactttatttatttatgaataaaaaaagagaagggcaaaaccacttactctgacgaatgttcagataatatgccgtagagtaagtgataaatatatggatgaccaaaaataaaatcaaaatattgggttggtaaataagtcctgtccgttttttacattttcatttaaattactgttcttacaaatcgaagaattttgctaatattttgatatatagcctcaaatgtgctctacaaaattgcattaaaagattttggccgactttcaaaa

SEQ ID NO: 34492 - DNA, 909 bp, Heterodera glycines
  misc_feature (513)..(513): n is a, c, g, or t
gtaagagcaaaacaactctgttttcctttctttagttgttacaagtaacatgaaaaaattaataagtaacatgtaacatttaacatgttatgtgttacatgttacgctaatcaaacctacaaacagcaaaaactagaaactttaacaaacgcacagctaaagtattcgtgcatatttaataaagcatagcataacttacttcgtgatcaaatcgtaaaactcttccggtgggttccatggcagtgagccatcacgatgtgacggaataagttggtaaagcttccggctatggtaaattgcttgcacatcggcacgatgggaaggcaaaataattttgcgtgtgtgccaaggagttcgggacgattcgaccggacaggcgcctatcggcaccgccggaccctaaaaatcctttattttcttaaaatttttgattaaaattgcaaattggccatttttgtgggcaaattctgttagcttatcacattaaaaattacaaaaattttcccggcggtntcttttaacggaataattgcagtggtgaagccaaaccttaaaagcacacaacctcatgtaaattgaaatgcttttttctcaaagccgaacaaccctgcaaacagtttcgggaaaagagggggcgaatttaagaaacttaaaccttgccaaattgacgggcaaaatgatacggagctgaatcatcttacaaaacaatccccaaaaacgattccgcgagcaacagaatatgccaacaaactccgaagacattttgacgaagagatgaaaaatgcacgaaactgctaccgaaaatgccaagaaagaaagggccaaactcggaaaaacccaattgaaaacgcgaagaatcgaacaacccacagacgatccgagagatgaacatccccacaaattcgccac

SEQ ID NO: 34493 - DNA, 1394 bp, Heterodera glycines
  misc_feature (1378)..(1378): n is a, c, g, or t
aaagaggtacaatagtgattaaaagaggaagaacagtgcttagaagaggtacaaaagtgatgagaagaggtacaacagtgatgagaagaggtacaacagtgtgagaagaggtacaactgtgattaaaagaggtacaatagtgattaaaagaggaagaacagtgattgaagaggtacaaaagtgatgagaagaggcacaacagtgattaaaagaggaagaacagtgattagaagaggtacaaatgtgatttaaagaggtacaaaagtgataaaagatacaaaagtgattagaagaggtacaaaagtgattagaagaggtacaacatggtttaaaattaaataaataatgaaaagtttttataaaaatcgattgcattttaatttaaaatttttttataataaaatactctttttatcattaaatataattttgaaaattaataattgaatatttattttgaaatgaaattcattttttataaattcaaaaaataaataatgaaattaaataaattaattaaatatttataaaaatcttgaaattatttaaaacattaaaaataacccaaaaatacaaagaaaaataatgtacaccgcccggattcgaacttccccccccctcaaaatgatgcctccgaatccccaatcacacagggattctgaggtctgaacgatgtcaaaagtaaaatctgatcacgtattcgtgatcagcgtcataaaatacccctaaagacatgtttttggaatattttcggtgaaaaaatttttccacccaaaaatcctggtcacctccctatggtcccgaaaccaaaaatcacttttatttttataacaattcgcaaaaaagagataaaaatgtaaaataaaatttatattatagagaaaaaaattgcgaatttttgtagtattttacttttacagaatgacttttcagaagggagttctgaatttttttctgaaaaatctaaaatttccagaatttctggaataactttttttctttagaagatagaaatcccaaataaatcccataaaattctcccgatttttttgctatttttaaagctttaaatcacttaaattgaccgttcctccattgagttatgaattttcaaattttagcccaaaatcctgagggtcaaaaaattgccaaatatttttgaatttttaaaaaattctaaaatttcctaaactgaaaattaacatcagattcgtgctcagcacatcaaaataccccagaaaaatatttttgacccccattttcaacccaaaaaaaattttcgaaaatttctaggggggctagctcgaaaatttttgaaaattcccgcaatatggcacaccattcgatagagcttaaaaactctacaatttgccctaangagtttttcgataaaa

SEQ ID NO: 34494 - DNA, 751 bp, Heterodera glycines
ggggacctctagagtctttattccaatcgaccacgttaattcattctctatacccctcctggcttatttcatgaaattatatataatttaattttacataaagaggcaaatttttacagaaaataaatagacgctgactaattagctaacatttataaagaaagtagaaatttgattaaatgcatatacaaaatattacttttttaaaatttgtataaagttcctagtcgtatgtgctttgcgttggttggttggcgtgggtgactgtggtggttgggccgtttttgcgatattatggctggaaaaaagatgcgatttcgctatggggagcgcggccgtctgggttcaagtgcttgcttgcgcttgtgctcggcattgaacggtgatggctgctgctggggtgccacctttgtcgtggcctcagtttctccagcgattggcagctgtcgaaatgaataaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaacacgagacataagcgcccgaaggcttggcctgaggaagtgcctaaaccggaatccggagtgctcg

SEQ ID NO: 34495 - DNA, 967 bp, Heterodera glycines
tctatggaagtcgttggccccaaaagcggcgttgcatttcggacactttcgccgccgattgtcatagcgaaggcggatgcattcaaaacagaacacgtgatggcacttgtccagaatggcatttttccgattcactttgcaacttggacaggtcagagactccttcaaaaattaaattttgaaattatttgctttcctaaaattctttcgtttctttgtgttctccgttatttactaaccttcaaaatgcgattttcctcctgcagcaattcgtccacattttcgtacttttccattctttttgctcggtccaacttccgtttcaacgaacttttctcttcctcaagccgtttaattttgttggcattcgcttcgtatgaggatgccttttttattacgctctaaaaagggagagaaaatgaaaaggtattaaatattttcgttttccgtggaaagagacttcgattcatccatcaccactgataaattttggccgaaatttttacgaaattgcccccccccctgtccacctatgtttattagccaacctcgcgaagttcagtgaattggatgtccaatcggtccaatctcaagcggaggtccgttgccaattgtgaaaattcaatgccctttttgcgcaatgtttcattgttttggtctctgatcctgaattgccttaattagcctttctcctgcatagctttcccaaatgcttgcctcaattcgtgctcaagtgtcactcggttttcggtgagtactctctctttctcctccaaccgttggcaatgtaacagtttggtggccaattggttctccaacgactgaatgttttggtccagcagttccttctcgtccctcatctttttctgtgcttgtgtgcttcgaatgcgttcgctcatcaacttcagatttacgtcgtccttttctcgcaattgtccactaattttttggtgctgaaaagtttaaa

SEQ ID NO: 34496 - DNA, 1727 bp, Heterodera glycines
  misc_feature (12)..(12): n is a, c, g, or t
  misc_feature (148)..(148): n is a, c, g, or t
  misc_feature (867)..(867): n is a, c, g, or t
gtcatttcgctntaattaataaaaatgtacaaaacaattctctaaatgggcttaattttgccgggacttaagtcccgctctgcttcaatttaaattaagtattcatagactatatataatttaaaataatgaaactccctttttttgngcagtttaattaaagtatgtttaaatgaggtgtgtgtacttattctaatgttatacagtatacgtatctcccgtcgaacattttctttgttggccttgaaaaagttcgctcaaccgttaaacaaaccttggatgaacagagtacaaaaaatgcagaagtggcggaagcatttgcgctgctcaaaaaacaccgcactcaaatggacagctgcgaaagtgtcggcacaaccgacgcggaaggggcagaacaaaagcagaacgtaagcaagctaatgattaatttgtaagatgaaaaaatactctcagaagtattgctaatacaatataaacgagctggggaagttaataactttagcactaaaaacaatttttattttggaacttaaaaaaatattggttttaacaaaatttaaaaattcaattattgtaaaatggagtaggtcggtaggtcacggtctaatcgaaaccgaaaaccgggctatttgttcattacctgggatgtatttaaagtatgttgaaattccgaaatagttatgtatgtacataagttttatttttaatattcttctaaaatatttccaaaaattatttagttatttattctctaaaattgcaatttttataaaaatctgttaacaaatagagccaacctttcttaaaacagttctcaaaatcgaaaaatttgttcagttttttggaacaaatctgttaacaatattntgatacatttgtattaaatatattaaaatttggttttaaataaatccataaaataattattgctggtgcttctttgttcggccaattcatttcaatttcatttggcccattaatcactgcgtattcgctcgacataggcaatattcacctacacacgtgcggcccgtccattgttagctgaagcaaatgcacagctacacaacattactatgacaaattccaagaacgaagacatcaagaacattgtacaataatttatttattttttgtttttataaatattttattaagtacattaaaatttctatttttttctcagattgttgaattgaaagatagtattgttgggtcgctaatcgagttgcgcgatatcgataaatgcgttgaaaaaatcatgacctcaaaggagtcaatgaacgaggaggacgaagtcaatcaggtcctttttctgaaaaatatacattatcgttaagattagtaaaatctacaaaattcaaaaattgtttttccagattaattggagttgctgggatgacgcaatttcgtgctttcacataacctgggaatattcgattttgtattctttaaaaagagtaagtaaattctgacaataacaaaaactttggttggctaataatgttaagtgattttttaaaattattgtctagcagaatccgaggcagtgatattattacccgttgaacattcttgttctcgcaatttgcatgaaattcggcaatttttacactgttaaaaacaggggttagggtgacaaaattgaagtagggatttagaaaagctaaaaaaatcctgcatactaaaggttattcgttcaattcccttgtggaacatttttatct

SEQ ID NO: 34497 - DNA, 605 bp, Heterodera glycines
ctttacaaattttaaccagcctttcctcccatggattttcccagggggataaagccggaataaattcccaaagaattttatttttagttaaataattatctaatttcgtttcattttttatatttgtgttttttggttcgtacatttctccagcctttgcggctaatttaaatgtttgagcattatctgacattatactttttggtttccctcgtctgcttgcgaatcttcttaacacatgtaaaaatgtttctgctgttaaatcaaacactggttctaaatatacggctcttgttgtaagacaagttattaaaacaatccaatattttccacttggttcacctttattttttgatttgattactgacggacccaaatgggtcggggtcgttttcgcgtgggccgttttcgcgtggggcgagtttttaaactataacttttttcattgtcaaccaaatccaataatcttggtatcattcgatagccctaagtgttctctattagcctacaaaatttggaaaaatttcggtaaggttcataaaagatatggtcagaagagttcaataaacgaaattttccaaatttttttggctcgaacttttttt

SEQ ID NO: 34498 - DNA, 858 bp, Heterodera glycines
tttacgtgtcagagggtgcgcatataagcgactcgctgtgctcgcacactgcatttcatatagctggtaatttatatctctccggcataatacagaaaaaatctctatctttttttttggaatattttacgtgtcaaagggtgtgcattaagcgactcgctgtgcttgcacactgcatttcaaatagctggtaatttttatttgtccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttgtccggcctaatccagaaaaaatcactatctctttttttttggaatattttacgtgtcaaagggtgtgcatttaagcgactcgctgtgcttgcccactgcatttcaaatagctggtaatttatatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttttgatattttacgtgtcaaagggtgtgcatttaagcgactcgctgtgcttgcccactgcatttcaaattgctggtaatttttatttctccggcctaatcccagaaaaaatcact

SEQ ID NO: 34499 - DNA, 1309 bp, Heterodera glycines
ctcgtcataaatgctttcactccgttcgttaccatcccctttaaagcgttcgtctccgccatttgttgcggatggtcctcgctgactgtgattcgacggtctttcgccaaattcgggtcgtcctcctccgcctctgccgcgcccgaaacgttctccgccgtctccttcgcttccgcgaccaccgcccctacggtcaccgtaactctctcttccgcgtccgttgttttcggcatttggccgggcattgcccaaaccaccattttgacctagaaattaggataaataatacaaaagaacgggggaaaaaccttcggagttcatgccacgaccacggccccgcccaccaccacgcaaaatagtgccaatgctcggcggatcattcgaagaattgagttctattagaataaaaatgaccacaattactctcaaatttacgggaatgacagaccaactgcattggcaccatgtccaaaaccgcgacggtctcctggaccgagttctgtgggatgaaattgaaaataatccaaataaccacacttaaataaccgaccaactgcattggcccctcttccaaaaccacgactcgtcgttcctccgcctcctctcgccctgctaccattgaaaacggtcgtcgagtcgaaggtgaccgatttgggtggcgaaatctccgcattcactggtggacgactgatgttgttgttttgtgctggtgctaaccaccaaattatgagtgtttagcactgaaaacgaacctcctcttcccaatccgccgcgcactcctcgcgtcccacgcccagtgacggaagcgacacgcggcacagaagcgcctccaaatggcacaggctgatcggcgatgggaagctgatgttcgccttcattggtggcagttccatttgctttctgcacatccgatgctgcgtcaatgccgttgcaattacgcaaaattcccctcgtcggcacgttgacaatgggcggctgctgcgatggctgagagtcggaaaaatcgatgatagttccttctaaagaaaacagaattaaaacatgaaataaacggtttataccgtttagattagcctctgaaattactccaagtccatcattctgaagatgagtcgtcccattctcagtttggcttggggcaattcctctgccccctctgcctcgtcctacaaaacttattgttaataacttaatgtggcaaattgtacacaccaaaacctcgagacccagatgacatcactacgaattttcttgacgattttccttgcaagagttttacgaaaaaattggctaaaaaattccaaatttt

SEQ ID NO: 34500 - DNA, 394 bp, Heterodera glycines
  misc_feature (53)..(53): n is a, c, g, or t
  misc_feature (57)..(57): n is a, c, g, or t
caacaaatggccgtcgatcacctcggccgggggacagccgtaaaggaaacggncggnaccgccaatcaacccgagttttcctgcgattttgctgggctttaacgggattagcttattttttgtccctaatattcttttatgtctgtctttcttttctcgcctccctcatctctctctctttttgtgtctggcttaattttgattgttcctccggacccaacaaatgctttaacccccactttgtccatgcttttgctgatccgatcagtttagcccattcggtgttttccgggggcgtatgactaagctgaacaacaatcgattgatcgacccgctcatcgaaatttcttcattaacaatatttttaattaattaatttgtttatcatataatt

SEQ ID NO: 34501 - DNA, 860 bp, Heterodera glycines
atttcttaatttcaggtaattaattttttttatttccacaaaatctccccaccccaaaaaataatggcgccgaacaacaaaaagccgccaacgccgacgaaaaaaacgtctcgcgcttcttccagccaattcgctgcttcttgcggcaccgatggctttgatgactgtccgccctccttggcttcttcctcgttacgtgccattggcttgtcctttgtccgtgccaaactccgatggcgacggttggacgaatttcggctggagtgccgtcgggctgtgatcggatgggcattcatcaacgaatcgttaaaggttcatgtgctcgacacggtggaagatctgtgcgcggaactgagccgatggagtgaataattaaaattataatttattacaaataattaatatttaaaattaatttaagaaaataactgttagtaaaatttatttcccattattattaagatttttaatttataattttttttattttaatttaaaatattaattaaacagtaaacaatacgcatattttttattattttaaaacatattttaattaattaatttaaatttataaagtgtttaatttaattatgtttaaataagtttattaaaatgtattttattttaatgtaatttattttttattaaaatatacttaattttttctttttaattgttttaaaaatatataaataattaattaatttaatttaatttcagttttcttattttagcggaaaagcatgctcaaatatttccggaggaagaaaatcaggccattcgacaagccgccttcaaggcaaaagcacaaagtttggactcggcccattcgctgtacagtcaacgcacatttaaac

SEQ ID NO: 34502 - DNA, 1046 bp, Heterodera glycines
ggggacctctagagtctgccttcacactttttcagtggtatgatatgtgccgtctttgtcggttggattctgttgtggcacatttgctgaaagacaatttggagtggacttttccggaagcgattgaacacgaaatggacagcaataaccaaatcacattggcatcattagctgctgcagaaaatcaaaatttttcagcacaaaattcgaaaatatttcttggcggaaccattggaggtgatacacttagcctatcaatgaattaatttaaattaaaaacttaaattgtttaaggaatttttaaatattgcaaaaaattgtaagaacgtattaaaataatttatagaaaatatttggtatatttttttaaattcactttttaatggattcttgcacttacaataatttttttatacattaaaaaaatgctctaaaattaatttctaataaaataatttccaaaaattttttttcaaagatgtccaattggattcatccaatgggaagcagctcagacgagcgcgttcattgctgatgcggattaagctaaagtcacagctgaagcagccaattctgaccgcgtttgagcgtcgattacgccgaattgtaaaattattaaaaacaaatattaaaattattaattaaaatacaaattttttttatgtctcaaattggacacgttcggaagttgatgatgaattggaggtgcattacttttccgctcagcgctggaccgaggagatggaaaatgcattccgaaatgtgcatttaaaaatgttcgtctccgccgtgctgatcactttcattttgatgatggttggcacaaaacgagatccatatgaggtactacggtagggatgcagtgaattttaactacttttaaaccaatggcattttgccattttgagattggcattctgtgactttgatgcgattttttaaattactttgaaaccatggcatttgccattcagattggcattatgtgtttttgaggcaatttttcacattttatccattaatgaaagggtaggtctatttttttt

SEQ ID NO: 34503 - DNA, 1041 bp, Heterodera glycines
ttttacagtttactttcttaaagccaaaagattcgaaacagaagtattatttaaaatcaaaaataattttagtaaattttttacattttagtttcaaaaaaacaaacaaaaaaatgtgcccaattttgaaaatgaaatagtgcacaaaaagggagggatggttagacgaaaagaggaatttttaggaagggacgcaccccatctgatattcacccttttctgttccataagaggccaaaggcgactgtgttcgttgacaagtaattgtccaattaaggtacttggacattccacagtaaaatgtggttcaaattttggaactgtctcgcctcacggttgggaccagaaggctagtgttggtggtcgaccgacgtatgaagccgcacttgccgacgacgacctgtacaatccaaaacaatagtcagaaaccacaacaacaaaagggcgccgacgatgatgacctgtacaatccaaaacaatacagtcagaaaccacaacaacaaaagggcgccgacgatgatgacctgtacaagccgccgcaacaatacaatcaacagcagcagcggaagatgggccgaccgaaatcgtatgaagatgagcttgacgaagatgatttgtacaagccaaagcaatacaattagaccgagcctatattatatgtctatatgcttatgtaataataatatgtatgttttatgtgtgtgcgataacgagtgtaaatatccatttaataatgtgcaattctggaaaacatcatttgaccgcgatttgacaattgaaaaggattttcattaattgaaaggttttataaagctgtaacggaaatattgaacatttttactgaaaagtagtcaaatattttagggtttatctcaaattttaacctaaaaaaacattttcaaaactattttgttaaataaacaaaaagtcacaaaaaatgcagaaaagttatgaaaaaataaacaaagtcacataaaaatgccaaaaaagcaccaattaaatccaaaaaagtcctgaaaattaaccaaaatgtaattaaac

SEQ ID NO: 34504 - DNA, 956 bp, Heterodera glycines
attgacccttttgtggcccaattcgaaaatggctgctgctgaccaaatggggaaaaacatagcaaaaggagcattgggaaaatgaggaaggctttatatgaaggcgatgtcgtgctcaattttggcggatagtaagaaaattctcgtgcttttgaacttccaacttgtccaatgtacattaagcgaatcgcaaacatttaattggttgacggtgaattcgtaccaacttcaccccaccacgcccgtactgaagtgccggctcagtcaggcactcgaacaaattcagccggccatggccgtgggtgtccagccagctaatctgcacaagttcaactcaatttttaaacggactatcgccaattgggttggttgcggaaccctttccttataaagaaagatattgccgagatatggcttttcctttttacgtttggttcggaagcccactgtcatttgttatctcgcctttgcttgtttattattccgttttttcagtttgtccagtcgagtgcggttgactttctccaccttttactcgtctgcatgcgatggttgtgccgagaatatgaaatcccagcccgttacgtcatttcaattcacgacgaagtcaataagaaatctcataattgttttaccacatttttcaggttcgttatttggtcccggaaaaggacaaatatcgctgtgcgttggctctttcactgagcaatatgtatgtgaggtaataattgtttgtcttctttcatttgttccactgccaaattcagggcagcaatttctgaggcgttgggcatacgggaattgcccagggtattgagtttaattatactctttcggtttgtgctgtaaaatccttaattgtttttcagtcggtcgcctttttcagtcaggtggacattgactcagtgctccgcaaggaagtggacttggaatgccggacgcccgatggaaaaaca

SEQ ID NO: 34505 - DNA, 1284 bp, Heterodera glycines
tgtcgcgaaagtcgcgacgagggagcgatgagaaacgattttattctgattttttgtgtctcacctttcctcctaattttgaatgttttttctttttcctaacgtttccccccattcttctctgtccttcacccaaccgtttccccctcttctagtttgccaattctttcccccctttgtgctaattcacccgccatcctccgtccattcaaaatctgcaccgatttctcttcgccttctctctccgatttcgtccctttgtccccttttttcttttctctttgtattcattggccaactttcgttggcatctgctgctcgcaccctttttttcttcttttttgcataatcacggcccatctcataatactttgctccctccccgttctgttggtctttttttaagtgttttcgtctcccccgggcggctcacttccacactttatataatcactgctcttcttctccccaatttttttccatcttcaatgccgattgcattaaccccctcggccctttcctctcgtgtcaaataaattgttgttggtcgaagtgttggtgggatcagggacggtagagacgggaggaacacacccccctctcgtcactcacaccgcgagaacggcattccgtctgcccccccccctctcctctcgcctcgccactctctcgccttcagcgtcgccgcccagtgtggcgagtcttgtcgtcctcttcaattgaccaaatccctcccccagtttgtccccccttcctcgacaaactttttggtgccacgacccgggagcacaaacccttcgcccttcaattcactttcgaccatccgtcactcttctctctgccgccagccgaccctttaggctcccggcaactcaacccttcgctgtccgccgaccatttcaggctcccggctttcatcactcaactctttgtcgccagcccccctttaggctttcgacaagccctcaattgagtcgtcagccgtccttttaagccgaccctttaggctcccggctttcaccactcaactcttatcgtcagccgtccctctcgggctctcggctaatctccactcaacccaccaaccgacagccgccttctctaggctctcgaccaaccaagcccgactcttgcgtccagccgccaatcctagactttcggaaatgtcggaaatcattcgtcaacgtctcaccgccgaagtccgaaccctttcggacctcgtcaagcgcctccgacaaagggtcgggaggctcactgaattcacccaggatggcgcccagagga

SEQ ID NO: 34506 - DNA, 796 bp, Heterodera glycines
ctattccggaagtgattcggtctccccataaatctggctccttcggatcggggggaatgccccgaaaacaaaaaatcgcctttttcaagtgtccgtttggggtactcaaacaattatggggagcaaaaatccaacgcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattattagaaatttttagatttttattcatctccctttttgatagtgaaagcatctgagtgcctaaaataacttgcaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaagaaaagttaagcctaaaatttttcgcaaatttaaaaagcattaaaaatttttagattttttatcatctcccttttgat

SEQ ID NO: 34507 - DNA, 979 bp, Heterodera glycines
ccagcatttccatcactgggactcaattctcttacatttcaatcactgggactcaacacaccagcatttaatcacgaggactcaacacacctgcattccaatcaccgggactcagctctccgacattccagtcactggaactcaattctccggcattccaatcaccgggactcaactcaccatcattccaatcgctgggacctaacctcacctgattcttcggtatcgcaaccaccgagactcaattctcctgcattccaatcactgggactcaaatctccggcattccaatcaccgggactcaactcaccagcatttcaatcactgggactcaacccaccaacattccaatcaacgggactcaatccaccagcatttcaatcactgggactcaatccaccaacattccaatcaacgtgactcaatccaccaacattcctatcaacatgactcaatccaccagcatttcaatcactgggactcaacccaccaacattccaatcactgggactcaaccctccagcatttcaatcactgggactcaatccaccagcattccagtcactgggactctgttctcctgcattccaatcaccggaactcaaatctccggcattccaatcactgggacctaacctcacctggtccttcggcatcgcaatcaccgggactcaattctgtgacattccaatcactgggacctaacctcacctgattcttcggtatcgcaaccaccgagactcaattctcctgcatttcaatcactgggactcaaccctccagcatttcaatcactgggactcaacccaccagatttcaatcactggtactcaaatctcctgcattccaatcactgggactcaattctcctgcatttcaatcactgggattcaaatctccggcatttcaatcactgggactctattctcttgcatttgaatcactgggactcaaccctccagcatttcaatcactggga

SEQ ID NO: 34508 - DNA, 656 bp, Heterodera glycines
tgaaaatgaaaattccatgcttggtcatgcaatattttattcaaatcttaaaatggaaatatgtagaaataatttttttttattcttagtttcgttataacaccaaaatttagcaaaaaaaaaatcaaaaaatgtgagactttttttgacaataataatttacatattttttatggacttaagatgatgttgtggcacagtttgagttcattgtaaccagagtgaagcaaacaatgaactgcaaacacaagttgcgcaaggtaaattcaaatgtgtttctttttatttttgtcatggggatggtaaagaatttcggtaaaaaagcgctggaaccccggaatataaataaaacccggaaatccgacccaaaaactcccgaattcaaaaacctagatttcgaaaaaatgcgtctatttcaaaaaaaaaaaaaaaaaaaaatttttttttaagtttgtcaaaaaacagtatattatttggcaccgaaagatgtgtaaaaaaagatatatcaattaaattccgaaagtccgtgccaacaaaaaaagctcccgatttctgaaatcggaattcgtaaaaaaatgcgtcaaaaaattcctcgtatttaatttgttttacaaaaattttgttaggaaggaaacgtcgcagaacttaacgatggt

SEQ ID NO: 34509 - DNA, 1040 bp, Heterodera glycines
caattttcataaatttcaacccctatatttgaatcttttaaccctattttcgcccttattttgtgaatttttttgcccctatttaggtctcaatgttgatttatcgcccctaaaaatcctcgtccttattaatatccggtcgtgcactaacatacttgatatagactgttacaatttctaaaatgaattttacctcaattattatgccaatgcctcgtacaatatcatatgtacaattataatgctataacaggcactcgcgcaaaaacgtcctagagataaatgaccgcagtattgtaaacatgttttttctactaaaaaatataaaaatatatagttctcgtcctgtttaaatttgggaataattaaaaatagtggcatgttatcctgacgctgggtcagttaaaaaatttttccaaaaaaggggggggccatcggtagagtattaccatttcttcattaagaaagcaataatggaatcggaaaaagaatggagcaacaatcaaaagcttatagaccttgccaaaacttcaaaagctaatgtcagaggcacaattccaaagggcttcccttatttcacggtcaattttggtctacagcccgggtttgctcatgtggtcgaagatgaaagaaaatttccgttcaatttcgcgcaggttttccctagtcagtttaaacttttaaaacagttgatttaggaaatcattggaggaatgctcgacttgcctcacagccattggagaaaaccaaaaaagcagagttttgatcaaattatggagagaagaaacaaattgaaaaaaaattggacaaaatacgattggacagaaattgtgagaagagaattaaatgagggaggggaaacatactaaactttgtattttcacatgaccaatttaacaatgcaaattagaataattgttgacagcccataattagagctcgacctggacctggatccaggcctggatttttgtcaggtccaggttaaatgtggaaaaaaatccaggtccaggcaaaacacgaaaaacctggattttcct

SEQ ID NO: 34510 - DNA, 1225 bp, Heterodera glycines
  misc_feature (55)..(55): n is a, c, g, or t
  misc_feature (57)..(57): n is a, c, g, or t
  misc_feature (81)..(81): n is a, c, g, or t
agtttaaaagggaaaaataaaggattttgtctgtcacaaaatgtggcagcaacancnggaattccaaccaaactctgaatntggttccgcgaaagaattttcttcgtgcctcgtaaaatgcattacaacgtaatgatgttgccaacaaaagcaaagagaagacagagcttttaaaaatactcattggtattatggataaaggggttttgttaatgatttaaaaaattaaataatctaaaataataaaaatcatgatcgcctacaaaaaacaaccaatttttattttttgatatcgatagttctaaatgatttatataattagcctacaaatttttaaaatttattataaaaagttatgataaaaaaatgctcgaaaacgagatttttaactccttcagcaggccataacctttttgaaaccttttttgaatgttaatcaaatttttttgaaatttgcagattaataaagaacattttgaactacaatatctaatgattataaacaaattttgagcatatgccttttttctgcgccttagtttcgatatattaagcataaatagctcattttccacttggtttaaagcttctaacttgcattttttgtgacttttttatacttttttgttgactttcatttttaaggcaaaatttgacttttagcgaagaaaaattccgaaaaataggtttaacttcgaggcggtacaaaaatttccttaccactaggactcaaatgacgagactgaaaataataataaaatctggcgtggtgatcttttgaaaatatttttttgttaaactagcaggttagcggcttcggcgcatctcccgctaggcagtacgattgtgttgtagaattatgaatgataaaaccgactattatggctcggccgcttcgcggcctcgcacccttctcttggcattttcttatggcacaactgggactcagttcttcgacattccaaacactgggactcaaccctccggcatttcaacactgggactcaacccttcggcattccaaacactgggactcagcccaccggcattccaaacgctgggactcaacccaccggcattccaaacactgggactcaacactccggcattccaaacactgagactcaacccaccaccattctaatcactgggactcaatccaccatcattccaattacttggaacagacccaccaccattctaatcactgggactcaattcatca

SEQ ID NO: 34511 - DNA, 473 bp, Heterodera glycines
  misc_feature (468)..(468): n is a, c, g, or t
caggggtgtgacttgtctcagaaaagacgagagcgagagtttggcgagaagcgagagtccccaaaaatacgagtgttggcgagaggacgagaggcgagagtttttcaatttttctgtagccttattttttacttcaaaaaacttcaaaatcgtatattaaattagggttacgggcccgggtatttgggcaaataccgggaccgggacgagaaaagtcaggaccgggaccaaccgggaattttccaagagaaaattttttttcaaaaacttccaaaaattttcatcaaaatgcatagattaatgataatttagacactaaaatatttctctatgtaaaatgattgagtatttttttatttaatggacaaaaaataaaaatcttatgatgttttttcgcgtaaatttgaaatattatctgactgctcaaaaattcaatctttaggggtgtattttcacccctcgtcccanaaaac

SEQ ID NO: 34512 - DNA, 565 bp, Heterodera glycines
tctcttgcgcttacgggagggacagaaaggtcgccctaatgggaaggaattgggcggattgacttgcattggggggaggggaggaggaggggtgtcattcacccaaagtgtcgtagttttcgtgcgttccccccccttgtgcagcttgcccatcattatcgctgacctgtgctctcaatccatgtttttgtgatgcttctgtactctgcacgtgcggtgtatcctttttggttgttctgcttacaccctgtgtagggctgctgccggcgattttgtcttgcgttcgacgtcgtcgccggtttggcgacgcctccagtggtcggatgcctggggcgaggaggcaccaccaccgctgccgcccatccgtccgcccaatgacttccgcccgctcgtccaccgggtcgccccgcaacgccatgtcgtgcaaaccggcgcgaccaaatagtcgccgagcgtgtcacgccttctccaactggcgacgctggattgcctggagacggaaattgcatgtttaacggtcaattaggggtccattactgccgattaaaacatcaggtgccgattt

SEQ ID NO: 34513 - DNA, 1801 bp, Heterodera glycines
  misc_feature (1685)..(1685): n is a, c, g, or t
  misc_feature (1692)..(1692): n is a, c, g, or t
  misc_feature (1754)..(1754): n is a, c, g, or t
  misc_feature (1761)..(1761): n is a, c, g, or t
atgaagaaaaggagttgagtttgtgttggtttttttattaaggcacgattttacggcacacacctatataaaaaaaatgaagaatcacgttttggaacatcctcgaaaaaccggtgacacaaacacacactgacacagagaagttcacaaaatttgatggtgttgtgcctgtttatgaatggaggaggacgacaacatttttcgaaattttctggtaccctgagaagtctaaatttgatgtttgttggagaggagatgaggcttactaccatggtgccaaaagaggaagatgagagtggcgggcggtcccatggcggcacaataatttagtgccgacgaacacaaaaaaaatgtgttgtgtgccaccacatcccccacttgttgtgtttgctttaagcttgacgattactaccggttgcgcgacgcgctcaacgcgtttgacaagcgcaacccgcacttggcataccggggcagcggtgccgttatggttgcgcaacagcaaaagccaagacggaagcggtcacggagtgaggacatgcacaaggaggagccggaggatgatgatgaagaggatgaggaggaagaagcgacggcacggaagcggaagagaagtgaggaagcggtggatgaggcgccgcagcggtcgtcggatggtggggacgaggaaaagcagcagcgcagcagcaacaaccacaacatccatcgtcacaaacgcgagcaacaccaccaccgggaggcgacggcacggagcaacagcggtggcaaaacggcgacgacgaagacaccaccggcggcacaggagaagcggaagatgaagccgccgagaaagcatgccgataatggtggtggtgatgacgcagtgaaggaagaaaacgccgccactgacgatgtcatgaggagtggggcagcagctgctgctgatgaggctgaagcggcgcatgggctggaggaggtggacagcgttggtccgtacattaactcattcagtattcgaggcgggaaaggtttccgataaagccccaacatttcaaccccctccccccccccttctgaaagggtgcttaaattgctcaggatggctactttaagcagattttcaccaaaaatttctacctaatttatgtatttagcaaaattttttttggaaaatttgggtgaaggaggtgaaaaaaacggtttatgccagaaaatttgattttctctcctcttagaaaaatgcttttttttatttaacaggtaaacaatttgactgggaaggaggagaagaggaggaggaggatgttgaattgggctttgaccttgtagagaatgaccatttggaccatggaaatgacgatggcgatgacgaaacggttgtggtggctgtggtgatgcaaaacgatgacgaagctgacaatggtggtggtgaccaatcggttgctgaacatgaacaacaacaaaatggccatgatcaacaattgcaggtttttttaggaacgtgtaaaaaatgggtttttgatatttttggttgagaaattttaaaaagtcataaaaaaaccaatgtgttaaccaatttggatgggtctgtagccagggggggggaaaattcctcctcccagaaaatcaaaagtttttccaggaaaaattggcaatttttttttaatttaatcaatttttcttattgttaaacaaattcctattcactncaatttncaaaaaaaaaaaattccaccgccggacccccttatacctcattttttgaaatttgaccccanatggcanagcaaacattttgagatttcctttatcaaaaaatgattac

SEQ ID NO: 34514 - DNA, 629 bp, Heterodera glycines
tcagcttttcacttcatgatttttttttacatatattttctattcttacttattatttagtataattgggttttgtcaaaacaaaaacataagtgcccttatgctctatccttatttattcttaatattttaactttacagatgtgatatacaaaacgtcatatcgtgccaagagagacgaggaagacaacaacggtgacggcgattgattggttttggaagcgatcgattttttcttttgttaaaatattgatgattttatgattatgaatttaccgttttccattaaaataataagccccaggcttttattttgaactcgctaattaacattttataacaaatgaaaaaaagtattgcaatgcaaaaaacaaatgtgaagtttttatactaatgattattagggtagcattttattttcaaaaagtcgcaaagatatttaatgaaaatattgttcaaaataggaaatttcgagcaaaaaaaaattcattcatctttttctactaaaataaaaagataaaacgacgttgtcaaataataacaaaaaagagaaatccttcttttcagctaaaaatgattctgcctagggaggttctctgtaagaatacaggtcacgaaaaaaaaattaa

SEQ ID NO: 34515 - DNA, 884 bp, Heterodera glycines
tttatatggcttactgtaataactaccaaatgccatcccttatccatcaaatggtggtaaaagttcaaattaataagacctaaaacttttcagaaaccctaatgaccgttttctctccgtcaaaaaaaacccttttaaattggacataattttcaaatgcttcattaatgttctattaaatttcgaatacatttattaactaccgaacaaatgtgtggatttgtattgaccgaccggctcaaaaaattgccttatttttttaaggaatagcagcaaaactgacaaatgagacgatgatgagtaaaaggacggcgatgaggacgagcacgcaattacggatcacggaaattacggggttttgggccccgtaaatttaaacaaaaaaatcaacaataaaagcacgcaaattcacacaacctcgcacaataatatttatagggaaagaaaattcaacaattgcagataaaattgcgtcaaaataaagtaattgtgtgaatttgcgcgctttgttgttgatttttctaaaattttggtgtgttagcccaaaacgggaaaattccttaaattctgtttcttcctaccgtattaatttctgtttgtctctactggattaatttctgtttctccctaccgtattaatttctgtttgtctctactggattaatttctgtttatctctaccgtattaatttgtttctccttaccgtattaatttctgtttcttcctaccgtattaatttctgtttgtctctaccgtattaatttctgtttctccctaccgtattaatttctgtttgtctctaccgtattaatttctgtatgtggatctttaccgtattaatttcctgttttccctatcgtattaatttctgtatgtggatctt

SEQ ID NO: 34516 - DNA, 873 bp, Heterodera glycines
tccttcgtccctgcccatctccaacttccccatcactaccgacgaacgcgtccaaatcctttgtttccgtcccgacagacccaaaggggccgtgttttgatgggcgacggagtgttggagggcggttcggtgttcaaccacctgctcatccaaatccatcccttcaggcaatttgggctaatgaccgtttctcataactttcattatgataatcaatgattagggcaaatgatttttcactaaaattgacttttcaaaattcagaaagcacatttggtcgttgtgtgcgctgtgtcttctgctgtctctgctgatcattctcaacagtgtgttgatcatctccatccagggctcctccccttatcgccttgggttcgtcccccctttttccctccaattccctccctttagtgaccccacttttgtgatcttttccgaggtgcttgcttggctgctcattatggtctcagtcatcggcgtcaaattggtctgttccttttaggatttagcatatcccccttcccaaatctccctgtttagacttgcatgtccaccaaaatcatcgaagccaattcagaggcgtgtcggaggcgtgctggcgacgaagacggggctgggcttgcgacggcacttccctccgtttccattgaggtggatggagccgaattgatggaccatcggcgtcctttttccgcgccacattgggtgaacgcgtattggggccttgcggcggatggaggcgaaggcgccgtcggacttcctggcgtggtggagccgcagccgccgttcgacccgtctctcttcccaccgccgcccccgcgctattcgtccctcgggggtctttccgagcctccccccgaggcccatcgacct

SEQ ID NO: 34517 - DNA, 840 bp, Heterodera glycines
aagtatttctgaatccttttattgtttaaaaacgcaatttcaactaatttttgacaaaaaaagtcgaggggtaaatgataaaattgaaaacaggaaaataaagatttgagccacttgattattccaaaaatattttagttattttaaaacacgattttcggcaatcagaaaaattttaaaaagtggggtttaatgccgaggcaaaagacattaaaccggaaaaagcagtcggtggtttctcaagggcagcattcctctggattcggttccgaagtgataatgccaaaatgtgtcatcattttgaggggcgtattcgatggcgtcgtttccattcattcgtcccacgacatatacacaatctgaaaaagacccttatttgttagctcaacattttctctcaatgactgaccaattcttcattgcattctatttgggcacccaatcggtgtgcgtcgagaaagttttcgccaatccttgaaagaaatgcgagttcgtctcgtgtcgttggagaaacgtggcgagagagtgactcaatcgcaaaagggccaagactgacgagcacagaaggcacagccgccgtaataccatcgccaccttgaaaaattacggaaaaattagaccgacttattgaggttggaaaaagtttgacagactcccaagcggaaatgagaaaattgccacctccatcatttgacagtaatcctcgtcggcgctcattaacggcgtcgtgtcttttgaccgcctcagaataaagtcgggaacgctggacaagatcaaagtcgagagagccattctcgaggttggtgacatcaattatacacttgaaatgtaagatgcaag

SEQ ID NO: 34518 - DNA, 525 bp, Heterodera glycines
cgaagacgacatttgcctatgcagcagaagacgaagtcctatgattatgacaacaaaaaaaataggagaaattttgaaaacttgaaatttttacttaaaggaatttttttgcgtttttttttgcaaaataaaattgccggagacaatttatagcatatttaatgtttaaacagaaaacagtgttgacacaatttttagttatttggaaaatattataaaataaaagagaaaataaagcaaaaaggaagaaaatattcaacaaaagaatggactaaaattgaagaaaaaataacgaaaaaattggagacaagtcgaatgaaaatttatgaatggattaaagaattgggattaaatcaacgaatacataaaagctataaatcaaaaagaatggcaaaaaatttatgccaaaatttgcaagaaaattggagttagcctttcagtaattaagaaatggaagaaacaatttggagaagaattgttctaagaacagtagaagaattttttttccccgcatttttgccattt

SEQ ID NO: 34519 - DNA, 921 bp, Heterodera glycines
aattttatacctcacaaaagcgcttgcgtatgagacggaggggctgtgcacaatcgccattttatttcacagaggatttttatatttagaggttatcccagaaaaatggctatctctttttttgataaattttatacacatacaaatgctctcgagcatgatagagagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtttgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatga

SEQ ID NO: 34520 - DNA, 874 bp, Heterodera glycines
cgggcgaatttgagcaaatgctttacgctgtgagaaaattatgtggcaattatggggggggggggaatagataattaatgaaattattaagaattttttacttagcaagtttatttataatgaaatcgttcattaattgtctctctgacattactaatgaagtaattaattaattaaactgagccaatctcacaggccgttgagcaggtcgacttggccaacggtcaccaggacgattttatgaagtccgaggcgctgctcaatttggccagggccaacgaacggttggccgagtttgagaaggccattgggtacgcggacagcagcttggaattgccgggcattgatcgacggagtcccggatatgcccatcttggtcagtgcttttgggagaaataaaacgaactgaaaccaaatggacacattggaatgaccatttgatgagctaatttaattatccagggcctatttcaattcggatgatatctcagatatgacgtgtcataaatcatatccacgtttcaattatgaactgacgtgccataagaacatatcgtatgcggaacttacatatgacggcacatatgatatggtatcacatgcgagtgtcatatcagttttgggctgtttcaattcaaatgactacatatgatatgattcctgtatatgatgcctacatatgataccaaatactgggataaatataagctaattaatgaaatttaggccgtttaaatacaaataaattaacaaaaattaataaaatgaaagatttttaattttatttctgtaaaaatattttaaattggggtcctttttttaggtgtagaaattaatggcaaatatcaaatatatttttctattataaaaataa

SEQ ID NO: 34521 - DNA, 1027 bp, Heterodera glycines
taattggtcatttcgtctctatttgcctcctgcttaatttgtcatcggtaaatttgggcaaaattcgtcgaaattgttcgtcttatcactgcactgttgatgatgctggttctgttgctgttgctgatgattttgtgcgtgcatcggaatgccataaacttgcacatatgtctgtcaaaatcaaaaatcaaatctccaaatcgatcggacaatttagccgaattccttaatctatttttgaattggtaatattttcagtcaaatcagtgcctaatcaataatttaaaatgagagaaactaataacagtttgctcgtctttaaatcctcctattttctgattagaaaacgaagatttgattactagagcagctacatggacttgatcatgtaccagaacgggcaaaacgtaattaaaattcccgtctttatggaaatcccgaggttgtggtgatttactgggaatctcggcggatggcgccgatcagatcagtgactaattttaaaatgaggactatttccaggattgaatgctctttgttcgagtttggtcaatgatcacggatggattcattaaaaaaaattataagtctcgctattttcgacttcatttttctgatatccatccatgaaaatttgatcagagcttatcagcggattttaaatttgtctccgatcactgaccatcagttgcgcacggcgcatatcgagccccgcttggctaagccgtacatgtgccgaatatggtgatggccctctgatggcatgtcgcgcatccgacggcggattgatcagctcttgccacagtgctggccaattgtggggcccatttgtggccaaaaagagcgcaattgctgtcacaatcactggcacaatggacgggacgagcacaatttggggctgtacatccaacattttggctaaataagactcaaaaaatacttagtacggattagaatttcgaaattggatgaatggcacatgtcaggaacgggattgtgtgggggacaactgggcgacatttcgatt

SEQ ID NO: 34522 - DNA, 1257 bp, Heterodera glycines
  misc_feature (6)..(7): n is a, c, g, or t
  misc_feature (36)..(36): n is a, c, g, or t
ataacnnttccttgggtccaccactataaatatacntggaaactttcattttttgttcattcaattcttcaattgttacatgttacatgtcacatgtaaattaaaatccatataatattttttcctttgttcattcaagtctaatttgctacataatacatgtcaacagaaattgcctatgaatagattttaatttcatttttgttcattaaagtcaaaattaattatttgttacatgttacatgtaaacataacttccttgggtccaccactataaatatactggaaactttcattttttgttcattcaattcttcaattgttacatgttacatgtcacatgtaaattaaaatccatataatattttttcctttgttcattcaagtctaatttgctacataatacatgtcaacagaaattgcctatgaatagattttaatttcatttttgttcattaaagtcaaaattaattatttgttacatgttacatgtaaacataacttccttgggtccaccactataaatatactggaaactttcattttttgttcattcaattcttcaattgttacatgttacctaaatgtaacatataaacacaaattccctatgaatagactttaatttaattttcacgttttcaatttttaaagattgcttttattatatggaatccgtttcatcttctttaaagtcaaccgagggccagacccagcagcagcggaaggaaattgcaaattcttcagtaagaccaaccgagggccagcaatcggtccgttactttcgtcgaattcgcatttgttcaacttcctcggattcatcggatgagatttttaattcttttgaacgtcaggacaactcagtgattaatgttaagaacactaagcaattgaacatgatcaaatctcccgaggtaagcagaaataaaaacttgaaattctttggtatattttaataaaattgtttaatatttcaacctctatcaatgaaattaagaagaacaaaaaaggaaaatcgcgtgaaattattgttaggcagcgttctctctctccgagaagtgacattacaatattaaatacatcaaacaaaacatcggtttcgaaagcacctgcaggaaagcacaaagaaagtgacgatgctagaaacgcgcgcaagatcttcgttggcgggtttaattaattggaaaaagaagattagttaactttttagattatagcatacgacgacgaagaattcattaaatgcttacttctcta

SEQ ID NO: 34523 - DNA, 943 bp, Heterodera glycines
aaattgagcttgctaatgaatggttatggatcgttattacaggtggacgatgcggctcgcagcagggggaccagctgatcagcagcgaatcagaggccatcggacggatgagcacgtgccgaggcaccaccaaatcagcgacggcactcgaaaatgctgtcaaaagaaaagagaatttggcataaacaaaatgtgccgatgaagaaataaaccggagaatacgcaccattctgccgttgaagctgtaaccatttcggcatttgtgttgtgttttgaatgagtttggggttattttgtgccgacggagacggcgtcaccttccgccgtgccattgtcgaggcatttatggcggagcaaattgcaagtgtcagccaacgactgaactgtttcggcacattgtcaccagtccaatccgggaaatgaatgaccctttaagggagggggaggcattcttccgattaaaatgagaaaattaattaaaaattccgattcctaattaaggttcattaaacgttgagtgccattttaacaattcaattttaatttggtaaattcgaaataattgaacttttccaattattttcacctgttcgcgctgttccccgccattttcttcagcaaatttgacaacggatagtccaccgaaatggccaccacttgctgctgctgctgttgcgtatcgtcgagctcagaaatacttaaagttttgaattttatttccgatcagtgacagacgacgcaaatacggtagagaatacggtaccaggactcatgatgataccgtgtcttttggggaacacggttaaacaattcttcaatcggtgaaatacggtacttatggtccaatccccgatcgccaatgttgtccctttgttttttcacctggttgtgccttctcgactgatcagaatgagcacactctcttggccatcgatcgcattct

SEQ ID NO: 34524 - DNA, 1142 bp, Heterodera glycines
tcaggacgggcgcttcgcgcccgtttgtttaattttgtggggaacattcggccgcttcgcggcctcaggacgggcgcttcgcgcccgttttttaattttaatcgcacagggattccgaggtcttaaccatctctaaagtaaaatctgattgcatattcgtgatcagcggcccaaataacccctaaaatcatatttttggaagatttttggtgaaaaaaattttccactcaaaaatcatggtcacacccctgtggtcccggatgccaaaatcacttttatttctataactttttttaaaaaagtgataaaaagctaaattaaaatttgtaaaatagagcaaaaaattgcggattttttgagtatattatttttataaaatactttttcagaatggagttaggaatttttttttgaaaaatttaattttttaagaaattatggaataacttttttattttggaagatagaaattccaaacaaatctcataaaattctccttattttttgctatttttcaaactttattccactaaatttgaccaaaaacgaagagagttatgaattttcgaaatttcactggattttccggggctcaaattttgacgatttttcaaaaaattttaaacaccttccaaaaaatctgaaacgcaaaataaagcgtatatacgtattcagcacctcaaattatgccataaaaatgcattttagctaatttaggagtaaaaaaatttttcgtgaaatgcaaaaccatggggtcccccctttggttttgagtttcaaaatcacaattaattttataactttttttaagctcatggtaaaaacatgagataaagcacattagattgggcttaaaattctctacaaaaaagctcttagacgattttttgataaaatcaactccccacgagttattgcgccagaactgaaattgaggcctagcaaccaaaaattttctatttccaaaaaatttttgaaaaatttttctgaaaatgacaccaatcgatagagcatgaaaaacggttgcttgaaagtggtctccgttttccccggaaaaatctataaaaaatcataaaattcaaaaacggaaaattttcgatatgaggctagctcgaaaatttctgaaaatttcagaaatccaa

SEQ ID NO: 34525 - DNA, 885 bp, Heterodera glycines
  misc_feature (52)..(52): n is a, c, g, or t
  misc_feature (64)..(65): n is a, c, g, or t
  misc_feature (168)..(168): n is a, c, g, or t
  misc_feature (227)..(227): n is a, c, g, or t
  misc_feature (237)..(237): n is a, c, g, or t
  misc_feature (269)..(269): n is a, c, g, or t
  misc_feature (328)..(328): n is a, c, g, or t
  misc_feature (331)..(331): n is a, c, g, or t
  misc_feature (336)..(336): n is a, c, g, or t
  misc_feature (398)..(398): n is a, c, g, or t
  misc_feature (407)..(407): n is a, c, g, or t
aaaattaaaatgaaaataaaacaaattttaatagtgtcatccaattttaaangaaggataaaannggaggggagggccctttgatataattatttaattgatttatttaaatgatttaattttagttggtttttgaaatttgaatataaattaattaattaaagtttngataaaatagaaattattttaaaaatttattgtggggtttataaagatgtattgtgtgnatgggaattntgaggatagtatatggaagtaataagaatatnggaagggaattaaataaattggaatagtgagaaaaggggtgggggatggtattgtgaanatngattngttgagagtgtgttaataatggaaggagtagggtaaattggtgggtggaaagagttggatgntgaattagnaaagataataaaaaaaattaattagtggattatgggaagaaagagagagaaaaagagagagatgaaaaaagagttaataaattataaacgaaaaacaaattaattagactaatttaaggtgaatcaagtggtcgaaattgcaaatgtttcgcacgaaggaattttgcacacccggcaattttacgatgtgatcgactcaattcttattgcctgagtaaatgaccttatttgttagtgattgtcggacgacgattagtaattattttattttctgtaaatttggtaaagataatttggcggtaaaggcgcctgagggaataagcgaattggacagacacctcagacagagcccgaccatttcttacaatttttccaacgaattcaaagaatccaaatatgccttttcgatttgttcgatgaaattgtcgccgaggtgtctaagaaagcgaattttttgaaataggatgaggttccacta

SEQ ID NO: 34526 - DNA, 926 bp, Heterodera glycines
aaaaccaaattatttttcattttaattaatataaattttttttaataaattttttattaaaaaaaaattttttttacattatagtctattaaaaaatctctctcatttaatattatatttttattatttagaaagaaattgttttaacattttaatttattaaaaagcgctaattaatgttcaaattcattaaaaaaatttttttctctaaaagcatttaaaattatgctattaacaggaatcttttcggcttctcaacaatcaaaatcaatggaaataaataaatgcattttctcatgcgatttattgcgcctcttaaaaaaaatgtttttcccgtttttcattcattgcttttctatcgctgctgctgcttctgctgctggtaatgtaagccaatgtcagcgccagcagcagaattggatttatttgattgaaagagatttattagcatcgcgcggaaaaagcataaacacatacatattttaagttgaactgatttaatcctctcacagacatttttttccatttttttcctatattagagaccaactaaattatttaaaaaattcatttgtgaaatttaatttttaatagtttaaaatggaatttggccgggaacgggaattttggaaaagccggggaccgggctccctggttttgaaacggaaaaaaacaaaaacgggaaaatcggtaaatcacggcagggaaaatattgattatatggcccagaataaaatggtcaaaatatataccaatcaatagctctcggtctgtaatgaaaggatccgaatgaatttttttgcggaaaccaatccctgaagagttacagacccgggactgaaatggacaaatggctttgggattgaaccgtccaaacccttaaacgcatggaattgcgacaaaatgcatataaatcgattcgtcac

SEQ ID NO: 34527 - DNA, 945 bp, Heterodera glycines
ccttcaacaattttggtcgatttgttcccgagaaaaataaaataatccgaagagtgccatcgttgtagcgaaaaagccaagtgccaatggccaatgattccgaaaaaagcgccgctgttggcatttcatttgatgtttagggccctttgaagacaatctttgatcagtctaatgcgagagtttacataaattaatgatgataataaaaagaattagccaaatatcaatttaagttgtccattgattggccgagtttattcattagccaaccgatgcaattccccccacaaatgccgccgccctcatgcggcttaagcgtgcattgggcccattaagccgaggagaaaaaaaaacgtcgatgaaaatgcttttgggcaaaagtttaaaatcgtcgggaaaaaatccaatgaatgcgcaaatgaaagaacagaaagagacgaattaagttgagaaattggaacgggagagaatgttaaagatttaaatgcaaataattgcagccgaaaaatattattaacaaaaaacaaaagaacgaacatttagcaattagtggagatagatgaaatccgggaaagagaaagggacagaaaaagccgaacggaaaaagggaacgggattcccgacttttcaccctttccctgtaaaacccgtcaattttgaacgggaattctgccgggaaacggaggaaatttatcttttttttcaagtgaaaaaattataataaaaacatttccttttgtttttgaaagccaaaattaaaataacaaattaatcaaaaatattataatttatttttattaattaaaggtccgggctcggtacatttgaagaagagttcccggcatcgcagaatgacacgtcgtgaaatgaaaattttaggcccggtctaaaattacggtggaattttatttttaaaattccaaaatatttaaataaaaatacgaa

SEQ ID NO: 34528 - DNA, 738 bp, Heterodera glycines
tccgttcgattgtccctttgtgtcttttgtcccattcctttttgtcttgtccatcacctgtgagtccctctgctgtttgctgagtccgcccccgtacaaaatgcccgtttcggttagccgtctgttgctgctgttcatcgtgccatattgactgttagcagttgcattattatggccagcgcatggcggcgaatagggacaaatttggccaaacggttgcgaagagcacatttggccaccaccggcagcagccaacgaactcaaatctggacaaaaacacgaacaatttgatgtaaaagaataaggaatttagaagtttgcaatataatggcccgcaattcaacatttgctcgtggggcataaattaaccaattaaattttgtttttcatgtttcgacgaattgtgccgttttggtcgactttttcattccttgccaaaactttatcatttcaaagcgctacttagtctaacaattcaaaaaaaaggatcaataaaatattcttgtgaatcgtcgggtgggggggggggtgccctcccggctttatgcaagtctattaacgaacgaatgtcaagacaattcgggaaaaacaagacgtaaatgtgatgtaagaggggctttgtgtccttcaataatcaaaaatttattgttgcaataaaataggaagtgaagcgaatgagcgaagagcggagcctaaggcactgccgaaacaaatccccggtattgatcgcggagaaaa

SEQ ID NO: 34529 - DNA, 939 bp, Heterodera glycines
ataaaaataacatttcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcactgtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaataatacccctgggagaagggagtggaaacatgattcaaaattttcattttttctagtctatctactcaaac

SEQ ID NO: 34530 - DNA, 1247 bp, Heterodera glycines
  misc_feature (1212)..(1212): n is a, c, g, or t
ttagtatttttaatagaatctctaatttagcatttttttcaataataatttcataaaataataattctccaatattataatgggccattcaaatgtgttttgaattattataaaattttacgataatcatatcgcgggtgccgcagttcaattttgtatttctataataattagagaccgcattttgaggcatatgcctttttttacgcactagtttcgaaatattaagagcataaataatacattttccacttggtttgaagcttctatgttgagttttattgtcttttttgccttttttgggattttcatgccctaaaggccgtttttttggatttaaaaatttttcttttttgaaaaaattataaaatttttatttaataatctttaaataaaataaaattgaaaatgagtctctgtttaaaattatttttatctataaatgaatactcataaacccaaatgactgtttccctatttatagactaaattttacatatataataatatttaatgtcacaggaagtaattagcaaacaaatatagaaaataagttattatagaaaaaaaattctctagtgatcatcattataaataataataactagggacgtgaattttagtgaagaaaaatcccgaaatagttaactaaaatagtgagtaaaaatgccaaaatagtgacaaaatagtgaaaaaaattcagaaatagtgacaaatagtgagataatttgcataccaaaaattgagcaaaactaatttttattcactgattgcaattgcaaatgaggtacatttccaaattttgaggcaaaatacgcatccgattatctgataaaattgtttttaaatagagaaagtccgttcaacatcgcatgaagtgagaggggcgaatttatagaatggaattacggtggggggaacatcacaatcaacattttttccggaaagaatttggcaatttgatcaaacgagggattttttgagacaatgaaagagattttttggcggattatttctgatttctcgccggccacgttgtccaattggttgtgaacattcgcaaaaatttccatcgattccattatggacaatccttgtgactccaattttgcaatggcagggcataaattgccaaagttggtgtgaatgtacgcgaggtcttgccatgttgacaaagtgaagcacgactgactttctcttatgcatgatgcnatcagttgggtcgaacgagttgactacctaaatgc

SEQ ID NO: 34531 - DNA, 1119 bp, Heterodera glycines
catccattctttgaatttaatttaaaaagccaaataatttcccatccatttttccatttaattttcttcattttcttctaagttttcattgtcgttctctccctccaatttttcattgtacacattattttgtctcccatttccccccaaaaaaagtgtctccaaaaatgtgacaataatttatttatgttagcccctgggggcacgggggacgggcgacatttttaaattgctgctggcgactaacgaccaaaaacacaacaacagcacaacgccaacccaacacagatgtgaattgtgtatataactatttgctatttggggggattggctaatggccccccatttgccctccctcagctggaagtcaaagccaaagtcaaacggtttcacatccccccccccagggtcgaggttatatccaaaaatccaccgccgccacgttggcgccgtcggcaagattaattgctgggaaagcgggcggcggcccgcttcgagggcggaaacagtaaaaagaaaaagccgcttttgccccacggggacgcggacgactttagtcggtgtcaaaagggattcattcattttcaaagttggatgaggtataaaaagtggcggttgaatgactttttgccaaaatgggctttttgacaaaaaaaatgtcattagtttcttttaaatttgaaaatttttttattgtaagccttaaaaaaattaagccatcgtagaggttaattaattactaattaccctagttgggaattcgcaattatgcaatcctcgtcattaatgccatcagcagatggggaaaccaaaatttccatcaaaactccttagttcaatgatcaaaaatcggaaatttgaatttgatcggacttgcgcatattctccgttcgggtccacgtcgaacggcgtttcctggcgcaagcggttgaagcggaagtcaaagtgcggcacgcgatgggtccatttgagaagccaatcggcaaagttggtcctaggctgttgttcacccattggagaaggccagcagcaacagcagaatgagtgatggaattggccaaattatggcgaaatgattaaatcctacgaaaataaaaaatttaattggaaaaattttaa

SEQ ID NO: 34532 - DNA, 1225 bp, Heterodera glycines
aagaaaaccgaaagtgatcgaaaggggaaagagaaaccattgggaaagtgatcaaaagagggagtgatcaattggggacaaaagaaaaccgaaagtgatcgaaaggggaaagagaaaaaatgggaaagtgatcaaaagagggagtgatcaattggggagaaaagaaaaccgaaagtgatcgaaaggggaaagagaaaaaatgggaaagtgatcaaaagagggagtgatcaattggggagaaaagaaaaccgaaagtgatcgaaaggggaaagagataaaatgggaaagtgatcaaaagggggagtgatcaattggggagaaaagaaaaccgaaagtgatcgaaaggggaaagagaaaaaatgggaaagtgatcaaaagagggagcgatcaattgggagaaaagaaaaccgaaagtgatcgaaaggggaaagagataaaatgggaaagtgatcaaaagagggagcgatcaattgggggatgagaaaaccgaaagtgatcgaaaggggaaagagataaaatggtaaaattgcaaatggaaagtgaaaaaaggaaggtccaaggctaaaataataaatgatcaaccagttttagagattaaaccaaaacaaacggacaacaaagctttgccgaattcgacgaggcgacagtcgcggtccatgacaatgtgataagctgataattgatatttccattttaatcagaaactctgataaattacgcagaagtgccgccatgtcggctttgttaatgcgcaaatcccatccctcgtacaaattctgatcgatcagcgaaagagacgaatccgatgatttattgttcaaattttgcaccggttgaggagataaaggaggctaaaggaaagaagggagaggaaaagaggggatgatacggtgtgtcatttggggtacggtagtaaattttgagaataaactgtagttgatttggcgtttgtctatacaaattgtatattaaatttctacgtcgaattcgcattcaactccgttgtcggtgaccatcaaaagaggggcagcggaaggcggatggttctgcacaatttggcactgatttcctgtgccgtactcagttggctttggaccaactaggcgttcagttggccctttttccgaaagtgtcacaccgatcgtttggcccaccttccggggaattcctttccaacagcaattttcgcaaatgattactctaattacgaagatgacgtgctctt

SEQ ID NO: 34533 - DNA, 1065 bp, Heterodera glycines
  misc_feature (46)..(46): n is a, c, g, or t
  misc_feature (102)..(102): n is a, c, g, or t
  misc_feature (105)..(105): n is a, c, g, or t
  misc_feature (113)..(113): n is a, c, g, or t
  misc_feature (115)..(115): n is a, c, g, or t
  misc_feature (124)..(124): n is a, c, g, or t
  misc_feature (217)..(217): n is a, c, g, or t
ttttaaaaaattttaattctttttaaacagcccaaaaagttaggcntcatatttaaaaaagtttcatcgaccctagcgcgctaaaatcgatatatctctccnaantttgcagncnttctccatngtaagggactaagttaacctgaaaaatgccaacgctgttgtttttaaaatttttcgaaattctgactttttcattattattattattttgcanaattaattcataaatattttttagaacgtgctctgaaacgcaccaaatgttaattaaaagttaaataaggctctctgatgctttttctatcaaaagggagatgaataaaatttttaaaaatttttaattcctttttaaacaggccaaaaagtttaggctcatattttaaaaagtttcatcgaacctagcgcgctaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctgtgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttcagaacgtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcat

SEQ ID NO: 34534 - DNA, 1095 bp, Heterodera glycines
agagaaggcggaggagaagcttagggaggaggaaaaagcaattgggaggagaagtaagctaaaaataaatcgaaaaggaaggaaaagccaaaaaatagggaaatcagaaaacaacggcacgaaagacggaggacagaagagaggcacaaacccagactgaagagccaaacaaagagcaggacaaaaagccaatgccaaacgaagcagggggaacagaacgcagaagtgaggggagaattcggtcggcaccgccttcagcgggaaaagcggcaccgacggcggaatgggagggcaaatggagagaggccgaaatgagagagatggccgaacaatgggaggaagaacgtgccgaaaagcaaaggctgacgaaaaaactgagaagggcgagtgaatgggcgaagggagaagcgaacaaacgcaattataggacaaatgggaattttaaagtaattaaggcggaactactccaaagagaaacggaagaacaattggaagtgcaacgaaaggcgaaagagcgactggaaacggagcacaacgcgttgttacgcttggagaaacggcgaacactgcgcgaagagaccgaatcggtgggcatggcactgatcagagacaaattggcggcgaaagagcgcgaagtgtccgcacaggtcatttgaggggaaaaggaagagagagacaaatggaaaaggaaaagcggactttagcggcaccgaatcatcgaattggagcgaaagctgtggcacatggaaatggcaatggaaagcgaacaatgaaaagaaggaataacggcgccagcggacggcacggacaaattgagaaaaatgacgggaaaattggaagaaaaaggacaaaagtggcagaaatagggagaaaaaagggaggttgcctgctgatcgaccgtaaactgacttggaatttgttctcttgagtttcttttcaaattttctttgaataattaaatttctccgcctttgtttcgttttgcgattcgtccgatcggtgcctttctccaccccccccccccctccatcctaaccaaactggttatctttttaagtttggttgggttggattcaaacatttcgtccgcctgat

SEQ ID NO: 34535 - DNA, 1175 bp, Heterodera glycines
tgacataaatcggattggaaaaaagtcatttccgttccctgaaaatataaatttatatttaaaatttcttgctaagaaaagttttatcgaaacacacaaaattttttaattttaaagtttagttgggaaataattgccttaacaatataaaaaaatgcaattatgatctttattctcgcctcgagaacagtctcgggtttctggttctcgtcttgttgagtcatggtctcgagtgtgttttgaggccaagtctcggtcttggtaccgtctctcgagcagttttaaagcattatcaaatcattttttctacagaaaccaaggtgatgcagtactgactgaatatgatcagaaattcgtcaactctttgcgtctcaatgtgcaggaaggccgagactttgggcacattcttgtcgttttggccaaccaacacaaagatgttttgtcaggccttcagcaaaaatctgattaatttttcgctgtgattctttctttctccatttccccccgtatttctgtgacatcgtaaaatttaggaatatttgaacaaataaactatctgaaatctaatgtaaagctttttctttcataaaattttttaagtataacaaatatcgcgccttaaaattgtgggaaattgcaattctcatccggagaaaaggaaagtaaaaagttgtgtgacattaatgcaaaacctttttatttcaaatttttatttcatcaatttttttacaatgaataaaaacatgaattttttattttaattggcatctcattgattagctctctctactgctaaatactaggaagaatttgttgatttattgcttaaaaggtcagccatttggccgggaattattttgccaggaatattggcactggtctccgttttgttcaatttttcgttaattttggatacttttaccaaaatgtgagtctttaaaattttaaatttaattcatttttgatttttaagaaaggatcacaaagtgtgtaattggctgttagccttcgattcgttttgccaattggttttcgcgctcctttccttgtcaattttttggcccagattttacagtacaccacagttgattaccgtatctgtgctggcactcttatgatgtaactttggcatcgtatgcctcatttttggcattttttttgatctctgccgaacg

SEQ ID NO: 34536 - DNA, 972 bp, Heterodera glycines
aaaattctaattgtaatcatttttttgataaaggaacatctcaaaatgtttggcttttgccattttggggtcaaaatttcaaaaaatgaggtataacgggggtccggcggtgggaatttttttttttttgaaatttgagtgaatacgaattttgttaacaataagaaaaattgattaaattaaaaaaaaattgccaatttttcctggaaaaacttttgattttctgggaggaggaatttccccccccctggctacagacccatccaaattggttaacacattggttttttatgactttttaaaatttctcaaccaaaaatatcaaaaacccattttttacatgttcctaaaaaaacctgcaattgttgatcatggccattttgttgttgttcatgttcagcaaccgattggtcaccaccaccattgtcagcttcgtcatcgttttgcatcaccacagccaccagaaccgtttcgtcatcgtcatcgtcatttccatggtccaaatggtcattctctacaaggtcaaagcccaattcaacatcctcctcctcctcttctcctccttcccagtcaaattgtttacctgttaaataaaaaaaagcatttttctaagaggagagaaaatcaaattttctggcataaaccgttttttttcacctccttcacccaaattttccaaaaaaaattttgctaaatacataaattaggtagaaatttttggtgaaaatctgcttaaagtagccatcctgagcaatttaagcaccctttcaggaggggggggggggaaggggggtggaaatggttggggctttatcgggaaacctttcccgcctcgaatactgaatgagttaatgtacggaccaacgctgtccacctcctccagcccatgcgcccgctcagcctcatcagcagcagctgcttgcccactcctcatgacatcgtcgggtggcggcgttttcttccttcactgcg

SEQ ID NO: 34537 - DNA, 1020 bp, Heterodera glycines
acagttcacgcccttcccttttgaaataattaatttaaccatattaattaatttattaataattgttaattaagtgcacgtgtctcattgacgattcggttaaaaatgccatcaattttctggaaaaagcgcgcaacaaaggcgaatcctttaacattcacaggtgggcttaaattgagtgcaaggagatgatacgcaccgttttgttggaggtgctaatgggcgtttctcaaaacaatcaaatggaaaattttacaaaattattttgttcaagagtaactaaatttttaattcatcgaaacctttcgattgcacaacaaatacctaagtgttctttctctattagctgtaattttttgaaatatcaggaatttttttttgaaaacttgcactataatagtaaggctgtcaaatgctatcaaattgactcaattcgtacaactatgaaaggagttatatcggaaaaacatgggctgacgcccagttggccagcgcccatttgtcccccactgctcgggggtccaactcttttcggcttcctgaagaaaatgatgatggaaatgctagatagaataattgctgttttcactttttctaaagtcgaaaccctaacataccatataccagggatggcattccgaggtccaaaaaaatttcagaaatcggtattccgtagctcataaatttttcggaaatcggaattccgaccccaaaaattcggaattccgtgtcatccatgccatatactatacatttttgaaacacgtcactacgttacggtagagataaaatatgtttgagtgtgtgccaagtttttttctttgttccaagttatatgggtatcatatcatgaactcttttaaaattttgagtcaaaatttatttacccccccccccccgtttttgtaggcatttcgtagaaaatgagttcgatgtgatcgcccgcgtggcgttggggcagcgcgagtcgcgacagtttgagactgaaatggcacacctggcgattgagtcgatgcaaaa

SEQ ID NO: 34538 - DNA, 868 bp, Heterodera glycines
tcaaaaaccggtttatacttgtcggtttttagattttaccgttcgacttcatttcctgatttttagattaagctcgttaagagctttcgaatggtactaaatttatggggattcgatcgtttaaaaaaagttagagtgcgaagtctctcaatttttcgagttttgaaccggttcaaaagccggtttttttggcatttccgcaacccgaaacatatttttccatgcttagatccttgagacgaatcgattggtatatcatttgaccccctttttcacggggcgttctctacagtttatccaaaaagtgatttcaatattttattcaaaactgaaatgagcttgttttattcgattgtttttatttgggtgcttttgacaagtcaaagtaatcaagatcaacaccacgataattatttatttaaattttttaatttatttttaatctatttttaaataagttttttccaacaaaaatgtcgacaattgtttgtttttgaattgattaattatataactaattcattaattaattgttcagccgtagaaatgttcaaatcagcaaatatgctgctagacaatgcataaaaattaccattggagacacaaaatgccaagaaaatgtttgaactagtcagaccgaacctttttggcattttgtgtaatgtaaaaattgaaaaaagcgcaaaaattggagaaaatttacaaaaattacacgaaaatttctgcgggcaattgaatgaaggcaaaagcattgaagaaattgcgcaaaatatgatgaataaaactgtcgaaaacacaaaaattgctgaaataaaagagatttttgaaaaaatgccacaaaaaattcaaaaattgccatttctcaatg

SEQ ID NO: 34539 - DNA, 1329 bp, Heterodera glycines
  misc_feature (40)..(40): n is a, c, g, or t
tcgatgtggactaaaaacccctaataattttttaaaaatntaaaaaaacctctccaaccaaattcgataaatttgaatcgctttacagcctaggtagcgaagctccgaaagcgcgaagcgcttttttccagctaaatagccgacggttcatttatgcttaatatatcgaaactagtgcgcagaaaaaaaggcagctctagttaattactattaattactatatatgttatattgacaaggagtttcgttgctaaaaccattttctcccggccgaaggccgggagcgccctgaaagtagtggaagggtcttacaactttttgaggcgcatccgggaaaactatagagaaaaattctgcgcggacgactgagtcccagggacggatttctcaatttttcgtgcgtttgacggcccataactttttttctgaaactcggatcaaaaaattcccgctgtgagggcactccgcagaagtgtcctctataatccagtattttttattttttgatcagaccaaatcccggacctgtacagacacggagactcagttaatttttttttcccacttcagtaccaggtgaataccacgtcagggtttggtctgagcgagggggtgccagcagacttattgtagagtttttaaagctgcatttttccagattttaaaatttcgaaaattttcaaaatttttcgagctaggcctaaaaatcggttttcgggtttttgaattttatgattttttaacgatttttcccagagaaacgaagaccacttccaaaacatagtttttcgagctctatcgattggtaatttttttgaaaaaaattcggtttttttccggaaatagaaaaaatttttggcctgagcgggacatttgagtcccgggtctataactcgtcagggatcggttttagccaaaaattgccttagaacatttttgtagagcattttaaatgctatcgaatggtgtactacatgatgtaaaattttcaaaaattttcgagctaggccccctagaaattttacggaatttttttggggtcgaaaaaggatgtgaaaaatatttttctgggctattttgaggtgctgagcacgaatataatgtttattttaagttttggaaattttagaattttttaaaaattcgaaaatatttttcaattttttgacccttgggattttgggttaatatttgaaaattcataacaaatcgaagggttgatcaattttactcgaataaagccttaaaaatagagaaaaatcaggagaattttattgactttatttggaatttctatctaaaaaaggaaaaaagttattccagaatttc

SEQ ID NO: 34540 - DNA, 768 bp, Heterodera glycines
attatgaacgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgcgatctaagcctagaaaaaaatggtgtaagtaaaaatcgtaattacgctcaaaaagcttctcaaacaattttagcgcttccaattccttctacaatcgcctttatacatcccattatgaacgctaaaattatcagagtgccgaaaatcgcatgtgatctacgcctaacaaaaaatggtgtaagtaaaaatcgtaattacgctcaaaaagcttctcaaacaattttagcgcatccaattccttctacaatcgcctttatacatcccattatgagcgctaaaattatcagagtgccgaaaatcccatgtgatctaagcctagaaaaaaatggtctaagtaaaaatcgcaattacgctcaaaaagcttctcaaacaattttagcgcttccaattccttctacaatcgcctttatacatccccattatgagcgctaaaattatcagagtgccgaaaatcgcatgtgatctaagcctagcaaaaaatggtgtaagaaaaaaaccttaattacgctcaaaaaccttctcaaacaattttagcgctcccaatcccttctacaatcgccgttatacatccca

SEQ ID NO: 34541 - DNA, 909 bp, Heterodera glycines
  misc_feature (60)..(60): n is a, c, g, or t
tgggttcatccattttgagactgaggaagcagcgaacagtgcaaatgcaaaagtgaacgngatgcttttggatgggaagaaagtgtaagatgatttcatcaatttgtttttgtggtatcatttaactactatccgtttttttaggtttgttggaaaatttttgccacgttccgctcgtgacaagcaaattggtgatccgtccagtcgtttcaccaatgtttatgtgaagaattttggtgatgcaatgaattcggagaagctgagcgaagtgttttcacagtttggcgaaatcatcagtgcaaaggtgatggaggatgacagcggcaagtccaaggggttcggcttcgtcgcctacaaggaccatgaaagtgctgcgagggcggtggagaagatgaacgaggtttcggtgcccggcagtgagaaggtcgagcaaaagtttacggtgtgccgtgcgcagaagaagagcgagcgccaggctgagctgaagcgtcgttacgagcagtacaaagctgagcgcatccagcgttatcagggagtcaatctgtacggattttgtttggttggggggaatttttctcaaattttaggattttgttggtttgggggggagtttttctcaaattttccatggataacttttgtttattatattaatgtgccattttttgtgtaaaactgttcggaaagctctccactaattaaaaaaataatgcaatccataaaggcatactacgaaattgtttactgaactggagattttaaggtacgtcaagaacctgcacgataccatcaatgatgagacacttcgaagcaattttgaatcctacggaaacatcacaagtgcaaaggtttgtcttcaacggattattgctatttgctataaagcggtgctgaaccagataccaaaac

SEQ ID NO: 34542 - DNA, 966 bp, Heterodera glycines
  misc_feature (919)..(919): n is a, c, g, or t
agaaaacaagtaagctgaaatttaaagaaattgaaaacattgatggaatgaaaaaagaaagggtagaaatcaatgcaagaaaaagtatgattttatatatatttttctggacaaggacagggcataaatgccccgtaactcttacgcttattcgtacaattcttgatagggttacgggatttttccgattacattttataaaatgaaaaggatttatgttcaatttgatttacattatgccaaaaattcttattaattaatttttaaattgataccgttgttatttgttcttaacagctgatttactgttagacttaaaattttgattgactcataaaatttaattggacccttaaattgcaataccaacccaaattacacatggtagcaacagcagaaaatgcgggaattttttccgcactttttaatccttaaacctggcaactgcaaaacttttctgccatgagtcaagacttcgcggcactttttttttgcacatttttggacaattcaaaaccaatcgtatcatctttctctttaccaaatgtgtgagtaatcattctcctggtactttgtgtacatatttgctcattgttcttcattttgttttctcccaatttgccaatgcttttcctcctccttttttctttcttttttttctctctctctctctccaattaattaattaattaacttttcgtccgtcgattgtcctttctttctctgccgacctttgcgtggtgtctttttcttctgtttgtgctttcttcccgaactttacaccaaaaggaacgacaaaatgaaattgtgtccatccacagtttaatttcccatcaaaagtttcgttcgttctctgtcccttttttccttttctttgttccttttcccttcgcatttcatggtcaaaatacatattttngtgtgtctttgttttgtttttttgtgtgtgcaactgatgcttttgct

SEQ ID NO: 34543 - DNA, 796 bp, Heterodera glycines
atatgcactcagtaatttttttactttttcatcttttataaaagcatcaaagctagagattcgagcttccaccaattatttccggtgagtttggttttcggttttttattaaaaagaaaataaaaataatagcaactatataaatccctccttttggaatctccatcctattagaataaattaatttgaataaaaattttttgtaaaaaatatataataaaaaactaaagccaataaatattatggaatcatttttacattaatcaatgaatcgattttacattaataaatattttattatacgaagtgtttgtttactaatattaaaatttattgctagataattttatacaaaataatcagtaaaagacatgagaaaaaataaagggtctcatttggcggtttttgactaacgcccattgtggcggtttttgactaacgtcccagcaccatctgttgtttactttttccacccttccaacgaattggacgggttcttggttgagtttgtcgtctgattaactttctgatgagcgcaattgtccctttcagttgaagttgaacccaattgatccattttaagactattttcgggactaataatttacacaaattaaaaacaatttaagccaaaacagaaaaatgaaattgcttatcagaaagagttattatttggtaaaaaactcttattttcggttatttgctgcgatgaacccgaataatatgtgctaattgttatttcttcaatttcattcaaataaaaaagtaaacaacagatgtgcagatttaagataat

SEQ ID NO: 34544 - DNA, 1614 bp, Heterodera glycines
caacaacagaaacgaaaattgcacaaccgaaaggcatgaatcttcggttgactgttggcatttgtcacacattcaataattatggaaattgacaataaaatatacaaacagagtctgtttctctgatcagtcctccttgatcactcgttccgacactttttttttgtcatttttctgtcgtgcgctttctctcttccatggtgccaaaagtgcgccgaaaagcctccggcacagccaaaggatggcaaaagcgatgatcaagcaaatcagcgcaatgtccaagcagaaatattcgaccattcccaactcggcactttccgggatcagttccttcagtggtccgttctccagcacaaagtcggtccatctgatcagctgctcctccggtgggtttggcttttgtcggtggagtttggacaggcgaagagcgtttgctttgtatctgacgatgcgaaaacaaaaactgtaaattcgaatttggcactcactttttgtcgttcaacattatgccaatctcctcctttatccggtcgacgctcagcaaatctgatttggtcaaaatgcgagcaaagccgcggtattccgccattttggccactcggagttggtcaaagaacagcggaatggccaggaaagggacgccacggatggccgactcaatcatggagttgtagccggagtgggagatgaacagacgcagcgaaggatgggcttttcgggggaggcgagacgaacaataagcacaaaaaaggaatgggcccgtccaaaaattgaaaactttcgtaatttcttgtattttcaatttcaaaaaaaaactaatttctttctttttattttttattttgaaatttgcccaaaagttccgatttttggcggcacctgccagcataaatttatttttttttaaatttgacccaaaacataaatatcccatttttggcaatttctgttccgagtttttttttggccgatactgtaaggaatttcattcgttttttggtcagtaccgtatcccgtctaattctctgttttatactgtaaggaatttcatccgttttttggtcagtaccgtatcccgtcaaattctctgttttatactgtaaggaatttcatccgtttttggtcagtaccgtatcccgtcaaattctctgttttgtactttaaggaatttcatcagtttttcgtcaataccgtatcccgtctaattctctgttttatactgtaaggaatttcatccgtttttggtcagtaccgtatcccgtcaaattctctgttttatactgtaaggaatttcatccgtttttggtcagtaccgtatcccgtcaaattctctgttttatactgtaaggaatttcatccgtttttggtcagtaccgtatcccgtttcgtgtttgaaatccatttttaacaacaaaatcattgaaaatcacttaagacttaccaagtaaatcagtctgttccacccattcgaactgaaaaaaaaaacatttaaatgtttctattcatgttcattgtcttaccaagtgaatgtttgacacttttttggccaaatttcggctgaaagtgtccgctttgctcactttgacaataaatgcgaaatcggagaaatgggaa

SEQ ID NO: 34545 - DNA, 892 bp, Heterodera glycines
ttctattattagctgctcgaatctgcgcctctcacccttcccctttatagtgggcacaaatttttggtacaatagcaaaaaaggcatggaataaagttgataatttaaaattttcaaaaaaaaaaaaagtgaaaccgtacagtaaattcaggcacttccaaatccaagcccgttttggcacggcgcgggtcatgccgtcgtggatcctgcactttgtcgacattgtactaaaaagagggcaaattaaagaaaaaaaatgggccaaggaaaaataaagaaacgaaaaaaaaattcttttttttttggcaccgccttatttaagcacgaaaatcgcgtgtttacaattaaatggagcttattgtaaacatttacccctttccttttcagtgcatttttgtgttttttcaagaacggaatttgatgttactcaacatttgcgtcaaagtccaaaatcgagttcaatcctaagtttgtgcccgtttttgagggaaggtgacactataatttttcgcatttactgacatgaaagttggacgataagcaactcctcgtttcattaactcaactcgtttaataaacgcaaaacacaattatgatttagaaaatccgactttcctgatttcttaaattttatttttgggcatttattttttctaacaataagtactgaaaatatatttcctgtgtgctttctgtgtcaatgacgacgaactatgacatcctcttttatcgacacgatgaaccctcgaaattccggccctcaatttccgcgttttaatcccaaaaaacgagttgggataatcaaaaacgaattggattttatattacgcccctccccccatagttacaaataaaataaaaaattaatttgtttgtcacttttatgccaaaa

SEQ ID NO: 34546 - DNA, 1180 bp, Heterodera glycines
caaaagtcgtgtccacaaacgttgggatcctcaaatctcggctcctcaaatgtcgagtcctcaaatgtcaaatccccaaatgtcggatagccgtaataattaaagctgcgattttggacataaaaccacgaaataagcatatttttcattaaaatttttttgtttgtttgatttgctgttttatatattcttagatgaaatttattctgcttaatatttaaaaagtgtatttatttattaatcaaataatacctgtatttgcaggagttattaattctgtttcaatatattaaaatttggtaatcaatttttgggaaaatgtttacattcttaggggctattttctgaaatttttagcgtcatttattaggggttatttttattttatttgcctttttaaaggatttttcaaaaaatccagaaaataggcacatttagtagggatgtgcagagtctcggttcccgactcgggaaatttcccgggtttttcgcttcccggtctcgggtttttagtctcggaaaccgagaaatttttacactgttaaggatgaccttttcggggagtgggtcgccggtaaagggagaaaagaggacaaattattgaaatttttaatacattttcttaacaaaactctttaaaaaacccaaaaaaaaaatttccggcagcgcctatcggcgtcgcggcccacaaattcccctaagatttcaaaattggaatctaaaattacccattttttagtgaaatccgaagaaagatacatattcaaaaattccatttttttctaacgtggcgcctattgcggtaaggggtgaactcgcctagccaattccgtctcagcaaagttcaaaaatctatctttaaccttacgcaaattttctaaaaatttagctaaatttttcaaaaaaatccattattacttgaagaaatctgctaaaaatgattcaaaatcgcaaaattggtcattttttggacagaattcgttaacaaatcgcattaaaaaaatgcaaaaattttcccggcggcgcctatcggcaccgccggacgttaaaagcagaaaaaaaaggtcgtcgcgtcacccagggggatgtaccaccccaagccgaaatcctgggtgaggcggctaaggctcacggtaaattggacaccagaaaattagacaccgaaaattggacactagaa

SEQ ID NO: 34547 - DNA, 1044 bp, Heterodera glycines
tttgagtagatagactagaaaaatgaaaattttgaaatcatgttcccactcccttctcccaggggtattattttgtaaagtcttttttccacaataaacttgtcataccgcatttgtcgcaccgtgaatgttatttttattgaattctgaaccggtttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactataaaaaattgaaaattttgaaatcatgtttcccactcccttctcccacgggtattattttgtaaagtctttttt

SEQ ID NO: 34548 - DNA, 1264 bp, Heterodera glycines
  misc_feature (21)..(21): n is a, c, g, or t
  misc_feature (119)..(119): n is a, c, g, or t
  misc_feature (121)..(122): n is a, c, g, or t
  misc_feature (136)..(137): n is a, c, g, or t
  misc_feature (157)..(157): n is a, c, g, or t
  misc_feature (173)..(173): n is a, c, g, or t
  misc_feature (195)..(197): n is a, c, g, or t
  misc_feature (202)..(204): n is a, c, g, or t
  misc_feature (224)..(225): n is a, c, g, or t
  misc_feature (228)..(228): n is a, c, g, or t
  misc_feature (249)..(250): n is a, c, g, or t
  misc_feature (268)..(269): n is a, c, g, or t
tctagagtcatgtcaaatttntgggacttttcttcgacgtggccatcagctgggttgtttccgtgacaaaaacaaaccagtttgatgttattcgaatgagctagacgcgctctacattntnncaatgtatcacaannggtctaccgccactccctgncgagatgtgctcgaanacaaagagaaggtcagtcgtgnnntctcnnnttcttccccgtccacatcanntcnttcaaatttcgggtgtgatgnntcttcccccatgcggcgnnctgcttcccaatattttgaatgtttccccaccgattggtgaaaattttttttttcccattcctttttccccaaatgggcccttaaaagggtgtgccaatcccctccttgaaaaaaattgccaaaaaaaaaaaaccttttttgaaaatttaaacacaaaaattttttaaaacctcttttaaaaaaaaaaaaaaaaaaattttttcttccccaaaaattttttttcccgggaaaccggggaaaaaaccccctccccccccaaaaaacccctttttttggaaaattttttttcttcctcctccccccattgggaggaaatttttttcccccctttttttttaaaaaaaaattattttcttccccccccggggggggaaaaaatttaaaaaaaaaaatatttttttttttttaaaaaaaaaaaaaccccccccccaaagagaaaagaaatttttctttttttttttttttttgtgtggggggggggggggggggggggcgggtttttttttttccccccccgcccccccgcggaggggaaaaaaaaaaatttttttttttttctttctttctttttcttctccacaaaaaaaaaaaaaaaaaaaaaaaaaaatttttttttcccccccccccgcccgccacaaaaaaaaaaaactttttttttttattcttactttattaacacccccccccccccccccccggcggaaggaaagaaagaaaaaattttttatttttcctccccctcccccccccccccccgccacacacaggtttttttttttttttttttttcccgcaaaaaaaaaaaaaaaaaaaaaaaaaaaaaaaaaaaaaaaaaatttatttttttttttcttttttttttttggaagaaaaaaaaaaaagaaaaaaaaaaaaataatatttattttctcccctcccccccccccgcgcccccggctttttttttttttttttatctttttggggggggggggtgtgtttttttttttttttc

SEQ ID NO: 34549 - DNA, 892 bp, Heterodera glycines
  misc_feature (64)..(64): n is a, c, g, or t
aattttgaaaaatttcgttaaggttcccattaatatggtcagaagagttcaaaaaaccaaattnttccaccttttttaggctcaaactttttttaaacttgacgaaattttttgcaaatttgcaggctaatagagcatctgaagggctttcgaatgataccaacaatgttatatttggatgccaaagtaaaaagttataagcgaaaccccgctggggccgaactgacgggttccgaaaattatgtgtcggattttgggaaatttaaagtacaatttttggtcgaaaattcaagaaaaatacatgaaaattctgtggcccaaaatgaagccctccctttctgcgcaaaaggcgcttggaccagaagcgccaagaaaatttagcgtgaaaattcgaaaaattttatacttaggtatgaatggagcaacaaaaaatggaaaaactatgagccgaattataatttttattagggtaataaaatttttaaaacaagttaatgtctgaaaaagaaattaaataagggcgcctaaaaagacaaaagaattccaataataaataaataaaatagaatttttaaaataaaattagtattcaattaattttttgagattagaactaaacgaaaacatttcttttcacccaaatagtttcatttaaaattaattaattaattagttattttattttttttcgaaattaattacccccaccccctatcattttcgttgaccaccacccatacatcggtttgaaattttcgttcaacaaaacattctttggccttttgtccaccaccatttgcttctgctgggattccggcggaaggaactcgtaaatgagggcacatgtgcacggcacggcacacactcattgcccccggggaaaagctaataa

SEQ ID NO: 34550 - DNA, 1345 bp, Heterodera glycines
atgttcgtccactccgctcggcgccgaagtcgtttcgtagcatactgaaattgacactttgttttttccgtcctgtcccgcgaatttgaaccaatttctttcgctgtctctgtctttcccaagcacgtcgcagctcatcggtgttgaagcgcatcgatcctccgatattctgaaaaatgaaattacaaataattaattagtaaacatctaaagcattaccccgtagacaataccaaaattgcggccaaaggctccgcgaagatgcacattcataaaatcaaaattttgtgctataaaaaaagggaaagttataaatcgccgacggatgcaaattgctgcattaaatgtcatcacaaaaaagttgcaaaccgcgttttcaaattgctcgggtcgcaaaagacgcggtaattattggaaggtgttttagaacagtttgagttgcatttaggggttatcgaggacactgatcccgaatctgccaatcgaaccctggacccatcgaacaaaaagtaaaaaacccaatttccggacgtttcagtgtccctgagcacgaatatgaaatccatttcagcagattctttattctaaacctcacgatccacggctttttaggcgctatatgcaaagtggtcaatttgaattttatcaacaagtaaaaacaaaaggggggactgtattgttttgcaaaattttttaatatataatcatgaaaatttattccctggggttttttgggtccatatttttgtttacttttttactttggggattttaatgattttttcacttttaaggctaaacacagaaagggaatgcatttggggaaaccgattccggtatttttgacctattcaaaccccgaaccaacaaatggagggggtgtaaaatgaacaaataaataaaaagctaacaaaaaattgaagcaggggcaccgcacatcgaaatgggcaaatggtagtagcgaaggtgaaaaggatgaaaatgcatccgtttatatgccaaatgaatttggcaaaagatggatgaaatgtcgcggatgactgtgtataaaagggacggacattcgcattttcatttttggggagtttggcgtattgatgattccaattcaaatttcattccaatttttttgcctctgttttcggctttgaatttcttcttaaggaaaaggtgaaatctagagatccgcctggacctggatccaggcttggatttttcctggatccaggttcaggtccaagccatttttcggcaacctggatttatgtccaggaaatccatgtccagcaggtccaggttttttccaaaatgccgatctctagtgaaatctaataaattaatgcct

SEQ ID NO: 34551 - DNA, 985 bp, Heterodera glycines
tccctatagtctgtactataattgtgcgttggatttgtgctccacataattgtgtgagtaccacacacggactctagaaaaaatagatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatagatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatagattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatagatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatagatttatttttgttttcggggcagtccccccgaacttaacggccagatttatggggagaccgaatactttcgggaatag

SEQ ID NO: 34552 - DNA, 1046 bp, Heterodera glycines
taactgtaattaattatttattttttcagatttagccaattcattgcgtcaacaacgcaccgaggacaatcacatttcgataaatggacaaatttactcagttgacggacctaatgttaatgttggtgttgaagggcatgatttgagtgtgaatgggagagtttatcaaaacagggccacagagcagtatctggaaattatacaagacaaaaacataagaaatgtaattgtcagtgtgccattatcgttattttctcgcgaaaacataaccgttgggcaaacgcgacatattcacgctgaatgcgatggaaatttatatatcgaccaatcggcagatgactgtattcgcatattatgcgttgatgtaaaaaaggatgccgctgcaaagaactttgggtcaacaagtggaggctttaattttggatcgacgagtgttttttacaatttttcggtccgaggaactttacatatccataattcgtcacttgagtgtgctaacattgaatgtgatgcatctttaaatgtaactcactcaccaatagaacgtaatgcgcaaatgaaatgtggtgggagtttaagtattgatgagtcaccaatgggaaatattcggcttaactgtgatggatctttgcggatcgaaaaatcgaaaatggaaagcagtcagattgatgttggtggaagcattgggattgttaagtcaccaatgggaagtattgggattgactgtggtggatctttacggatcgaaaagtcgaaaatggaaattggcaacctagactgtggaggaagtttaaccattgtagaatcgccagcgcaaaatcttcagttagactgtggaggaagtttaaatatgaaggagtcgccaatgaaaaatgttggcattaattgtggtggaagtgcaaccattaagaagtcgaaaatggaaagtggtcgcattaattgtggtggcagtttttcaattgatagaacgccaacgggaagtgttcgaattaattacggtggaagtagaattaatttatgaaatcaaacgaatgatcttgttcgga

SEQ ID NO: 34553 - DNA, 916 bp, Heterodera glycines
gttgtcccattgggcacgacaagaagtagccgaagtgcttctgctgccatcgtatagacacagttgttgaatctgtgtacttggcggctgaacacgatggttatgcttgtgttgatcgtgtaggtgttgtgctgcttgaacttctcggcctctcccggcatttcctgctgtttgttgttgttgctgctgtagttgatactgtactgcttgaacttctcggcttctctcggcatttactgctgtttgttgttgttgctgctgtagttggtactgtactgcatgaacttctcggctcctattagtatttcctgtttgttgttggtcctgtattgctgcttgaacttctcggcttttcctatcagttccggtctggctactgcttgaacatgttgctgctgccgttgttgtaattccgtcattttctgctgacgtcaccattatttcatcgtcattatcctttgcatcttcttcattgatgcgatcatcaaacatttcggtcagcgtatatgagcatggcgctttgaacagtcgaaaatcgtccgtcccttcttcggctaatgagccggaagggccaaggcgacgctttcgagcgcgacccttaattggatagataattagcacgcgttttgtcaaaatatggcctagcctaggcttttccacagccggtgctgctcaagaccgaaaatttctcaagacttagacatggcccgggacgagattattgtcccccggtgccagggacggtcccgtcgaaattttaagggaattgataccccccaccctccaagacctccctcattcaaattttccacaaattttgcttaatgtttccaaaaatccacaaaaatcgcaattattggtgaaaacctgttaaatggtaaaaatttccaaaaattttcccgcctaacccctcctg

SEQ ID NO: 34554 - DNA, 920 bp, Heterodera glycines
ttttaaaaattcccaaattctgaaacttaaaatagacctttattcgtactcagcaccttattttaccccagaaaaatatttttcacaccctttttcgaccccaaaaaaatttttgaaaatttctagggggcctagctcgaaaatttttgaaaattttacatcatgtagtacaccattcgatagcatttaaaatgctctacaaaaatgttctaagacaatttttcgctaaaatcaacccctgacgagttatggacccgggactcaaatgtcccgctcaggccaaaaattttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccgttttttagccctagctcgaaaaattttcaaaattttcgaaattttaaaacttggttggatagcctttcaaatactacacatttttgctcagaaacaatttttcggtcaaagcaacccctggcgagttattcgcctggtactgaagtgtacattttgagcacacttcaattagccaagcgtgcaggccagggggtggctctaataaaaaaataaaaaataccatcatgtagaggacagttgtggggagtgccctcacagcgggcactttttgattcgggttttagaaaaaaagttaggggccctaaatgcacgaaaaaatgagaaatcagccgctgggactcagttggccgcgctgaatttttctctatagttttcccggatgctcctcaaaaagttgtaagacccttccaccactttcagggcgctcccggacttcggccgggagattttgatttttgaaacgaaactccttgcgaatataacgtatata

SEQ ID NO: 34555 - DNA, 966 bp, Heterodera glycines
ctttaaatctgcaagaaattagattggcaatatgtggttgtaaaaaacttttgggtatggaattattttttgaagtgagtcaaacaccctattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggcaggcaatgtatggctttcaatctgcaagaaattagattggcaataagtggttgtaaaaaacttttgggtaatgaattattttttgaagtgagtcaaacaccctattagtgctttgctgtgccgagaaccggcaggcaatggatagctttaaatctgcaagaaattagattggcaataagtggttgtaaaaaaacttttgggtaatgaattattttttgaagtgagtcaaacaccctattagtgctttgctgtgccgagaaccggcaggcaatggatggctttaaatctgcaagaaattaaattggcaataagtggttgtaaacaacttttgggtaatgattattttttgaaatgtgtcaaacaccctattagtgctttgctgtgccgagaaccggcaggcaatggatggctttaaatctgcaagaaattaaattggcaataagtggttgtaaaaaacttgtgtaaggaattattttttgaagtgaatcaaacaccctattagtgctttgctgtgctgagaaccggcaggcaatggatggctttcaatctgcaagaaattagattggcaatatgtggttgtaaacaacttttgtgtatggaattattttttgtagtgagtcaaacaccctattagtgctttgctgtgccgagaaccggcaggcaatggatagctataatctgcaagaattagattggcactaagtggttgtaaaaa

SEQ ID NO: 34556 - DNA, 1304 bp, Heterodera glycines
  misc_feature (1063)..(1063): n is a, c, g, or t
  misc_feature (1134)..(1134): n is a, c, g, or t
  misc_feature (1141)..(1141): n is a, c, g, or t
  misc_feature (1150)..(1150): n is a, c, g, or t
ttaatcatctatttcgtcatttatattattttattttgtatatgtgttattacaaaatttttgttgtgttttggcattatttcatcatttttggcaacttatcatcattgattttagtgaatttttttttgtaatttagtgcattattttccctaaaattttgatcaattaagtttttaatcattttgcacgtcactacattgattttttatttttagttggttaatttattaagtggggaatgcattgttttattagttttaagcattaaattttgcataattctgcttatattattcccattgattttttgattttagttggctaattttttgcagtgggattgaattgtttttgccaaatcttggtgtgttaattttggcatcattttttgcatgaatgtccccattgtgtttaaatagtttatttcgtatgtacaaaacgggaaatgaaaagctagcaaaaagcatccaattttttaagaatctacattaaatttagaattattattttttaaatatacgtattgtatttgaatgcatagggaaactttgaggacaaatattccttgatgatttttaatttctaaaacttagaaaaatacaaccctatgatatgaaaaattttctcataaattcatccctaaaatttaaaaagccacgcccacccacggggctcgaaccctactataaattgcagaactttcgaataaacgatgcttatacatactgtaaattcacgtagatattcagatttttataaaaaatttcaaattttgtttctgactttgttttgaactcactcaacttgtctctctctctctctctttccttaaattcattataattttttagagatcaaaattgccatttttgctccatttttctgctccattttccacaatttgtgcatgctgctacaaagaaagtgtgcttcggatatgatgaaccgttcacagtttacaaaaatccatcaatctattcgattaccttcaaattaacactgcgtggattacttttagccgtaatgggcaaaaaaagtaagcaaattaattatgaccagngaacggatttatatgtgctaaaaaacgtcatatatgtgcatgtatatgcgacaaaaaacaccaaaatctcnaaaaggncaaaaatantgcaaaaaattcaacaaaaaaaaactgcgtcaaaaatagttaattttttcaaaaatctcattttttagcaatttcactagtacaattctaatcaaaagcatttcaatgctttttgaccgtaatcttttttcttaaaaaatgaaaattttcaaaa

SEQ ID NO: 34557 - DNA, 911 bp, Heterodera glycines
aatttttgcaataaaagccaagcgacgactttttttgcctttaaaaaacgcttttttacggcgggttttttcggaaaaactttggaagatggacaggggcgtccggcggtgccgataggcgccgccgggaaattttttaaatttttaatacgatttgttaacagaattttgtacaaaaatgaccaaattttgccacaaatcttatattttcttcgtaaaatactgatattctgacataaaatttcaaaattatcttgctttttactagagtgccacgggaccgggaatttttgccaaaaccgggaccgggacttgccgggacctgagaagccgggaccgggacctcgattttttttcgggaccgggaccgggaccgcaagaaaaaccgggaaccgggaccaaccgggaaattttaaaaattcaaaaaaattttaaaaatttaaaaaaaaattcaaattttaatttatatcaagtgaaaataatacaaaattatttggttttttataataaattaaattaatgaaaattttcaaacaaattttcttcaattatttcaaacaattaatcatttttggactaaatcatcgaatattaatagaaattcagatttgattttcacatcactttttttcggagcgctttttcaaaaaacttttgggaaagaaggggtcccggcggtgccgataggcgccgccgggggaaattttgaaatttggttgtaatttgttaacagattttcaacaaaaaaaggttggtttttgcgattattaagctcaattggtaggattttcatttaaaaaatgataaaatatgtatcaatttaaaaaaaatttggcagtgttacttttaaagatatattaattattattttttatttttccctttgactccaatttttcttcactaatttt

SEQ ID NO: 34558 - DNA, 882 bp, Heterodera glycines
ctttctctccatgatcaatgtgtgtgttgtgctttctctcctctgtcaatgctcggcttctctaatcatttcttttgctgtttctaattccaaaaaatggttgtgcttcttctgttgctgctgctgcagctgatctttctttttgtgctcattcctttgattttcatgcgcaatgattcactcatttctctctcttttttccctaaaaggctctgatcactttctttttaaaaaatttaattttatgccaaattttttgctttgtcccccccccatccatttttacattgtaaacattcatcgcctcctcctcctcctctcctctcactctgttgctgctgcttttgttgttgttgctgatggtggtgcaccaaattctcaataatttttgtcgccaccaaaaaacacaacaatttgtgattgattttgattgataaatgcatccgaatgtgttctcccccccccattctccgttatatatttatttcctcttttgctgttacgcaattttggtgctcctcccctcatcttcttccatttgatcattttgtgttaccatttattttacttaaaccacaattaaatgtgttcattttatgatgttccattgcaagaatttgcgcaaattttgtcgctaaatattaaaaaaaaattcatttttaatatatttattttatttttgcatttaaaagtgtgtgtatgtgcacatacgtcgtgtgctgtggacacaagagtggtaacaactaaaaacaactgacaaataccggcggcgacattttcattccatcgtatgattgtcaacaatacgcaacgactgctcggcattggactgctcgatctcgtcaatgtcgaaagcttttttcactgagacatttaaatgga

SEQ ID NO: 34559 - DNA, 1384 bp, Heterodera glycines
cataggtactactgctaaatcaacgcagagacgcctttctttgacctttttaggctcctgcaaaacctggtgcacttctgatcactactcgaaaaatgagtaaattaattttcactaaaaagttaagcctaaactttttggcctgtttaaagaggaattaaaaattttttaaaatttattcatctccctttttgatagaaaaagcatcagagtgcctaaaatagcttgtaaataaaatttggtgcgtttcagagcactttctgaaaaaataattatgaattaattttgcaaaaaataataaataattaaataaaaacgaaagactctgattttcgaaaaaatttttaaacccagctagctcggcgctcatttcagtgtaagttagtcctttaccggggagtttccctgcaaagtttggtgcgcttctgatcagtttctgaaaaaaaaagttaagcctaaactttttggcctgtttaaaaaggaattaaaaatttttaaaaatttattcatctccctttttgatagaaaaagcatcagagtgcctaaaatagcttgtaaataaaatttggtgcgtttcagagcactttctgaaaaaataattatgaattaattttgcaaaaaataataaataattaaataaaaacgaaagactttgatttttgaaaaaattttaagtaaaaatcgcaattacgctcaaaaagcttctcaaacaattttagcgcttccaatgccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaatattagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatccccattatgagcgctaaa

SEQ ID NO: 34560 - DNA, 606 bp, Heterodera glycines
aatgacatttcgccaactaagccaaattcggacgtttcgccaactaagccagaataggacatttcggcaactaatataaaataattttttaatttatataatgtttaatgataataaaatttataaaaagtgtatatgctctcttaataattctgaacagtatttgatcagagaatcagaatcctgacattgcacgtcagaagagaagcgaaagtcttttttttgttttccgcttctcattctcgcaaacagggacgatgagacgtagggattcttgcaccagcaggggtgggacgctaccgcgatctgcggcgttttttcacgcgattctcgaccgcggcaatttgaatccgcgaccgcggaatttttctgccgcgcaccatccctgtcttgcactaccatgattctgatattctcgccaagaaatagtcattgctctgaattgttaagagagaaacagacacattgttgaatcgctgatgagagcctggtttcttatagataaacaaatttgcatgaaattttattattgtttcataattaaaatctgttttaatctagttggccaaattagttgccgaaacgtctgatttttgatgagttggc

SEQ ID NO: 34561 - DNA, 937 bp, Heterodera glycines
  misc_feature (867)..(867): n is a, c, g, or t
  misc_feature (917)..(917): n is a, c, g, or t
cggaaatttgggggcctcggattccaatgatcaatttatcgttaatttttggcatcggatttcgatttacggaaattttggggacttcggattccaattaacaatttatggaaaatttttggcatcggatttcgatttacggaaatttcggggcctcggattccaatgatcaatttatggaaaatttttggcatcggatttcgatttacggaaattttggggacttcggattccaattaacaatttatggaaactttttggcaccggatttcgatttacggaaatttctgggcctcggattccaatgatcaatttatggaaactttttggcaccggatttcgatttacggcaatttcggggcctcggattccaatgatcaatttatggaaaatttttggcatcggatttcgatttacggaaattttggggacttcggattccaatgatcaatttatggaaatttttggcaccagatttcgattaacggaaattttggggccgcggattccaatgatcaatttatggaaaatttttggaacgggatttcgatttacggaaatttgggggcctgggattccaatgatcaatttatggaaaatttttggaacaggatttagatttacggcaatttcggggcctcggattccaatgatcaatttatggaaaatttttggcatcggatttcgatttacggaaattttggggacttcggattccaatgatcaatttatggaaatttttggcacaggatacggaaatttgggggcctcggattccaatgatcaatttatggaaaatttttggcatcggatttcgatttacggaaattttggggacttcggattccaattaacaatttatggaanatttttggcatcggatttcgattttacgaaatttcggagcctcggatccnatgatcatttatggaaaatt

SEQ ID NO: 34562 - DNA, 1271 bp, Heterodera glycines
tggtccataacaaattatttgaaactcagacgcgtgtgggctctatctgggaaaagaacacccgctgtactttgatgtgatgaagaactaagaattctgaataaaaaatttcgaaattcgtcacagaaatgtacacctgatacgctttgccaattcgaaggtcgctaatagtaaaaactaaaagccctcacaaactcaaaatcacttttataaattttcttaggcactgaaaacgataataaaaaataaaattgtgaaaagcatttacataacccggtttttgaatcaattaccccgaaaatcagccaaaaaaccttttataaaattttgaacaaatttaagtgcttttatggtttttggctctgggccatataatacatattcccaaaaatacaccccttaaggattatctaaaaatttaaaaatacacctgaaatgtaaaaagggcggccgctttaatagaggatcttttgaaaaaatgcccaaatatcaaatacacataaaatatgaacataaatcgcgaaatatactcaaatatgcaaaatatgacattcaagcggaaccgctcagttgggccggcacggttgggccccagcatgcttttccactataactttctatagcttttttctttgtaatccaaatccaacattgttggtgtcattcgaaagtttttcacatgctctattagccttataaaatgttttttgcctattttcgtgccaattttgctattttgtgactaaaaaacgaagccccaaaaattatgtttcgtggctccaatattttaaattcgtatctaataatttttttttaataattttaatttcctcgaaatgatttcatttgttatcatcgtcttctgcgcgttccatcctcaaaaaacactccgccatccatggcacaatattttgggcaaatgcctttctcgccggacttcccgggggggccatttggccccggcgggcctgagaatccgttgggtccagggatgccttcgggtccgttacggcctgagaatgtcattttacgttccggaattcttatttgttctttgccaccttttggtccgatggccccgtctttgcccggctgtccgactttccctggtggcccgggcggtccgaccgggccgggctcgcctaaactttcgacgtgccaaactcagaaaggcatttgctcacccggtggtccattctctccggggatcacttgctgaacggatttaacaattatttgaatcttttaactcagcaaaaacttcatttgtt

SEQ ID NO: 34563 - DNA, 637 bp, Heterodera glycines
gcccattcatttacattggacatctgcagcacaatcggtccgtgtccacagctttgtccattcgattgtcctccgatcaaattgccatccttttcttgctttgtccacaatttttggccgttgtccacctcaccccccccccgtccccaattcccccttccaaccctttcacatataagttgctgttttctgttttgcatttttccagtgaataagagacagtgcagaaaacggagattagtaagaccaacacattattcgagacacagcgcgagaagagaaagagagaaggagagagattgcttgcatttactccactccttcatctcttcccactcccccacccatcaagtacacagcaaagaaagggggatgggtttagcgcaagggaaaggcaaaatgaaatgaagtgaagagataagtcctaacaaaaaatagcaaaaaattttttaccgcacaaaccccgaccccgaacaaacaccggtaatgcacgaaaacacatgttttcacgccccggacaaacaccggcaaggtgtgaaaacacatgttttcacgccccggacaaacaccggcaaggtgtgaaaacacatgttttcacaccggacaaacaccggacaccgaccggtctttaactact

SEQ ID NO: 34564 - DNA, 1692 bp, Heterodera glycines
ttttaaaatttttcgaaattctgactttttcattaattatttattttttgcaaaattaattcataagtattttttcagaaagtgctctgaaacacacaaaactttatttacaggttaattaaggctctctgatgctttttctatcaaaagggagatgaataaatattttaaatatttttaattcctttttaaacaggccaaaaagtttaagcttatattttaaaaagtatcatcgaacctagcgcactaaaatctataaaatctctccaaatgttgcaggccttctccattgtaaaggactaatttaacttgaaaaaatgccaacgcttgttgtttttaaaatttttcgaaattctgactttttcattaattatttattttttgcaaaattaattcataagtattttttcagaaagtgctctgaaacacacaaaactttatttacaggttaattaaggctctctgatgctttttctatcaaaagggagatgaataaatatcttataaatttttaattcctttttaaacaggccaaaaagtttaggcttaactttttagtgaaaattcaataactcatttttcgagtagtgatcagaagcgcaccaggttttgcaggggcctaaaaaggtcaaggaaaggcgtctctgcgttgatttagcagtagtacctatgaatttaaattttctatgaatttttaaagttttttgaaatttttttaagtgcaaaagtggtgggtgtctggaaaaaaatgcaccgggtttaaaaaatctaggaaaattagtaagcttttgtagtgttccgatacgtatctctgcaaaatttggtgagcccctgatcaattacaaattatttatggacgatctgctctgaaacgcacaaaattttatttacatgttagtttaggcactctgatgctttttctatcaaaaagggagatgaataaaatttttaaaaatttttaattcctttttaaacaggccaaaaggtttaggcttaacttttttttcagaaactgatcagaagcgcaccaaactttgcagggacactgaaaggacgagaaataacctatttcaaatagtaactagtcatttccttttaataattttttttcaaaataatttttttttgggttttcggggcagtctccctgaaccgatgttaggcttaactttttttcagaaactgatcagaagcgcagcaaactttgcaggtatactgaaaggaagagaaataacctattttaaatattatctagtcagttcatttaaataatttttatccaaaaaaattttttttttgggttttcggggcagtacccttaaccgatgcgcccagatttatagggagtccgaatccttcgggaatagcttcgatataccactactttatttttaccttggatttttgctccccataattgtttgagtaccccaaacggacacttgaaaaaatcgatttttttgttttcggggcagtccccccgaaccgatgcgcccagatttatggggagaccaaatccttcgggaatagcttccctatagcctgtattttaattctgcgttggatttttgctccccataattgtttgagtaccccaaacggacacttgaataaatcgattttttaatttcataaatattttttcagaaagatgctctaaagcgcaccaaattttatttacaagttaattta

SEQ ID NO: 34565 - DNA, 938 bp, Heterodera glycines
ggattcggtctccccataaatctgggcgcatcgtttcggggggactgccccgaaaacaaaaaaatcgattttttcaactgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaatctgggcgcatcggttcggggggactgccccgaaaacaaaaaaatcgattttttcaagtgtacgtttggggtactcaaacaattatggggagcaaaaatccaacgcagaattatagtacaggctatagggaagctattcccgaaggattcggtctccccataaatctgggcgcatcggttcgggggtactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaa

SEQ ID NO: 34566 - DNA, 1085 bp, Heterodera glycines
  misc_feature (51)..(51): n is a, c, g, or t
  misc_feature (78)..(78): n is a, c, g, or t
  misc_feature (92)..(92): n is a, c, g, or t
  misc_feature (112)..(112): n is a, c, g, or t
tttgagtcagaagtttcgcttttcaaaaaaaatcattggggatcgtacgtnttcggcaaatgagcgcaccatagcaanaatggcgtagttgnaacgacacttctctagggtntgaggtgttttgagtcagaagtttcgcttttcaaaaaaatcattgggatcgtacgttttcggcaaaagagcgcaccatagcaaaaagggcggagtttgaacgacacttctctagggtttgaggtgttttgagtcagaagtttcgcttttcaaaaaaatcgttgggatcgtcctttttcggcaaaagagtgcaccacagcaaaaagggcggaggttgaacgacacttctctagggtttgaggtgttttgagtcaaaagtttcgcttttcaaaaaactcgttgggatcgtcctttttcggcaaaagagcgcaccacagcaaaaagggcggaggttgaacgacacttctctagggtttgaggtgttttgagtcagaagtttcgcttttcaaaaagatcattgggatcgtcctttttcggcaaaagagcgcaccacagcaaaaagggtggaggttgaacgacacttctctagggtttgaggtgttttgagtcaaaagtttcgcttttcaaaaaaatcattgggatcgtacgttttcggcaaaagagcgcaccacagcaaaaatgacggagtttgaacgacacttctctagggtttgaggtgttttgagtcagaagtttcgcttttcaaaaaaatcattgggatcgtacgttttcggcaaaagagcgcaccatagcaaaaatggcggagtttgaacgacacttctctagggtttgaggtgttttgagtcagaagtttcgcttttctaaaaaatcattgggatcgtacgttttcggcaaatgagcgcaccatagcaaaaatggcgtagtttgaacgacacttctctagggtttgaggtgttttgagttagaagtttcgcttttcaaaaaaatcattgggatcgtactttttcggcaaatagtgcccacagcaaaatggcggagtttgacgacacttctctagggttgaggtgtttgagtcagaagttcgcttttcaaaa

SEQ ID NO: 34567 - DNA, 935 bp, Heterodera glycines
ttgttttgatacagaatttgttttttttacagatggtacgtctgacaaaaaaaccaacaaaaaaatgtgaaagattttgaattttatcaaaaaacaaaaggggggacccttttgtttaaaaattgaaagattttgaattttatcagaaaccataggggggacttttgttttgcaaattttttgaaataaaaaatcgtgaatatacttttattcgccaaattatgctcaatgcttaatttgttcatcattctatatcaaaacaaacaaacaaacaaaatttgaccaaaaaaagtgaaaaattttcaaaaaaggccactttttaactacgccgattttctttcatcactttcactctccgttttgaggttctgttcatcggttctctcttcgccacctgttatttcatgttcgtcaaattccgtgccacttacaataaagacgaggacactttccgcgtcgaacttctcgtcctcccgtgcattgtgctggcgctgtttgtcaacgccgatttcactgcgttggaagttttgtggaccttcagtatttacctcgagggtttgccaatttattggcgtcattttgccactattctttagctgtcgcgattttgccccaacttttcatgcttcaaaaacgcggcgaagcggagacaatcactgcccattatctgtttctgcttggcatttaccgcgctttatacattttcaattggtttatttgccggttcatttttctgccattttccaaatttaagggtctatcgctattacactgaggcgttctacgacccaattgtgatcgtttcgggcattgtaagttaagaaaaaacagcgccttacgcctcgcattcctttcacaggttcaaactgttctgtacgccgatttcttctatctttacgtcactcgagtggtcaaagatggggccaaattggaat

SEQ ID NO: 34568 - DNA, 1051 bp, Heterodera glycines
ttgttaacagatcagtcaaggcctggaatgcccttgataatacgttaatgtctagctcattaaacacctttaaaaaattattagaattgactcttgattctgaaagcgccaatgtataaagaaattattaacttttgaggcattttattgactttgacctcgattttattttcatataaatttttcgttattgtttatttttaacctgtgatctcacttgatatttattcacttactctgtaaatatttatcttaccggaaaaggtcttctatagaagttattaacatcgaaaaatattatggaaataaaaaagtattagataagataaatttaaaagttaaaaaaggtgtgtaacgtgaacataatcggaatcaaaggtttttcacgtaagcatatgcgaacacagagtgtgtttttacgtgagctgtattttatatataggaagttttcccggagttctctagaatatcataaaatttatatacgcaaaatttttgtacaaatacctatgtctgttttcaaaacttgtttcacgtaaaaagttgacctgaaatgaattttttgtgtgtgattcacgcagcctaatttaaaacacaagactttcactttttttcatgtgaatataaatgaattcagttcacgtaagcttaggtgaaaacagttgtgtttacgtaacatgaaacacttttcacgtaagtataaataaatacagttcacataggcataaatgattactagggctgccaattttatgtaaatacatacatatttttttcctggcttctccttgctctaaatagcaggaaaaacactttcctttttgtgtttacgaacaaaaaccgggacttttatttacatatttttacatatttcggggtttttatacatatttacatatttcgggattttcttacatatttgtgcatattttggatttttcatatatattttcattttttttacatatattgagtatttttacggaaatttttggaatcctcaaaaaaaatcaaaattccgcaaatatttttgtactattttcattttttt

SEQ ID NO: 34569 - DNA, 1459 bp, Heterodera glycines
  misc_feature (935)..(935): n is a, c, g, or t
attaaatacacgtaaaatattcaaaataaaactcttgactcttgaaaaaataaaatcctacctttgaactcagtatgataggaaactctcaaaactgtcatatccgtctcaacaataacaggtgtttttcgtgcttaacggtcatccccaccgggtctaccgggcactgatcaatccaacccggaggggacaacttgaccaactgcttgaggaggtcagccatggcctacaggcggccattttccgtctgtactcatttgacggcgaccgaattctgagcattgatcagtgagttcgatcacaattgggttaaatttatttaacattcttcttcccctccaatttcaggctgcttcaactgaaggatatgcgtgccattgccgtgccccgccacgagcagttgacgctcaacggcatttctcctgtatgttaatttatggcacttagaagccagttgaagaagataagcgcaaaagcttggctctgtctgtccagctgaccaaattacttagcaaacggaaaataaattctaatcaatttccgatccgtcaagatcaaaatcctcagcgttaatgtgttctgttccttttgatttttaccgcatttggcgctgtttatttaatgtttcgtgatcaatcagcctaattttgatcagaaagctccgttagaccatttttagctatttcacttcttatattttacccctgcatatcttcttaatcccatttttgggtctgattttgggcttgtgagaacttagtgtcctaaaacgtaaattcaaaatttttgggaaaacaaaaagcttctacagtatccctatagatcagggctggccgtgattgaatttccaatcacggaaatccgtgagccgtgatcacggggctttaaaaaaaaatccgtgacccgtgaaccgtgatcacggcaccccaaaatcncccgtgatttccgtgagccgtgatccgtgattataaaaaaaattttctaatgattttttatttaaatttatttaaaaaacggaatttaatcgcgggaaaaattcccaaaaaatgttttaaagaaaccaaaacatataaaccgctttttttgcggcgaccttttccaaaaaatgactaagtttacgatttttggcaattttttgaggaaaattagagctttttgtagaaatctccaaggaaaattttttatttttaactaatttattaagaaaatttttctttcttaaatttaaccaaaaatctatttatgtagagaaaaaaatttcctctaatttgtaagctaacttttgatgctaaaaaaatcttttggaccaacatgctcagtccttcatgacgatctgaacaccccaaaagatactgaaagtcgggaaaattttagaaaaaattcttagagggttgggaaaattttctgaaaattttgaataggcctgtcgttttaaatttaagcggagagaaaaaatagg

SEQ ID NO: 34570 - DNA, 801 bp, Heterodera glycines
aattctatcgactgatataataacgatgcagtcgcggcgttgacagtgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagatccataatatctttccataacgctggaaaggcagaatttgaatggccagccgatatttacactgagcacccgttgaagcgggtgatgcgaagccatagcaaactgtatttttaaattctggccgcaattctaccaaacacgtgattagaccgcagtaactctgctcagagtgaagat

SEQ ID NO: 34571 - DNA, 881 bp, Heterodera glycines
  misc_feature (24)..(24): n is a, c, g, or t
ttttaggaataagatataaataantttttttaaaataattcctccccgggatcgtttttcatgattaattcaattttttcgcctttttcgactcaattatttccgaaacgtattcacacggaaacggcaaaatgcgatggcattggaaagagccatctgatcagaatgaagtcaaatgccattgaccaaaccgccgattctacccccgaaatatcgttttagaagaatgaatgcccccgtctcgggatgttgtccaaatattagtgtgattatttttaggaatttatttaaatttttatattgtgtattaaatgataatttgtttttatcaaccatcttcactttttggtctcctttcctcgcctgctgatgagcagcagttattgtccctcccatcagtgcccatttcccctttccctgctgctgatcatattagaaatttcaaagaatttcgttatgtttcaaaaaagttatggtgcattaacattgccaaattgttttatcgtcgtgtaaattgcaatagaacagcaaaaaaacaactcaccactttggtgtactcagcgaactctgtcgcttccctttcttcttccggccgaaacagattataataataattgcagaacaacaacacattgttgaatgattacagagagaatgaaaatgagagttcattccgtctctatttataaaggcgtaaagacaaaaaattggtaattaaaaaaacggcattaattgaaaattgcccatttaatgcgttgggttgatcatttaagccttaaacgggggttaattaagggtcggtcgatttgacgtttaacttaatgctacatgcttttttgttaattttacggctaatactaattgacacgaatcgctttttt

SEQ ID NO: 34572 - DNA, 113 bp, Heterodera glycines
cctgcaccgaaggtactcactcggcctcttcgcggtctcgtggtgggccttcgccagccttgtcatatatgatcttacgataaatcggaggaagttttattttattatgaact

SEQ ID NO: 34573 - DNA, 856 bp, Heterodera glycines
tttcagaacgaacagagggccaaaattgtggatgaattgggtgcacagaatgcggcggaattggaccgagagcagacggaggcaacgaatgcacaaatgcggttgacagaaatgctgaaaaaggcggcggaaactcatcggaaattggtgggccgaatttacgaatgcaaatttccgggcaattattttcaagtttttatccctctttcattcgatgcctttcaaaaaaaaaaatccgttaaactcatttccattattaaaggaggatgagcgtaatcaactgtttggaaagcacaaatttttggaggacaatttggaggcgtaccagcgatgcgttttggaccaattccatcaagagatggacacgcgctgttcacagatgggcaaagggatgcgcaacgcatttgcggacattgtcggacaaatggcggaatggggtaaaacagaaacatgagaggaggtgccccatttacaaaacaaaaaataaaggaaaatttaacaataataaatcaacaaaaaaatcactcttcatcgtctgctttttcttctactttttctagcaaaaacttcacccaaacagatcgtccatttttaaaaaaagaaatcgctttgttttcgaagtcaaaatggcacttataataaagaaattcgttaatgcccaatctaaaattattgtttgcagtttctcaattactttgacgtaaacatacgttaaagagtccttgtccttttcaaggacatcgcatttaaatcccgtatcttcgaattcccctattttgatgtttaaaccatgcagccctaattttttagttaaaaaaaggattgttcacgaataaaaaaacccactgtcccaggg

SEQ ID NO: 34574 - DNA, 186 bp, Heterodera glycines
atttttgcattaatatgttaaattccttatatatttatttctacagcaaaaatatcgactactgttaaagaattttcttagtaatgaggaatcatattttgtcgaaaaggaaaaccatgagtatacaaaaatacaattcaatattttgatttttgtagagggattgaacaaggcgaaagaagaagg

SEQ ID NO: 34575 - DNA, 1597 bp, Heterodera glycines
  misc_feature (1513)..(1513): n is a, c, g, or t
  misc_feature (1586)..(1586): n is a, c, g, or t
agcggaccggaccgggcccggtaccggtttttaccgcgctcggcaaaccggtccggcgttttttggaaaaatccggtttgaccggtttttgagaggccgggcccggaaaccggtcattttgaaaatgccaaaccggtccggaaaccggcattttggaccggtttttaccggtttatgatatagccaaaaattcttcatttttatacaatttctgttaataaattgcatcgaaattttcaaaaaatttctcggcggcgcctatcggcaccgccggaccctaaaaatccttaattgtctttatttattagctcaaaatcgaaattttttttgattttgctgcaccatgattctgaatcttatcaaatgttccacaaatatcgaacacagagatttgttcttttgtgctacattactgactaggatcttctgtactactgcactttagcaaacaattatttctttgaatgctttaagagttgtcaattttatcagcagacatatgactgcagagagaatgtagtgaccacctgaagagctctctgttgttaatctcctatttgtaagtgcaattgtattttattttctagttttattagtgacaaaaatcaaacatttgctgtcttatgctcgtcagtgtgaaagtgacattgtcagattgaacatggatgaacatgtcaaagccgaaaattggagcagtgaatggcaacggcaaaatgaacgaaagggccaagaaaaaaagaagcgaacgattccaaaactaaaataagaatagtttttcgataaaaaactggatttagaataatactagaatagaccgggacttcgaattttaggaaaaaaggggaaaatgaggatcgggatttgtcgggacgagaaaagccgggaacgtttcctaattaattctttttaaaataatactggagtaggtagggactgaaaattttgggaaaaacggagggggcggggggataagtccaatagccggatgcagtgtggtattagattaatgttgttgaccccttcttttgaattttgtatttgattggcttttgtattttggtgattattcggttttatggatattaattgtcgaccatggaaagtcttccaccttttcataattcatcggcatcagaacggaggtgaagcggttgagcagtaaaaatgcggtcaaaaaattctccacatggaaggagtaatagccaacaaaaagcaaaagtgccaacacaagacgaggcaagcgcagataaagcggcaagaaaaggccaattctgccaaagcgaggagcaaaaaaggtgaacacataattgacgaggctctgaaaatgttttaaaaatataattcaaaatagaaattgtctttttcaaaatatttgttttacgcaaattccgcggacaatgacaagcacaaaaaacgatgagcgaaaatggccgaaatttgcgatgatcactcccaactcaacacagtacagcagcgcggacggcacaccgattggccatgcgacgaccatggnggcaaatcggcattggcaaacacggcatggcggaaaaatatgccgagtccattcagggcattaagctaaatangcagggatgat

SEQ ID NO: 34576 - DNA, 1058 bp, Heterodera glycines
tggaggaagcggaagcacgcggatgttttgagagaatgtctttggatgagaaggaagggccggtgattggaattgaagggaaaaaagaggaatctgaggcccctggtagtgaggtgaagagtggggagggccagggagccaatgaacgtgaccccacgcagggaggccaaaaagctgagcagcaaccaaatgcctctgattgccatgcccgcggacgaaaattttatcgcggaggtcaccgaggagtgccacagaaaaattggagccgaggcgggggttttcaccagcatggcagctgggtcggtggatgcccggagacgaaggcccaagcacgccacttttacaacttccgccgaaattcaaattgtgttggaccatccacttcctcggccgcttgtcggtgtgtgcaatgcgcgggccactcagggcatcatcgcttccgtccgtatcgccgttgacgtgaaaatttgcaggggggaaggaagtgtgggatccgtctgtccatcctttttcctatcattttcatttacttgtttttgtcctatttatccaaaacaattcctcaaaataattcattccctttgatctgaatttgttcaccgtcaaaaataatcccttgcctcatcccctctggcgcttgccccaagcattatcctttgtcccttttaatgtgccgaatattcttgctattcccctttgtctgttttgtgcacgccgcctttaaaccaattcgctgtccgctccgacccgtatttaagcgatggattggacctcaatcggacttcttcttctcttctcaaaaatccttattgttgctctgttctctaaactttgcttaaaatccaattttgactaaaacaccatttttactcatttattttgattgaaacttttctttaaataaactttgtgtttctcaaaagcccgggttttgaattggtaaaattccctaacaagtgttgccggacacaacactttttggtgccacgacccgggaccattaagtgagcaggttctggaactgggtgaaaaatcaaaacgctaaatccatttgggac

SEQ ID NO: 34577 - DNA, 956 bp, Heterodera glycines
tctttcgccccccccacctcccacgcccttcagagcacgacaaatatttcaacaaaaattttgaaaaattgactagagcaatcgaacgctaacggacgacctaatggaaaaaaatccccgaaggagagaatttaattaaatccattccttcgggtgtccgtgccgggtactcaaacattcgcggggtaagcagtgatggttcgtagaatcaaagtaccgaacctatagggaagctattcagcaaggattcggtctccccagatcggacgggtgcgcatcggttcggaaaaaactgcctataaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctggacggatcggttcggggggactgccccg

SEQ ID NO: 34578 - DNA, 513 bp, Heterodera glycines
agcctaaacttaggcctagtctaacaataagccattgttcgagttgcctgtggataagttgtcatgataaccttaggtttaacaacgaaatttatagttaaaaactttattgaatacctaacaaaaaaagtttttctcttagttattaggacaactataataccatgagaccagggatggcacggaatttcgatttccgaaaatttttggggcctcggaatgccatccctgccatggacacaaaatgccatgggacgcgtaaaatgtcatgggatgcgtaaagtgttgttgggactcgtaaaatgtgatgggacgcgtaaaatattatgggacgcgtaaaatgtcatgggacgcgtaaaatgtcatgggacgcgtaaaatgtcatgggacgcgtaaagtgttgttgggactcgtaaaatgtgatgggacgcgtaaaatgttatgggacgcgtaaaatgtcatgggacgcgtaaaatgtcatgggacgcgtaaaatgtcatgggacgcgtaaaa

SEQ ID NO: 34579 - DNA, 787 bp, Heterodera glycines
gatagagagagagagagagagagagagagagagagagagagagggagagagagagagagggggagagagagagagggagagagagagagagggggggcgtcgaatttgaaagcagaaacaatgcggggctttgggctcttctcttctcctccgaattcgcttccctctcgatttcgtcgtcaaccaaattaacaaaatacggcacacaaacaattaaaaccgaacgctgtataagtcaacaccaattaaagtccacagcacaaaactcaacaaatttaattcaataaaaaatcaaaaatcggagagagcgatgagaatataatattaccattatttgacgcaaaattataatatgagaagaactgcgaaacaaaaccaaaatttagaaaatgacaaaattaaagagacaaaatgccacaaattaattatttaaattaaatacgaggtcaaatatcacaggggagagagagggagcagaaagggagaggttgggaaaagttagagagaggggtagggtgagaggaggcggataaaaggggagagactgtaaggaagagaaaggatgggaagcagggataaagggagtgagggagggtaaagagaaagggggagaaacgggcataaacctcaagagtttttggatgacaatgattctttgtgaaggtaagaaagaaatgaataaagaggtagttttttttggcaggaaatattccctgtaaatgaaaataaacaaaaaatcgcgatagtgagatgaatttgggaaatatacatcacgacttcttcggga

SEQ ID NO: 34580 - DNA, 1766 bp, Heterodera glycines
cctttttaaacaggccaaaaagtttaggcttatattttaataagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgctttttaaatttgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaataattgtttgagtaccccaaacggacacttgaaaaaatcgatttttttgttttcggggcagtccccccgaaccgatgcgcccagatttatggggagaccgaatcctttcggaatagcttccctatagcctgtactttaattctgcgttggatttttgctccccataatgttgagtaccccaaacggacacttgaaaaatcgatttttttggtttcggggcagtccccccgaacgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtga

SEQ ID NO: 34581 - DNA, 1224 bp, Heterodera glycines
gtggtcaaaccttcaccagttcattccccagtccgatccccaccaagccccaagcaaaacacaccattagtcggtcaccgaacgcaaccacaagaacggactgatcaactgcaagaaacagaacaacagacgccggccagcgacatgagatcagggatcgtgattaagattttttaagagggagaagtgttgtattattgtcattctattttcttggcattatgttattgacacgtcaccatcatcccacacaccaagatcgcccataaatactgctctcttccctccttcctcgcttcgggcgtcattcattctcatttatcatttgcatttcaccccacacactttgtctctctcttcacctcactttatttatttgtttattgattatatttcttcttgttgataaacgacacaacaaattggcgcagtcagcataggcttttattttaaaaatacaattcaaaggaaaagactattggctttacaagctgctaagtaggcctctgtgaacacacattaaaggaaaaacgaatttgggaacacgtaagtcaaagcgaccgctgcgtgcagttaaaattcgcaattcctctggccaaaggacacttaaaattactcaacaaatcaccgaattttactgccaattaaaatccaaatcaaaattatcactgacggccaaattctattcactttctcaattcactgtcattcaaatcaatcattctatcaccccggagcaactcaaagccattttggctgatcaacaggaacagttcatgaaattgttgcaaaacattcaactcggcaaagcaccaccgcaacaaaatccgtcacaatccaatgagatggacttttttgcaaattaagtgcacaaatttcggaatttatttacagcccggatgacaacatcacatttgacgaatggcatgaacggttcggctctttcgttgaacaggagggtaagcgatgtcagagcataacaaagtgcaactcattgtaagtaaactgggacggacgaataaaagcgttacactgagagtattcaaccacaaacaccagataaagttggtttgttagacacactatcaaaattacgcacaatttttcccgaaactaagtcaattttattaaaaggtattagtgtttttcactcaagtgcgaagtcaatcaagacgtcctcgcgtttggctcaaccgtcaacgcagtggcagaaaaaagcgaaat

SEQ ID NO: 34582 - DNA, 807 bp, Heterodera glycines
atattgtctttaactacatttacaataaattattggacgcaaaatttattggaagcattagtatgtgaaaatttatacaaaacattggtcaattattaatttgaactaattcccaaccgccaagagaatgccacgcgacagctgggatgggatacatcgcgtagacaagttgtgcggaagtcgatggccaacttacttgaaaaaaataacatttttacaacttcaaacctgaccatcgatttgggccatacatattctaatgtttgattttttaccggcagatatgaacatctctcacttagaatgctaagttgatcaagttgcctgagctgcttcctgctccactagacttgacactcagctcaatgtgctctgatttcgtcgtcctaccgccagctcaacaccgtacatctatgatgaatactggggattcattgatgagttgagatgatcaatctatcattcattatcaatctttgaattataactattcaacaaaattacagcagtcctagataggctagagcccagcagactgtgaataaagagcttgaatcgggatcagacaggatttgtaaagcagaaaatttgttctttttgattttaaaattttttttttaaatttttttattttctttaaatcttttttggaaaaatttctgaaagatcaacagctttttattaaaatttgttaattgatctaatcatcacttagccgagctatgatttcagtgctaaaaagtattcgatcagtataatcataaaagttgcctgcgctgatcagaaaaaatatgattcagatcagcg

SEQ ID NO: 34583 - DNA, 1067 bp, Heterodera glycines
agggggaaaggattgtttgaatgaatttgcatctcgttcataaagcatcgccaaattgtcgtcgcaatgtttgacaattgctcatgctgttgctggttggttgctcaaaatataggcattttcaacacatctttgcttttttagcaatcctctccaacggcaccggcattgtattgatgctccgctgtcactcaaagtcacattgtatcccttgcaactttgtcgtcgcgaataactgttgcaggagctcttgcaaacattttttaaagatacaattggacctgaaacagcaataagattaggatgggttaaaaaaggttttaaatttattgttttaatcccaatcgcaaaaaaacatcgtacattaaaacttcactaaaaaatagaaaactatattaactattgggcaaaacatcgactaagacacggcatccctgtgccaggtgtgttcgacagattattgattccgacataaaatatttatgataattagagaaaactcgagtattgagaatgaaactcgactgatgggtgacaaaaaaccaaaccgaccgagacacagaagccaaattttcattaaaaggtttgctaggttatttggacaattttttgtgatttaagattttcatgaatttacggcgatcgacggagagtccagcgccgagaaaatacgaatttaaatgtaactatagtcgcatttttgatttttaaattcaggacaaattgggttaaattatatgttgactcaaaactcattttcttgacagtaaagtttcgtttctttttttactttgcttttcgaaatatttgttgccgttaaatctggcatcccaaccagtacctgcaattatattattacaatttatttattgtgttaccagtctcagcaggaatgccagtaacaacaggacggtcatctacagcattagaaaaatgtgtcggatcagtagtgacaacgccaaaaggaataggctggcttaggataaccataaacagcgaagctgtccacttgattgaccataattgttcccatcatatccataagttgactgatgattgccgcttaa

SEQ ID NO: 34584 - DNA, 1007 bp, Heterodera glycines
  misc_feature (882)..(882): n is a, c, g, or t
  misc_feature (947)..(947): n is a, c, g, or t
gttgtccatgcggcacaatttcatcgattgtgtcgttgtccattgcggttgactgatcgcttctctttgtattggcgattcgatggtccaattttgtcgctctgagcaatcattgagaaatggaaactaagaaaagaattttcaacggaaattgaattgctgaattttaaataatttatttttctacagtatcaaatttaccgtaccattgccgtgtgacagtccgcgtcatcactcgcacattcgcagaacacctaatgtacaaaagacttactgtactgcatgtacagtatatttttggtaatttttcctttttgaattttaaaactctttttaataaatatattctttttaaaatgccatgccatcgcttgcgaaagcggagcgtgcacaaaatgcacgaaacggtgcaacgcttgcgcacaatgcgcgggccgtctgcgaccgcaggcgccgcggtggtgaccgcatttgatgcgcaattcgctcaaatgccaacggcacggctcgtccatgtcgcacagggaaagcaccgccgggcacgacgacgcccaaccgatgccattggttgtcattgcatcggaaactgaaagtaataacaaagcaatttgtcatcatttttttatttttaactcgtttttaaacaataattaattgctatgtttaaaataaaaataatttatttaaattaattttcaaattttatggctgttttttccccaaaaatgactcaatttctgctaatagtaaagagaacaacagccgccagcgcagttttgtccacattttcctttatttgtcggctttttcggttgtccgattctttcgccattcttttttcgtaatttccggtggctttatcccccggtccaacttcatttnagcagtgagaagcattggggagggggaggggagggacacaaaaagcattggtttgaagctgtggntgtcagaagtggccatcttcaccgctttgcctatgttttgtctctgaatggccaaggtgt

SEQ ID NO: 34585 - DNA, 614 bp, Heterodera glycines
cgtgcggttccccccccccccccccatttttcacaaactatccgaatgccaatgccaatgattgacttacccccccccccccgtcgatgttttggtttctgttctcttcgaggtcagttgaatgccgagggattaagggaatgaagagccattggtgagaaataatgagggggtgagttttttggcatattaaaacgaatgtcatttttgagtaaactgatgaaaattaggagaaacaacttaaaaattaattaagatttgtcttattttgggaaaagggctgaaactgaagacaattatttgttgcatttgtcattttaatgataaattgatacggtattgcatttacagtaagaaaaggcattgacaacgaaaagaaccaaaaaaggccaaagaaaaatatttgaaattttttcttccctcataaaaaaataacttaatgagctgaacaattgggaagaagaacccacatacagcatctgtcccttctcaacaccgtattcccattcctaacacaaaaaatgtcacgaccatctgataagcgcaaacgatggatgctcaaggacagtttggcgaagtgacgtgtccacggcacttccgtccccgtcccatca

SEQ ID NO: 34586 - DNA, 1276 bp, Heterodera glycines
  misc_feature (1243)..(1243): n is a, c, g, or t
  misc_feature (1250)..(1250): n is a, c, g, or t
gttagttcggatgttacgatgtccaattctctccatcattcattatgctgtgactacgttacaccatcttttattgtacgtggaaatggcaaaagaagaagcaatcgtttgtggcgcactcgaggcgcttgttcctctccttgctcctcaaactgcaattccccaatcgggaccaaacccaaaacttcaagcaatggttaagtcaagtactcattcatcctataaatgtgttgtttgaggttgctgattcactttattttctgctgctggacaatcttcaatgcaaactcacattcctatccctccaaggtccacgatatctcgtcgaaatcctcaaatcgaatcccggatatgtaaagttgttttacgccgttgtccgttgtattcgttcaataagcacttgcgccgaaaacaaagcttcactaattgccataggtataattttgattttttttttgttgctgagtcgtaatttgtttaggtggccttgaacttttgcatcgggctttcaattttatagatgatgacaaacgaaaattgacgacattaagtgcgattagaaatttgtctgacgtggccactaatcttgaaacgcttgcgccacttgtggctgagttggtttctttgattgccgaccacaatgacgaggaattggtcagttgcgcctgcggaatcttgtcaaatttgacttgcaacaacattctcaacaaaactacagtttagtttcaaaaatcatattttagtttggttttgctaatgttaggtttgcactaatggcggagtctccatcctcgcacgggctctctcaaaattctccaacattgaggatgtcacagaacccgctctgtgtacgcttagacattgcactgttcgtcatccgcttgcgtaccaagcacaaaacgaacttcgttttgcctatgcaactattttggttattttgcatttattaagatcgaccaaatgtttttttagtcccttttatccacgcaacgaccgcccattgtaaaagctgcgttgggccttgtgaggaattgttcgctttctaacgagaatttgaagctaattctctcggttagtggctaaatctttaaatattggaaatccactcattgtttcaaggaaaaaaatgccgacggcgaaactgtactatcactgtcagtcgcattgcttgaacagtcgggcaaacagttggcccacgaattggagcggtctctggtgacggagtttctcttctcgaaatggntgaaggngcaatctctgcgctacaccactcact

SEQ ID NO: 34587 - DNA, 1310 bp, Heterodera glycines
gtgaggggaggaaaaaagaacggaaaggaaaagcggcaattcaaaaatacgtttcaatggatttagatgaacaaattgttaattaatccttcgcttttactttgttccggcattgcatgtttgtacgggtctttccataatggcacttcctcccccttttcgtcccttttgcttgcggcgtccaaattctgttcaagaacacgagaaaaatgaaaagacgacacttcaattgtctgaggatttgcgaggcttttgcgaatcgcgcggcgataacaaaacgaaaacatgctaatgaatgccgcaaattacgaaaaattaatgcttttggaaataaatgttttgatttaaacgattcgtaataagaaattgaaagcaagtctgtctttcaaaacaattaaaaaattaatgagtttccgtcttttatcaccacccttcgcccgtcgatgttcggctgttcacaaattcctgaatcagctgcatgagttctctcttcacttcatccggcacaattcgacgcgaggcatccttcagctcgtcaaccatcgcttgcagttcaacgcgttcatagccctaataagaaaccatttattcgtaggtgtaatttccaaaataggaaagtttatttaaaacaataactcatgcggccttattcaccttcgctaccttcttcgcgatgtactcctcgcacatgctctccactcgtttcgcccaccccgactcgtgaagtcgtcgttccacaacctcttggacccggtctttctcaccactctccacaaattccttctccaagtcttcttttcgttgcaattttttcaaaggatttaaaaatgaacgtgccgatgatccttgcattatgacaaaaaaaaatggaaaaccgctttaatttctcacataagcatttgtccaagtataatggtttaaattaccaaatttaattaaatggaaggaataaaaaagccatcaaaaccaattagatattaaaagcagagaacatataaaactacataaaaatgaggaagacatgaaagtccaccaaaggaaaagaaaacataagaacgaatatcatggtttttctcattatcaaaagggtccagatcagatcaaccattgttttgcaatcactgatcaatatggtctcggtcgttcagcaaatccccctcctccaccgccttcgtacccacgcataggtccccctccgccagggaagccgccagggggcggcccaccaaatgcacctggcggcggaccacattttgcggcctttcggcgcatggcacggagtgcactccttacgaaacgcgaaaattgat

SEQ ID NO: 34588 - DNA, 1496 bp, Heterodera glycines
  misc_feature (1474)..(1474): n is a, c, g, or t
gatgccgttcatagcattaaaaaaaataaataaataaaaatggcacttctatagcatttggggagcggcattttttccaatatcgtaaatgtccccgaaaatagaatgtcaattcacctcgcttttcgtgctttcccgtccctatgtgttgcggaagtgccgcacaattcgaaactgttttcaattgtcgtaaatttgaatttacatttataaaacatttaaaatacattatatgtaccataaaatttctctggcgttttttttttgtaaaatgtaaaatttgttggttttggtttagatttttgacactgacaccaccacattttcttcctcctttcttcttccttccttctctccaccccatactttttttttaatacaaaaaacgttatttgaattggtgcaacgaaagcgacgacgaaacgacgcagtggcctctctctctctccgtatgatgcaaaacccacggaattataatcaataaaacacaacctgtgctgtttcaacgatggaaaaagtatgttgggcgtctccgcccgaacattcggtgattgaaaaaaaatctggattctatcgatgataaaattgtgaatttcggataaattgttggattttgggaatgaatgaatgctggtattccttgtggaaacggggacaaatcgtgagaaatttagcatggtcgtgtgtatgatggataatatcagtagtgatcaatgaacaaaaaaaaaagtcgggaattccaacggggaaaatgcccgattttatagatgctacataatgttgaggatcccgggaaaaatggcggatgtttcctttataatactgtcggggattccagggactttattgtcaggcaaaatgtccaaaaataaattcggaactcgtggaggaactctaagaaaaaacatttacaatgccaacaaaaaaaccatttttcaaaatttaaatttcccaaattcctaggttctttcccctttggtgctgaacccggcggcggcgagcagtagtagcagcaacaataacaacaacatcaacagtggaattgagcacggattacctctgagcagcggcagcagttgtcaaagcagcggcgaattgttggacgacagcaggggacgcggagggggcggagcagtgtcagcaacacaaccgcagcaacagcaacattttgcgcaccgaaaacatcaccgccttcaactacaacaacaaaggcagcaaagtcaacgaaatttgttgctcggcaacaacactggtgctgatcccacgcttggcaatccgtttgttgccgattttgcggacgaagacgaggacgacgatgccattgcacggcacatggacattggggatgaggtgagtgaaataaattttggttggaatttagtacgaaaacctgagggttcgtttccgaaatttccaattgatcagcgcttttcggcgtttttttctaaattcgaaatgcctctaatttacaaanaagtaattcctcgtagactttt

SEQ ID NO: 34589 - DNA, 1370 bp, Heterodera glycines
  misc_feature (1339)..(1339): n is a, c, g, or t
atataattatatttcttagggcttaattttttaggtagtaactataaaacacaaggtttaaaatgctgttttaggtaagggaaattatattaaaatcccgaaatattaaataaatttttacgaaaaaatgccgaaatattggaaaaaatttaagaaattgaaaaattttgtgatgtaaaaaaataattaactgctcataacactaaaaaaaatttcttcattgattacaattgctaataattatatttttgaggtttttaatgcatttttccaaaataattaaaattaaaaaaacaaaaattttggtcaagaaagaaaaaaaaattacaaaaatcaaaattttgtcaagaaaaaaaaacaaactaccaaaaatggaaaaaaatttttaaaaaacgcctatgtatttacaaaagttcaagcaaaaaatttatttttaaaactgtaactaataattacatttctttttgaattttagcaaatctggaaaaagcaaatgagcaaaattgaaactgtcaaattgaaatcggatatcgaagaaatcaaatattttcttccattttgtcccaatgtcaatctgcacaaaaggacatgcactgttgtcacattcggtagagcaaaaatatgagaaattttaaatgaaacccaaatttttgctaggtgttgggcatactgttaaggctgaaaaagaactgctcaaaatttacccggaatgccatttgatcgctgctgatccgtcggatgaaatcaatgccaatttgactcaatcaatcggtggcacttttgttcatggcccaattggtgctgagacggccaatcaacaaccagtgatctcatggggaggtaggctaaactttatggaaatgcttttctttaatatatttgcacttcactaccagtgattgtaggtggcattccgaggccgaacattttaggaaatcggaatttctaggccaaaagtttttaggaaaacggaattccgacattgcggaaatttctaaatttttgaaaatggataaatttttcaattttatttttttttagtagcatatatgtaaaatgttaataaatatgattaaaaagtgtatttaattaaaaagaagaagtttaaaaacaatatacaacaatttgaaaattagactgcataaaatattttaaatcggtgctggtgcatttcctaaatccgccaccaaaatagaatattaaattaatagatgaatattatgtattttcgagcaaatattaagttatttttgatatatattcgatcttttactaattatattataataccatgctttttgtatacataaataaacaaacttaatttatatttatttanatttaccgtgatggcggatttagacactttt

SEQ ID NO: 34590 - DNA, 1181 bp, Heterodera glycines
  misc_feature (56)..(58): n is a, c, g, or t
  misc_feature (60)..(60): n is a, c, g, or t
  misc_feature (206)..(206): n is a, c, g, or t
  misc_feature (211)..(211): n is a, c, g, or t
  misc_feature (1118)..(1119): n is a, c, g, or t
  misc_feature (1158)..(1158): n is a, c, g, or t
taaagtataaatgtatattttattatagtatgattaccctatctttatttactgannnantctaggtgttattggtctaataaatcgatgtatattaatatatagtttaataaattataaaattttgcaaattaaagccgaaagattatttatatgcaatataaagcttcataactccaaaaatttgatgcatacatatatatagngaacnctctaccttaataattttcctgcgccgaaggcccaccacgaggccgcgaagcggccgagtgagtaccttcggtgcaggaaaattattaaggaagagagttcattatttatttgttttttgcataattaatttataaatatttttttcagaaagggttctgaaacgcaccaaattttatttacatgttagtttaggcactctgatgctttttctatcaaattgggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaatggtggtgtctgcaaaaaattttcaccggggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaattnntcaaattctgagtctcctattattttatttttttttcanaattctgaaggggcggggggggg

SEQ ID NO: 34591 - DNA, 950 bp, Heterodera glycines
  misc_feature (934)..(935): n is a, c, g, or t
aatattgtgaacttgattataatccctagtgtaagtaaccgatattcatacaaataaaaacatctctttgccttaagcaaaataaataataattaagttattaattaccgagtctgcaataatataaaatatttgcgtactgtgctttgtacaacctctgaggttcctattaggaaaagccttcagattaagcctatatcctatacgagtatggcttttaaatgacaagataaatatatgttaaattaaaatgctgacacaaaagacctatgttttgtagaaaatccctaatagtttcagctttggctagattttcagcgaatatttttgaacgaaacttttctgtttgttgaatttatccagaaattacagacacatttccatgaaatattgtgaacttgattataatccctagtgtaagtaaccgatattcatacaaataaaaacatctctttgccttaagcaaaataaataataattaagttattaattaccgagtctgcaataatataaaatatttgcgtactgtgctttgtacaacctctgaggttcctattaggaaaagccttcagattaagcctatatcctatacgagtatgggttttgaatgacaagataaatatatgttaaattaaaatgctgacacaaaagacctatgttttgtagaaaatccctaatagtttcagctttggctagattttcagcgaatatttttgaacgaaacttttctgtatgttgaatttatccagaaattacagacacatttccatgaaatattgtgaacttgattataatccctagtgtaaataaccgatattcatacaaataaaaacacctctttgacttaagcaaaataaataataattaagttattaattaccgagtctgcaataatataaaatatttgcgtactgtgctttgtacaacctctganngtcctattaggaaaa

SEQ ID NO: 34592 - DNA, 1326 bp, Heterodera glycines
acctcatattttttctattcttctgttctctctcgtcaatttctctgtctcgctttgctctctttcttttctctgttttctttctctaatttctctgtcttaatttccggtacttttcggttttgaggccaagatttaaattttaaaaaaacaaaggaagcacataattgcaaaaactccgtgccagaattatattgggggcatatatgtcacaatttgagctaaaatttcttcaaatggcactgcgccacttttttttggcatctttgcgccagaggaactcgcacaaataggagtccaccatttgggagtgcgtgccgtgttgcttttttgttgaatgtttttgccgagcgccaagtgcgctcaatcgtttgtgttgggccccgaaaaatgtcctttcgttagtttatgcaatgtgaatgaatatttttgcatttctgcgcgtctttttttaaattcaaatctaggccccaaaaccgaaaagtaccaattttcctttaaatttattgtttcttttcctcccttctctctatttctctgcattgcttgcctctttttttctctcttctctttctctatatttcttgagggcacctcgttcggtcggggtcgttttcgcgtggccgttttcgcgtggccattttcgcgtggccgttttcgcgtggggacgttttcgcgtggctggggtacgttttcgcgtggccgttttcgcgtggggtacgttttcgcgtgagtacctgtttaggactgaaattggtcggatttgtgcaaaacatccatgtttcgaatcccgaacccgaattcggacaaatttcttaacttttttatttcttgcggctagtatcttctacaataatttgtcagtttggtcggatgtgcgtcaaacggaaaaaattattaaaattggttctagtcggttttacgcgtcccatgacattttacgcgtcccatgacattttacgcgtcccatgacattttacgcgtcccatgacattttacgcgtcccattacattttacgcgtcccataacattttacgcgtcccatcacattttacgaatcccatcacattttacgcgtcccatgacattttacgcgtcccatcacattttacgagtcccaacaacactttacgcgtcccatgacattttacgcgtcccaacaacactttacgcgtcccatggcattttgtgtccatggcagggatggcattccgaggccccaaaaattttcggaaatcgaaattccgtgccatccctggtctcatggtattatagttgtcctaatgtcagagagaaaaacttttttttgttaggtattcaataaa

SEQ ID NO: 34593 - DNA, 1784 bp, Heterodera glycines
aagcagtgcattttatggtaacgaccctgaaccaggcgtgccaatggatgtaactccaatggcgcaatgtgcattcgaatgttttgtgttcaaggtttctgcagttcgcactaattatcgcagttggctgcgttcttcatcgatccacgagccgagtgatccaccgataagactagaattcattcttcaacagaagtgtaaaaaaaaataatgaaaaaaaaagaaaaagctggcggtgcccgagctgacactcattgagtcttaagccacgtgctaggccaagcacgggcactaccgcgtcgtctcatcacggccacggacgtagcagcaagcacaaacacaccgctagttacggcacgtaagaccgggaacgaaaccaccatccccagtcagtgtgttatgtgcctgccacaacaaccgctcaacgacgcacagacgccagcacagccgttaggtcgccccacgagcgtgcatcccacattggcgcagcgaaccagccaagcgaggcggcccgccaccgacacattgccacgcagcagccatacacaggctttcacacgtgcagcactgagcggtataccacagctccaacgtatggaagcaccccaaaagcatggctcgtgaggcagctgccccgtaatgttgggcagcgtccacaagtcatctcgaacgacctgtgcccatcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccggggcagcgacgggcggtgtgtacaaagggcagggacgtattcagagcgagttgatgactcgccccctacaaaggaattcctcgttcacggacaataattgcaatgtccgatcccaatccacggcaaattttcaccggtttaccaaccccttttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaaatcctcttctattattccatgcacgaacattcaagcgaaa

SEQ ID NO: 34594 - DNA, 1109 bp, Heterodera glycines
ataattaggaaaaaagaaagcatatgccaattcattgcccaaattaaggaagattaaattgcggaaataattgcaagcgacgcacacaacaaacgaacgaatcaaatgatcacggacggagataataacagataagacacccccggcgggggggggggggggggggacacgcacgtcattaactttaaactcacattttgttacaatgaaactgctgaaaatgttgtaaacacccgacaaatttggataattaaacgaaaaaagtgaggtgaaaatggaaaaaattagacaaaaaaagaagaaaaatttaaggcttcttcaattcactaaattcaatttcaatagaaatgggtggaaagataagttcaaataaaacgggaaaaaaaggattttggaaattaaatttaaaaagttttctccccgacaatctgttcaattgtaattttgccttttcttccacttaacttttttacaaaatgattatcccctcttccccccccccttcgcttttcccactttcgccgtccgtcccttctcaattttcaacgaattctttcccccaccctaaaaaaaactgggcgtgagaagcggctgatattatttcattagcaaacaaaaaaaagacttcctcgttgcgaaaaatgggccccctcatttttcgtgtcacttttccctcggaaaatttcgaatgaatgaattaacaattaattgcttataaaaacagctcttttcacgcgcttccccccccccccccaaccgttcaaataattttttttttttttttttacaatttgagtaatttgaccaaacaaccgactgaaaaacaaaagaaaaagtattcctttgtgttgtgtttggtaaggggtacggtagtaaaaccttttcgatacggtgcgatttgttaaaattcgatctcaaaaaaggataaatagcgaacataatacgccgtgggttccagcagtccccctttttcacagtggaattttccgtttttacatcttatgattttcctcccatttcctttctcccgcggaactaccgatcactgatcactaaaagattactaatcggtcacttccttcaatttttttatctgttatggttttttt

SEQ ID NO: 34595 - DNA, 495 bp, Heterodera glycines
catgactaaattataaagaaaaaacctaaaaaaattaaggatcaaatttttgttttccagatatgggtctgagtttttaaattcggtaagcatatatcgaaatgaatttgaataaaacgaaatgaatttgagccaaaatatgtaacatttatagtacagaaatggaaaagtgcgactttatccaccccatccacagtggtgttcacctcagcttgtgcccatttttcatccacttgtggtgaatttgctggcaaagtctgctggtactgttgttgatcgtcatggcatcgattggacgcagcttttgccgggacaccaatttgagttcggtcccgtgcttcagtgaggaagatttggtgctgaattttcaggtttaataactgaatatttcttacacttacaacaggaattgttctctaattgactgacaacatcgggattctacccataaaaatgcaaagataccttgtgagatgtgctcggctgtccaatttc

SEQ ID NO: 34596 - DNA, 833 bp, Heterodera glycines
tcttttttctttttttctctttttccttccttcgtttcttcttgactatctctctatctctctttcttttttcactttttttctaactttggttgtctctgcttgctctctccacgtcccttttttgctgtctctgctcttccttttctttatgcttttccctccggtgcccataggccacgcccactgccccgggggcgatcactttcgttggtgggggagaggccaacaaaaaggccgtcccgccgctcgacaccgctcactttcgacttgacgaccacggccaaaccgattcaagaattgctagggaacttattgaacaatttcagcctttcatttcatttcgtattcattaattagccgataaaaatgtgcgacgaagaagttgctgctctcgtggtggacaatgggtccggaatgtgcaaggcgagtttttggatttgggaggattaaattaaaaaaacgtatagccgattcttctggaacgttttaaagaccatcgaatttcaaaattcgaaattaaaataattcttttttaatttacaattgataagagagaaaagggaggacagagaaaaagtaaaaggccaattcatattatcatatcagcagaattcctttgcttaacttttttttgcacattaaatttaccattttagcattttaattgtttaattttacgtttttttttgtctataaaaatgcttttttcacatttgaaaatggtttttgcatgggatttacgccagcttacaattagtcctttttttctgttcttctttttcctttccccctccattcccccgttgtctccccttttttccaattctctc

SEQ ID NO: 34597 - DNA, 1339 bp, Heterodera glycines
  misc_feature (1285)..(1285): n is a, c, g, or t
  misc_feature (1294)..(1294): n is a, c, g, or t
  misc_feature (1305)..(1305): n is a, c, g, or t
  misc_feature (1307)..(1307): n is a, c, g, or t
acgtgtttgccatgacgaaagtgtaccacctgctccattactctgtttggatgctgacctcaaaggtgaaatgaaactaataaatttcataattctatattaatgcttttggtgttagctcgctcttcgacttcgcaatgaactggaattatgaaaaatgtgtacgctgatgcactttcagtttggccccaccgttgttcagccaaatttgtgttcttcttgcaaagtaaaagcctaattttttcatatattttttgtatttttaagcgaagtgttggattttccgattacgtactgcattctcacttcaaagtgtgaagtgatatacacaaggatgcttcaactgattgtccaaagatggccgaatgttgcacctgaaaccatgtcgttggacttcgagctggcgatgccgccgatgcaaggattcttcgacttttacagggttaaaatgccatcaacaataacccggctcaccaaatgatcacaattaccatgccaatgtagatgtaatctcgataccatcaacaattttcttgttggtttttctcgaaattatgaaatacgcccttaatcatttttcaatattttgttactttttcgttggaattcattgataaatatgttttggtattaaatttccatttttcgaaaaaaatcacaatagaatccgtgtgggacaaaaacagcttgtcagactaaaacgaccccctgactaaaacggccagactaaaccatttttgaaaattaacgaaattcggatcctagaggaaccgattgatattaaatttatttttgtagtgcttacaattgtatatgtgtacccaaaaaagccattcataatgggcaccaaaatggattacgccaaagtggcggacccgaagtgggcggttcctgcaaactaactaaaagtctaagtttatagatattctgtaatttttttcctcgttttatttacatcacttttatttccttacaattttaatcaaattccaatcattatttttattttttatgcttaatttttaagtacgctttttcattattagagctcggaattatatggaaatccatatttttttcctggactgtgggaggcctgaaacgcacaaaaaacatgtttttagcttggtttgaagcttccaggatggagttctatatccatatattccatatttcgcgatttatgtccatgtttctatatttttgcatttaagtccatattttatttccatattttggcattttccaaaaaacctattagaacggccccatcagctaaattggncgttttggntctagagaccngnaaatttttcaaaaaaaatcattttttcgcaaa

SEQ ID NO: 34598 - DNA, 1262 bp, Heterodera glycines
  misc_feature (82)..(82): n is a, c, g, or t
  misc_feature (120)..(120): n is a, c, g, or t
  misc_feature (1208)..(1208): n is a, c, g, or t
aaaaacaagtcacatgaaagtctgatcttcagggggattaaaagtgattaaatgaaaacaaattacgttaattgttaaatgnaaacaattaatcatttgctttttattttttcgggtgtntaatataaagaataaattaattattttatttaagtaataaaattttcattatttattaaaaatagaccaaaaaatcgcgaataaattcattaaaaaaaaaagttttatcggtataataattttcctatgacattagttacaataaaaataaatcaaataaaattatatcaatgtgttgtgttatttagggtaaaaaaaacaattaccaaccaaaaaaaaaaacaaaatttcaaatatcaaaaatataaaggtattccataaattttatttgtttcataaacaacacaacagaaatcatcatcattttatcatctaaattatttgtcccaccaaagatactgtaaaaaaacccaagaaggatacagtagtaggaaaagttacgataggaaaatgttatgcaacaatttttttgtctcccatatttaatacaagtaaactgagtcaaatgcgccggttccaactgaaacgccgccctcattgctggatgccaacttggtacggaccaagtgaccaggctggtcaaagtatggcaccgtgccgtcaactctgttgccaagcataaagccatacacgcccaactccatgacaacatcatcgaaaacggcctcatcacggctgggccagactaagtagttctaaaatgaatttaaaaatgcttttgtatttcaaataattaaaaaatataattaattatatataattaataaatattttaataacataaataatactaaatccataattaaattcactaatttattttgaattgaaaaaataaaatatgaaaattaaacaattttccaaataaataggtgattttttttttactaatttgctatacaaaatccaaaaacaatttccgtttttcttttgctaaaaaaaaattttattataggtactcaaaaattcgaatcatttttgttattttacaaaataatttttgtgcgactaacaaacaaatttcgcttacaattagttgaattgaaatttgttataagcattttaggcaataataaatgaaaaattagccaatttaaaaattaaattaaaattatcatattttgaattacataaaatactctaataanagatgaattttttgaaaaaaaaacttataatcataaaataattactgatatttt

SEQ ID NO: 34599 - DNA, 216 bp, Heterodera glycines
agttcagcgctaccgttcactacatgagctgtacaggacaacaaattgacaggcttcctgtaccaataatatcctcattggcaagatgcccatgaggatattatccatacaaattttctaattttatttttgttcgagttcggatcaggggttcgaaattagcaaaaatgggtgctgtattcgtgatcagcgacctcaaaaaccccttaaaactta

SEQ ID NO: 34600 - DNA, 748 bp, Heterodera glycines
cccccgttgaatatcctatgaagccacaagattttctccttttgtatattttgtaggattatgttttataattttatttttagcatcacggtcataattttttaaaagtctccaattatctgcaacatgtccggatgtggaaaaggaggaaagggactgggaaagggcggcgcaaaacgccatcgtaaagtgagtacaaatagaataatttacaaaaaatagaaaataaaagcgggaaaatacatccctaagaaatgacccgaaaaatttcagaaatacaacgctgagacttgaaaaatttttctcaaaaattgatcgccaaaatttgatctttttgcttcataaaaattttcttattcgaaaaaatctataaattattttattaatcatttaaatgcccaaaagtgaattttttgattactttttacgtcttttcataaaacttaaatgcctttttttatgtcttcttagggatttttgtgccttttaatgccgttcttcaatttttggtgtctattatagtgttttttgcgatttttttggtgctttttcgagacccctaatacttatgataaataaattatgtaattaaatgtgaaatgatgttttcggttttgtttttctcagaataactgctacctattcctattttcaggggactcgttacaacatccaaggcatcaccaaaccggtcatccgccgattggcacgttgcggaggggtaaagcgcatccccggaatgaactac

SEQ ID NO: 34601 - DNA, 777 bp, Heterodera glycines
taacttatcaatgataagatgttaagtacctaatcagtgataataaactaataaattaattttttacagttaaattgttttttacatatttatttacttttaaaagcacttttgtttttcatttgtcaacacctttctgagtcccattagtcatgctcaacacggggttggtcattcccttgctgttatgaaacagaaataatttcatgtttagaaaatttctcggcaaaacttttgtcataacgggggcatcgcgtggcattggcaaggaaattgcacttaaattggccaaagacggcgcgaacatagtcatttgcgcgaagacaactcaggacaacccaaagttgccagggacaatttacagtgcagcggaggaaattgaaaaagtgccatttttttggggggggggattagcggaatgtttagtaattaaaccgtataatgggatgacactcaaaggtcgtgtatcgttttggcgccgacgttttggcgccagcccaagtttttgggttataactttttttgttgttaaccaaatccagcaagcttggtatcaatcgaaagcttaacatgtttagaagatatttctaagctattgcttcgcgattagacaattaccaaaaaagttataacatgaaattccaaaaaagtcgaaatttttgagtttttttcttaataacttttttagaagctaaaatttttgtgtttttttgtaagggtaatagagcttgagaagggctttcgaatgataccaagattgatagatttgggcaacaa

SEQ ID NO: 34602 - DNA, 1072 bp, Heterodera glycines
  misc_feature (978)..(978): n is a, c, g, or t
ttcgaatagcaatcgattgggctgactagactccatatttgcaggaatagcaatggcaggtctatcttaaaggcctgacgagttatgtttcgacaaacatcctgtacaccataaatcgattttcaaatttagtcgaactatataaatttttcaaaaaattattcatcttttttatggttagcgcatatgtctctagctttatagaaacggtccccgaatctgcgaggaactacttttttgagaatttctatagattattattctgcatgaatccttcgcttaaattcccatttatctcataaagtcagattaaattaattactccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggctaagtcttctttgcaagaagcagcacaacttttgtttgggccaacgaccccaaaccattcgaatagcaatcgattgggctgactagactcaatatttgcaggaatagcaatggcaggtctatcttaaaggcctgaagagttatgtttcgacaaacatcctgtacaccataaatcgattttcaaatttagtcgaactatataaatttttcaaaaaatgattcatcttttttatggttagcgcatatgtctctagctttatagaaacggtccccgaatctgcgaggaactacttttttgagaatttctatagattattattctgcatgaatccttcgcttaaattcccatttatcttataaagtcagattaaattaattactccgatttgttttagaattggtccaaatacgcttgctaatagcttttcttttcgaaaagagaggcgaggaaaaataaaggttgcatccaaatgtaattttttttttacattgaagcatttggatggcttgctngttacagttggctaagtcttctttgcaagaagtagcacaacttttgttggggccaacgacccccaaccattcgaatagccatcgattgggctga

SEQ ID NO: 34603 - DNA, 932 bp, Heterodera glycines
  misc_feature (814)..(814): n is a, c, g, or t
  misc_feature (906)..(907): n is a, c, g, or t
atcaaatggacggactttgctcggaatgacaatggtatcgtcggttagaaggcgctcttttgcatcgagaatctggaaacaaaattttgctagtgtggggtatttgaattttttagaatatttgagttttcccttctcaccgtttctgcaatttgctcgccaaaaatggcacaatcgaccgtctcagtgaccaaaatatcacagcgttccttcagttccagtctcttcgagtgacattcgtgcagttcgatgcgctcctttgcataccttccgttgattgaaaagcattttcttgccacggaacacatcgcttcgtccatttcacaggcaacgcagtgggggtcgaccatgctaattgagaaacgggtttcaatcatacttttcttgaagatgaattaaatcctccaaaatcattttttttaaattttaagtataaaagaaggttggccaggtaaggacgagggaattgataatgacgtttagatgataaggttcagtgggagggttgtgggttaggtgtcatattttgttgccacctgtacgccgccacaatgctaaaaattccggtgccgcagccaatgtccaatagacgtggtttccttccgctgtttttccgagtgtccaaagcgcgcaacatggcctgggatttgttggtgaaaactattattgttgtccctctaatccgttgtgttgttgcgattgtcaacccttctttcgtcccccgcctttaaatacctcggcaattcgcgtgttccgttgtctgtcgtttagcatccgccaatgccacgcgtcgaacagattggagcgcgcgttntctctgctgctgctcgcgtgaagccattccgtgtcatcacgagcgaattcatagcacggctgaataatcgacagagcgcaaaagtttacctnncagcaccattaattagttgataaaa

SEQ ID NO: 34604 - DNA, 1176 bp, Heterodera glycines
  misc_feature (23)..(23): n is a, c, g, or t
  misc_feature (1115)..(1115): n is a, c, g, or t
gaagttggacgtgcacatcagcnccatggcaaattgcgctgcatggacatcgcaacgtgcggacgcgagtgttattactgcgactggtgcaaagagagcaggtggaaaagtgggagcaaaaagataaatagaaattgccaagtgttaggcctcggcgggtgggaattgaaccaacgcctaaaccattccctcgtgaacatttttaccactgggctatttttgggggtttctacgggttttggctgcccattcttttgttcctctcaaaatggcactcattcatttgatggcattgaacagaaaattgaaattgctggagaacactgatggcaatttgtgccgcgcaacggacgaacggacgtacaaattgacgacgaaactttgcccaccgccggaggaccccaacttcacactgtgctcgacattcaccaaaagtgtgtggcaaaaggactattggcagaagcaaggcgcaattgacgtgtggatgaaggtgaagcggaagaagcaaaaagacggggaaaagcgggggaaatgcttcgaattgcttcaacattttgccaaaaaaaatttcagttttttgaacgggcgcccaaccgagcggagatggaaaaagagttcttctcgcagttggacaatcctttgctgggcaaagccttcaaattggccatcatcggcgaatggttggccgccaacagtttggacgtgcgtaaaatgggaaagttgcgtaaaatgccgcagttgtgctgcattttcagcagggaagttacacgccgaccaactcggaattgttggagttttgggtgtcgaagagagcgcctgaccgattgttggcctgcgagcacggcgtggtcgactacgaaattgagggctccaaagtgaaaacgaatgttttgttcgaagcggcaacgaccgcgggaaatgtaaaaggacaaaacgacggaagcaactgaacatttgacggtccctttcagttgccgaacattttcaaggacaaaaagtgtgccgcgttcgaaaagttgcaggaggaacggttcaagcaggaggtgcacgagttcaagcagcgcgggggcggcggaggcattttcggcggcattggcaacttattcagaagcggngggagatgaagccgagttgggggagtgatctgccgaaggggggggggactgatcgaatgat

SEQ ID NO: 34605 - DNA, 916 bp, Heterodera glycines
tgtcgggcagtattggacacgtgcagaaggccatggaactgctcaaggcactgaattttttcggtagcatttggaaattggagaaaaaaatatttaaaaatgcaattaaattgcaaacattttgaattctcagagattgaaaatgacctgactgatgctaacaatcgaattgtggacgctttttcaaaaatggagcagtcttttgatgacgcacaacgccaggaaatgcaaaaggacggatggacatttctgagacaattccaatacgaccaactttgtacagatcaatgtgatcacttttatttaaaccatccaatttttatatgtaatcttttcgaattttatttttcaccacttaaagatgctcaattgcccgaaggatttcgccattctatcgacgaattttcacaaatgccaaaagaaacgcgtgaagcaatgctatggaagcgaattgagcgcatttcgaggaatatccctgacgtaaataggccaattatggcaattattaaggaattaattggtggttatgctcaaaaaattgtgcaaatttatgaaggaaatcgctgataaattggaccgacggaagatggaaaagaacgaacgtttgtcgggccagcggcgacgaaaacgacggcaattggaacccatcggcggcatcagtgtgctcagcccaattatgttgcaaccgtttatgttttcgccgacattgacgtaacaaattaacacatttcattaatgaactattaattgataattaaaatattatttaatgaagaaattaaaaattattgagaaataatgccctatttgtcaatcccaaatgaattttcattattataaagcgtaacttttaatattttttgctaaactatgattgtgataactaactgtgcatcgaagaaaatattttttctgt

SEQ ID NO: 34606 - DNA, 739 bp, Heterodera glycines
ttaccccctccatcccacgttttgtgccttcgcacttattattttcagtttctgttttcccttttttcaaaatttacccccccccccgccccccccccccatcctcactcttctttcattgttgtctctctttttcatcattgtgcctggttgcactccatatttcatacacacttttgtcacgctcttgcccctcttcccgtcttccctcattcccatactcactcacctccctttgtcagccaccaccacccccagcagcagtacacacacaatatcgaatttttttttttactcagttttcgtcgccttcctttttccaatcttttgttcaaaggttttttttaaacacaaaagttccgccactatggcgttttatacacaaatttaaatttcaacagcagaccacccgcggctcttgatggggcgtcgttttggcgtcagcccgagtttttggactgtaacttgggtatctttagaaagctaaatatatttaagagttgttcaaatataatgcatggcttttagacaattacaacaacaaaaaaaaagttataatatgaaaatagtaaaaaaaaataaaaatttttgaaaaaaattttcttattaactttttatatgttagaaaatctttatatgcttttttcggcgaataaaggttgagaagaattaacgaatgatacatacaaaacctgtgggagttggttgacaataaaaaaaaagaattacaacccaaaaa

SEQ ID NO: 34607 - DNA, 1196 bp, Heterodera glycines
tgcaccatatcgtagtatgagttacggtagggagggcttgagttgtggtagcaatatgcccaatttggcgtgtgacttccaccgtagccattaactttcggaactacggtactcaacgaattaatttgaggacagcgttgaatctaaaaaataaaatgaataaaatttagttaattgtaaattttttttattaattttaattattatttcaccattgccaatgttcgtggtcgtgtttctatggaattgaagcgaattatacacggtgaacagaaacgacgtggtctatggccaacagcaaatgaatcgggaacattcatactttttgtaataattcttaattctttttaaattatcatttaattaaatgattcaaaatatttttattttaatattttggtgaaaaatttataaaaataaatataatattatttacatttttaaactcatatataattcttgctatttttggcactttttagttttataattataatattagtttaatattatttatttaaaaaaatgaattttagtgaaaattgcagctaatctttggttaatcgatgatttaaaagtgtgaatttgaccccggaacaaaagaacaaatcaacgaacaaaaaatgacaaacagctgacgagagaaaacttttaatgggttacttactcacatagcaaacacatgggaatttgaattttgatttttaaaattaggaaattaattcattcaatttttcattttttaagtttaattagtcattattgttcgaaagtgatcatgcatttaaaaaatattatttttaacataaaataggtaaaaagaaaaatcttttaaaaatagaaaaattatttttcgagtattgttggatttgagccgtatagggcagagcacaaaaaaattaaaatgtcctgatttttcaggatatgtaaagatgcaaaaataattaaaaaataattacttaagtgcaaaaaaaaataattgattattatataaaaaaaaaattacatttattcaaaaatatttcatgtaaaaaaaaaattcaaaaaaaaaaaatttaaaaaaatttactaataaaattattatttaaaaaaaatttataaatcgtaaaaatgcattttttatgtttaatttttcttatttttttcttttaatcgaatccggcaaaattcgacaaaattttgatgaaatatttggc

SEQ ID NO: 34608 - DNA, 724 bp, Heterodera glycines
  misc_feature (61)..(61): n is a, c, g, or t
ttgttgttctcccggcacaccaagcggcggcaacgttaagggagggcaatgagagtgccgngccatgccatgtcgtgcgcggggggatgatctcgctaacactcgaaaatccccggcaattaaattcggcaaaaaacgggcacgggccccccgaaatccgacaaatgcctggtttctaggcaaaatctcgtaaatccacggaacccgagtggtaatccgggaaaaaaccaggcatttgccccaaaccccaaatttaatagtgattcatgcaaaaatctcttgagttgtcgagcgcgaaatggaaattctcaattttttaggcttagttgcttggttgtaaaattttccatttttctctccttctcgtctctctctctctcttttttgtcattccatagttcccgaggtcattctcgatttagggagctcgtctgattattaattttctttcttccctggagactattaacaatgtctagaaccaccaaagagaataatttaattcaatcgagaatgcaatactttcacattgattcatcgaatatttctggaatctaatgcgtgaagccatcgggggaggggagaggaacgcgcgaacactctgatgaagattaagaaaataaaaaattttccttaaatttctcataaaaaataaattagggaaaaatcttttaaaaatcttaaatccaggtcctatgctaaaaaaatgatgtcttttcagctg

SEQ ID NO: 34609 - DNA, 881 bp, Heterodera glycines
acttaattgaaatattattaatttgtatatttcattatatttatgtaaatacaattagaaatcaattaatttgagagttcatttttataaggtaatagtatttttccttctttatggcattcttgtggaaaataataaatcataactttcttgaaatttaaaaaaacatgaatttttctaaaacaaaaatagaaattttatttactaaatatatttttattaagaacaataaatagggcttccttttttaggcaaatgcttaaaattttgcgcactttaaacgttcagataagcgcgaaaaatgcatttttcgcttggtttgggaggctacgatgatttttataatgcttatttttgcctcctccgggatttttatgcctaatgtgcctatttgcaggattttcaaaaaatccttaacaaatgtattgaaaacgaaaaacagaccgctaagaaatgacccaaaaaaatttcagaaatttcccctaaagaaacgaataaatttaatgtaaagggggggggggtgaatacatttcgacgtatttttggcaattaatttttaatttaataatttcagaaataaaattccgaaaaatctcgagttcataagtgggattaaataatgcttttgctcacttcagtggagcggtctgcgcgaagtttcaatttcactgcgccaacggaagtcggcgatggtcaacgcgtggcgacgcgtcgcttggctttgccgcgtactggtcataattgccgatttggtggagcgggcggaagaagcattcgcggcgattgatcgtctgttggaagctctgaaactgatcgcggttggcacaaatttgaagcaggagttctagcggttggacggaggcggagacacccaactgaac

SEQ ID NO: 34610 - DNA, 392 bp, Heterodera glycines
cccccccccccccccccgcacacccaaaaaaaaaaaaaaaaaaaaaaaagaaaagaaggtggtttttttttttttttttttttttttttttttttataaaaaaacaaaaagaaaaaaaatacatttcttttttcttcttcttttaataaaaaaaaaaaaaaaaaaaaaaaaaagaaaaaaaacaaaaactctcccccccctccccccccccctccccccgccccccggccggcgggggaggaggaaaaaaaaaaaaataaaatataaatatcccccccccccccccccccccccccctccccctccctccccccccccccacggaggcgaggaaaaaaaaaaaaaaaaaaaaaaaggagggggggggggggggggggggggggggggggggg

SEQ ID NO: 34611 - DNA, 984 bp, Heterodera glycines
gtttaggttcaaaaaagttatggccagaagaattcaaaaaacaaaattttccaacttttttggccataaatttgttcaaaattaacaaaattttttggaattttgcaggcaattagagcatctgaagagctctcgaatgatactaagattgttggatttggatgacaaagaaaaaagttatagtggaaaaacatgtgctggcgcccaaacgtgccggcgcccaactgaggtagaccggggaggaggaagaaacaagcagctgctgctgcttcacacattattcactttatctgtccgccgtccaccgccttcagcagttggtccgtgctgaattggcacccgtactgtgcatttgggcaccgcccaaagaacgcgtggccaaacgcgaagccgtcgtcctcaaatgtcaaatggtcacagcagtgagcagcaaactgatctgtgttggagaagcaacaagcattttcaaatttgacaattttttttttttggctggggtcagtcttggcggggtgtactaatttgtaagttagcctagcctcctctccgaaatcttttttatatttttaaaacttagaaattccaagaaaaatcttaaaaatttttctaagagaaatttcatgaaatttttttgaaacgtgattttttaaaaattttataagaaaattttttattataaattttattgggaagagttttctaaaaattttttctggaaaacaaatcattttggaaattttaaaaaatatgatccgccaatgggggcgggaggaaggaaacgggcttctcccactttggcacgaggattttttgtgtcaatttttttatgacgccacgccactttggcacggccgttttgcgctcacattataaaatggtttattggcgccattattcaaaaagggtcaaaagtcattgaatacacgtgccggtttcgattttcgggtatccgacccagataatggttttaattcattattttaa

SEQ ID NO: 34612 - DNA, 1069 bp, Heterodera glycines
taaatgagattttgattaagcttttttttgaatctcattgttaagattgaccttgatttgacaaagttacgaaatattatgggctgtcgtaaacatatgagcatgactgtatgaaaattatgttataattttttttataaattgttgcagtttattaaaattttgatttttaattatcggggtgaggcgggaacacttacccccaccccttgatacgggcctgatctatcgcatatttttgatgaatttgccattattttgtgtctcttcccatattatgctttaaatataaatttttcatgtcatttaattcgtgctgagacgaagtaagaaaaagtgcaagcgatcaaagtaaatcacaataattttaaattaaataaaataataataatatgtattttaaaaaaatatttgctaaaaactggaactttataaaataattatacaaacagaaaaagtaattaattcgttgtacctattaaaaatgtaacacagattgcaataatttttgatcgttcactgggctagaaggattaagctgtgcttcatttccgcttttcccttcactcatttgacgcgttcatttaaatgtttgcacacatccgcaaagatgttgtcaacagagccttcagcagcgatctgattggaaatcacttagggtacataatgtaaatatatattttctacattattttggattttagcactttttcctacatttttttgttttttgttttgaggattttttaatagaattttttattaaattcccccaaaaattcacgattattcgttaatattttcattttacatattttgagaatttttgaactttaatagaacttattaccccctaaaaaatcgatcttttcaaaaatgatcaaaaattaatttttaagatctaaaacgtattctaactatgcctatttaggtattcaatgccatatttcacgctttcctaagtccgggggagccgttaggcgcgttgggaaaatttttgagaattttaatgcaatttattaagaaattgcttaaaatttcaaaaaatctgccaaaaaattttactttt

SEQ ID NO: 34613 - DNA, 953 bp, Heterodera glycines
  misc_feature (869)..(869): n is a, c, g, or t
ggtcgtaaagaatggccgccgcttcggctgctgctctctccctaacccaaatttgtttagtgcccgaaataacactcgcgagccttacaatcaaatatcttaaataaatatcttttaaagaacatttatatctttacgacttcgttttttttgccattttgttgctcagagacacaaagaaaaaatatttaaaggcaaatttctgaaaatttgaaatatttttttatttagccagtaaataagcgtaaagaaggcgctggtcgtcatttgttactcaaaaattcataattggacaacggactcaaaaaaaatgagatatgtgagaaaaatacactttctcattttggcgtattgtattgtatcttttaacagagaaaaacaacatttactccgttctatgtatagccttttttccgccttactaattatcttttttttttccttttagaaatataaatggcggtgttcggctttcatttagtcttgacaatgattgcagcggtaatttttaacaaaacagcgcaatgccactttctctgtgatttgctgttctttaaagggttggctgtcaaattcgttcgtaaatattattattattttttgtttaagtcttggttatttcgtgctagaatcgtctgttttgtcagaattaaatgcctgtgaaagtgaaaacaaacgcagaaggaaaaaagagtaacggatattttttgaaattttcactcgtatttttagtgatttttcaggaaggatttccttcggattggtggcaatgatcgtttggttaaattgccgttgagttgcgatgctcttcagagagtccctttcttcgattctctcattttgatcgtcaattattcctttttcgcctnttttgtctttcttataagcgacgcgttttgccttctttttccggagagcaaaggttttgacattctttgtttgagaagcagttt

SEQ ID NO: 34614 - DNA, 930 bp, Heterodera glycines
ttcttcttcagttttttcttacagttctaaattctggtcattcataaaatttttcccactttaagggttcttgcgcttctctcagcgggaggatgaccgatcgttttacatttaattttttcttggtggatttttcgtaattttccttttttctccagcgattgtaaaattaccttattttttctttttcttgaccaccgttggtcatatatatgtttaatacctctttttaggaaaagtaaatcagcaattttaaaagtcttttctctcgcttttcgactaatcattttcctttttaaatttatcttgtcccttttctatttctttacgcactattttccaagctttcaatgcttttttctgaatgtaattttgtgtaaatggatatatatgactcataattttctgagttaggtaactttagcaatcggtctactggtaattttgggtgtcttaaatatattgtttaaaaatggtgaatgtttcaataaccgtatgtatggcgatgttataatcaaataatgcatgaatcagtaactgatcccaattgtttcccttttcatttagttgttgcccggctaagattttcatccgttgtagccttattgattttgatgttttcaagcggttataatccaaatgcaaaatattttcattttgtgtcatacttgagttttccttttaattaatttttacaatataaaaaataagtaaaatttaaaaagtaaatgaagtctagaattaatttaagaataattgattaaacaaaataatatttaatgaacatttcacttaaatgaaagaaacaatatataatcaagacgatgctaaaatgataataaaaaaattcgacgcattaatgaaaaaatatataaatagtggaaagaaacaattcacaaacagaatgaaaagatagaagaaatatataat

SEQ ID NO: 34615 - DNA, 480 bp, Heterodera glycines
agcgcccgtcctgtgccgagaagcggccgaatatcccccctaaaaattaaaaaacgggcgcgaagcgcctgtcatgaggccgcgaagcggccgaatatcccccaaaaaaattaaaaaacgggcgcgaagcgcccgtcatgaggccgcgaagcggccgaatgtccccaaaaaaattacaaaacgggtgcgaagcgcccgtccaagcccaacaaaatttagaaacgggcgcgaagcgcccgtctggccccacaaagtctaaaaacgggcgcgaagcgcccgtcctgaggcagcgaagcggtcgaatgtccattaaaaaaattaaaaaacgggcgcgaagccccgtcctgaggccgcgaagcgtccaaatttccctacaaagtttcaaaacgggcgcgaagcgcccgtcctgatgccgtgaagcggccgattgttctcaacaaaattaaaaaacgggcgcgaagcgcccgtactgaggccgcg

SEQ ID NO: 34616 - DNA, 840 bp, Heterodera glycines
  misc_feature (730)..(730): n is a, c, g, or t
tatagaggaagctattcccgaagggattcggtctccccataaatctcgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacganagactcagattttcgaaaatttttttgagccagctagctcggcgctcatttcagtgtaagttagtcctttaccggggagtatccctgcaaagtttggtacgcttctgctc

SEQ ID NO: 34617 - DNA, 991 bp, Heterodera glycines
  misc_feature (11)..(11): n is a, c, g, or t
  misc_feature (893)..(893): n is a, c, g, or t
  misc_feature (950)..(950): n is a, c, g, or t
tttaaattttntgatgagcaaaaaaatatataaattattagacaataaattgagtacatttggcgtataaggaacaaaattattacttgattagaagaagcaaattaactgaaaaattcaaaatcttttatcacaatgtcaatttcaccactttctggtgctaatgacactaatttgcttattaatgccgtgccagaaaatatgccacaatcaatgccacgaaattcatcgtcatcttttccagctgatgatattattgcgggcacagcgcttttatttgccgcctttttaggttaaaaattgctaaaactttttttgaaataaaataattaataggtcaattaacattgaattattgttaattaactaagaataaaaattattttagacaaatttattaaaatttataaaatatttctttattaaaaatatttaataaaataaattttaggcatttttcttcatgttactgaaatgttgaccatgtgcaaattggtgaaggatgtgatcggatttcgcttttttctctgcctttcatttgctgacctcaatatgttgttgttgttcggcatcattcctggttcggctactttgaaaaaaaaacaattaaaattctcctattttgataatgctctaaaattagagaaatactgggccaagaaattatttaatcaaaaaaaaaacaataatggaaaaataggaatttcatattacgtctcgactactattcacgaattaaatggcttaaaattaatttgatgtagattaatacacaaaatagagaccaaaaaagaatcaagaatatatgctgaattgtaaccacagagattggatttcacggtttacagaaagtataaaatccgacaattttcaattttttttctcattctttnttaacaataggtgccgccatttttgtgtcatttgtgctggtccccgttgacgcatgnaaatacagtatgcacatttgggcggatactgtgtggtttgc

SEQ ID NO: 34618 - DNA, 1101 bp, Heterodera glycines
  misc_feature (26)..(26): n is a, c, g, or t
  misc_feature (31)..(31): n is a, c, g, or t
tttttttcttgacaaaatttttgatntaaanaatgtcaatattgctaaagagaattttataaagaaaatgtagctcatttgcaactgcaaccagtgaataaaaattatttttgctcaatttttggcaaaaaattatgtcactattcgtcactatttcggactttttgtcactatttcttcactattttgggatttttactcactattttagttaactatttcggtatttttcgtcactaaaagttgcggccctagtgatctgcatggtttttttgatgaacttgagaaagcggccggttgagtcacaccagcctgttgctaccttggtagaattgaataatccaatttttataattttttctaagaccaagacggacaagtcatgatgttgctcagaacgagtagtatggaagtgatcagaagccgagctacgactataaataggcagacttattttaattgtgatgttgcatgcttgctatttaaatatagttgtataatatttgcttttttgcacatgaattataaaacgatattggattcggctaaactttgtatagtcaacccccagaaaaaatcgattggcacttgcaaatttaatgtttttcattttgttgcgaagtggataggttttttaaatcattaaaatgaacacggcgagtcaattttgggctccaagtacaattaagttggttttttcgtcttagtggtctgtgagttagtcaccaaaaggggggtcccaggttcaagtcctccctatgttgtgtgttaatttcaatttcttcttttaaagaagaaggcagaattattttttcattaataaaagttttcgtggcaataaaaaatcatattcaaaaagcgctggttacgtacaacatcgacaattttatgaaatttttttagcttataacttggtgaatactagagcaaataaaaccattttatgctcattttgaagggaaaattctggagaatattgtaaattttatttggtttggccttaaattgtggacttggctaaaaaagaattaaaattattgaaatgttcgtccctttcaaaaaaattttctagcttttaaaatttcttctaaattttgtata

SEQ ID NO: 34619 - DNA, 1159 bp, Heterodera glycines
aaattttgaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttcccaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactataaaaaattgaaaattttgaaatcatgtttcccactcccttctcccaggggtattattttgtaaagtctttttttccccaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttcccaataaactttttcaaaccccatttttcccaccgagaatggtattttttttggaatttggaaccgttttgagtaaaattaaaactaaaaaaaaattgaaaattttgaaatcatgtttccccctcccccctccccgggggattattttgaaaagcttttttttcccaataaactttttcaaaccccatttttcccaccggggaaggtattttttattgaattctggaaccgtttgggggaaaattaaaataaaaaaaaaattgaaaatttttgaaaatcatgtttccccctccccctc

SEQ ID NO: 34620 - DNA, 662 bp, Heterodera glycines
taaaagcctaataaattttaatgaatatggaattttaagaactcaatttggatattctttgttcaaattaaattaaaaaaaacttgtgaatgttttaaaaagacgaattgaataatttgtctaaaattattaaaattcaattatggttaactatccaacaataaattggttaattaataatcaaaaatgaacatttggcgttccgttcgccgcacgcaaaggtccgattccagcaggccacaattatccgaccgcaaatatcatttaaccattcatcatattttccttttttaattcataaatttttaggattcttaggttttcaacaatgaaaatgaaataattggcaaaaaaaacaaattatttatatgttgcttttgtcatttttcgtccctatttaggcccctttttatgaattctttgtcggtaaaaatttgcaccctaataattattaatttgcctttcgttaaatcatgcagttttcattgttgttcaagattataaaaactgacataagtcttgaatttattaggtcctgtgaataactgttttttgaaatatttttttttgtttatttttgaatttcataattgattaaacacggattaactacctctcttactctcctaaaaacggggagttcgagcacatgctgtcagggg

SEQ ID NO: 34621 - DNA, 938 bp, Heterodera glycines
attattaggcgctagaaaaattccagattatactaatattccaaatagtgtaaccccacccgtgattcgtattcagcaagttcacccattaaggatgtcggcgccggaattggtcgttactatgccgtcaattttccattgagagacggaattgacgatgaaacttacgagcgcatttttgcgcctgtcatggagaaaatcattggcgcctatcagccttcggtcattgtgcttcaatgcggtgcggactcactgacaggcgatcgtttgggctgttttaacctcacattgaaaggtattcgacagtaaaatccctgaattgctttttgctttaggacatggaaaatgtgtggagtacatgaagaaatttgacctgcctgtgttaatgctcggcggtggcggttacaccattagaaatgtcgcgcggtgttggacctacgaaactgcggttgcattggatactgaaatttcaaatggtaaattttccgtttggtaatttgagcattttctcatttatagaattgccttacaacgattactttgagtattatggacccgactttaaattgcatatcaatccgtccaatatgcccaatcacaacaatttggaatacttggataaagtgaagtgagttactatctgtaaacttacgttttaaagcatttattgtcccaagggaaagaatattcgaatcattgcgccaaattccgcatgcccccggtgttcagatgcattgtctgtttttgaacacttcgtttgaatctgattttgatttcagcacctgagcccgatgcaatggttatggatgaagaggcgcaattggacgaggctaatcccgacgaacgtatcccgggtaaaaaagaaaaatgatttattttaattattttttaagaggcgctaagtgacaaattggtggagcatgttagtgaacagtacg

SEQ ID NO: 34622 - DNA, 925 bp, Heterodera glycines
gggggggtctttttggtttgcagacttttctttgtgattttccgggggttttcggggtccctgatcacgaatctcgttctttacccgtcggcattccctccgaatggttcattttgctcaaatggcccatcaaatacagctgaaacggagacatcggctgactttgggtggagattgtgaccgcaatttgcagaaagtggaaaagtgccaacgaatactccgtgaaacagaatgcctctgccattcccacgtcgaatttctcggcacgtaattcgtccatcagttcaaagtcatcggcaatttctaattagggagttcaaaaaagtatatttgaattatttttgtcacaataaaattattgataggaaaagcaccaaaaagccccatggattgaacgggcgtaagaaaggcggctaacactttccatgctttgtttatctaaactttcccgccaggaaagagaaaatttttagatagttttttctaatttttaaaaaaaagttgagaagaagctactgctcatttaaatccttagagcgctgtcttttttttgcattaatttaccatggtaaattctgtcattcattttgcttaagtctccctccatgataagctcgtgcaacggtttcgtctttttctgcacaaaataccgcacattcagttggacttcatcatttttgttggttaatttataagttgcatctgttattgggaccacatatgctaaaagtgcgttttaatttttttattcgtaaaatttggaattttggcgaaattaacctaaaatgtaaattaaaaccctaattaattacatttggtggccttcttctgccaaaatttggccaagttaaacccaaatcaaaatgacttcgaaggaaatggaattttgttggacgattaaattttcaaagggtttcccatttcc

SEQ ID NO: 34623 - DNA, 596 bp, Heterodera glycines
atatttttgaatcattaattgcttttccatataaaaatctattagggttttgcttacttcctttatgtagaatttttaacgtgatcgttttattaaatcacattagggttaagccacgaccccgagctccccgatacccgacattaattcggagaattggggactccgagcgttataaaattaaaaagttaattcaacaacgaaggggggaaaggttgaaatttttgaatttttgaacaattttcgcccagtcaagaataaaagaaatttttgttcgttgattttatctaaaaaaatgattatcaataaagaatgtaaaaatgacaattttattaaaaattgactgaaaaacgatttaaaaatttaccaaaattgcttgctacgttatcgcacataaaagtctatcttactgaaaaaagtaaaaattacgataattttatgaaaatttcataaaacaattaatgattaaagactagttctatggataaatattataattgactaaataggatcaaaagacatagttttcaaaaattaaaataacatactaataatactggtttactaacaaaggaaggtccccaggtgtccgtggg

SEQ ID NO: 34624 - DNA, 925 bp, Heterodera glycines
gccatgatttggctgtcaactatgacaacacggtgcgcacctccaccaacgaggtggtccagttcacgtttggcgacgacggcctcgacccggcgtacatggaggcgaaggatggccgcccgttggacttccaacccatgttggctcaagtgcggaacatcaccagcaacagcacctggtgggcggagatgggatgatgtactgcgcgggggcctcgtccccctcccggaaaaaaatatttaaaaaattactaaattagaaatttttcaatagaaaaattagaaagtttttcttataacaaatctatgaaaaaaatgttcataaaatttatggtgaattactaagatttttcaaaaactacaaaaatcgctgaaaattttacaaaatttttttttcatggaattttcttttaaaaaacttcgttttgtttttttttgtaaatttctaagttagtaaatttaaaaaattttttaaaacagttcataaaaacacaatcaaacatatttgtttagtgagaaaaagcaaacttggtgtcatatcggcaccgctggttcctctcatacgtgtacaaggggtggtcacttccaagggtcatacggtgtacgatcgggccaggggggtggtcatatgcaggggcgtatctagaaacatttttcggggggggggggtcccgacctgaagacctttttttttttgctgtttaaccaataactttttttccactgctgggtaacaactgcacttttttcctaaaaatgacccatttttggccgttttaaggcaaaaaacttgtaaaaatagtggaaaatggaggtccggcgggcgcccaagggccccgccgggaaaaaattttggaaatttgagggccaatttgttacgaaaattgccccattaaattttttttaattttcgtttgggggggggg

SEQ ID NO: 34625 - DNA, 1026 bp, Heterodera glycines
tgtggtgcaaattttggaactgtcccgcctcacggcgcgggcttaaaagcatttgtagcgcaataaaaaagtttattgttttgaatttttcacaatttatttaaaaaagccaaaaaatccggatccaattttaaaaacgaaaatagtgcacaaaaaggagccgcctcaccgtggggcttaaaagcattgtacatcataattaaaagcgaaaataattttcgtatattttttcacaatttatttcaaaagacaacaaaaaattgataaaatgttgaaacgaaatagtgcacaaaaagggagggatggttagacgaaaagattttaggatgggacgcaccccatctgatattcccatttttctgtttcacaactggccaacggtgactgtgctcattggcacgtagttgtccaattaaggtacttggactttccacagtaaaatgtggtgcaaattttggaactgtcccgcctcacggcggggcttaaaagcatttgtagcgcaataaaaaagtttattgttttgaatttttcacaatttatttaaaaaagccaaaaaatccggatccaattttaaaaacgaaaatagtgcacaaaaaggagccgcctcaccgtggggcttaaaagcattgtacatcataattaaaagcgaaaataattttcgtatattttttcacaatttatttcaaaagacaacaaaaaattgataaaatgttgaaacgaaatagtgcacaaaaagggagggatggttagacgaaaagattttaggatgggacgcaccccatctgatattcccatttttctgtttcacaactggccaacggtgactgtgctcattggcacgtagttgtccaattaaggtacttggactttccacagtaaaatgtggtgcaaattttggaactgtcccgcctcacggcggggcttaaaagcatttgtagcgcaataaaagttttttgttttgaatttttcacaatttatttaaaaaagccaaaaatccggatccattttaaaaacgaaatagtgcac

SEQ ID NO: 34626 - DNA, 1126 bp, Heterodera glycines
ttattgtccgatttgccctttcacgactccggcgtgcagatcaggactatacattacatttttgatgatgaatttttcctcaaaatattttttcatttttcctgcttggaattcaagcccactgtcactatatattttcatcgggataattttagacttttcgaacacccgatcaaaagcctcgatcatgtcctcactcttctttgacttggccggtgcactgaagatcattcgactcagcacgtcgatgcagaccaataaatatttataaccgtcgttatgctttttcagctgatcaaaaatgcataaatcacactgccaatcggtgtggaagccactcggtattgtcttcagtctcgggaatcttttccttatgggcttgtgaatcgtgtatgttctctgtttttctaggaatttatttacgtcatcggtcgtaattttcgggtcaatctttttcgcctcaattaaaattttttgaatcccagcgaaacttgccggagattttaaattataataaattttcgataaaattttctctacagtcttgcccatattagtggtttgaagggtttcttctctcgcactatgccgggtgtttttatagattttattgcctttttccttccacgtccccacatgacctttgatttatcaaccatgtcttttactgttggatccttcagtaaccgatctttgagaaattttgcaccgcgcggcgtttcatctttcttccctgcgagatacaacaaaacatctctataattactgttttcaatcggcaaattcatgttcgactgtacctttccggccgccgtaattttaaataaatctttgttttccttcacgtacctaaaaagaccgtttaaaagggtcgggtgtataatagttttgatcggaatgggtgttttgagtgtggatgttgtttggggctccggagttaactcatttattgtatcattatccgattccggatcaggagttttctcttcaagtcttttcccaggaataattattttccggggttcatcggtctcctgtagtttggattggttattgaggcccagatatggtgcaacatttggacctggtacatgattctcaatcaccaccttctgtggtctatttt

SEQ ID NO: 34627 - DNA, 858 bp, Heterodera glycines
gccgttccttttcagtgccatcatttccctcgttagtctttcgttgttcgcccgcaattcagcgatttctttggtcaatccgaggatgctttcagaaggaattatcaccacctttatcccccttcttcaccacatttttgcgagaaaaatcgtttcaattttgctcatttttttcgcccccaatcgctcgccattcgccgcgaacggaagcacattccgaagttcgtccaatgagtcgttcatatcttggagatcaagtgatcagacaaacgcttttatcaagcctgatcagttatcacctttcccccccccctttctctctctctctctctttctctctctctcttcactctctctccctttctctctctcctttttttctgttttctcttaccatgcattctcttccgctctctgctgttgatgtgcaatctcagaatgttctgttccttaatttccattttccttcattctctcttccctctcccacttcttcgttcaaatgttccgttctttttcgacttcgttctgacgatgatcctgaacagcgtctcttgcgcacatacggctcaatcttttcggctgccaattgggcaatgtttctctaaatttcacagtttttttgttgataaaatgcaaaataagtcgagatcaatcattctcgactctccctctgtccgtcctttatccctttttaccttcccagccgatcctccgctattattcgccgcttcgtctctttctctgttcgccgtttccccttgtgcgcaaatagtcgtcaggcgttgctttacgtctgccatgaaatgttagggaattttgtgtaaatattttttgccaaatcggctaatatgaaac

SEQ ID NO: 34628 - DNA, 883 bp, Heterodera glycines
  misc_feature (5)..(5): n is a, c, g, or t
cctanttgggtataaacgtatcatatactttcagaactttatttaaaaattctttatacttttgttcaacggtgtacactgagtttattgataaatcatttcgattttcaagtaccgctacatttaattttgcaaaattaatatttttaaaatctcttctataaattttaggatttttatgactgaatttttcttttattttaaatccgaccattttgtgatcggaagttgaaaaattttctagtactgttaattcattaattaattctaagtcactagtaattactagatctaaaatcgccttttctttaatgtttaaacaaaattgaattaaaattaattaattccaagaattttcaaaaatttatttattttataaagctaaacatatagaccagaaccaatccaaaatcattaatctattaaattcatctctgccgatttcattatgaagttgcatacaataagcgcagagttgtagtttatcgtttctgcgttgtaataatcttttttgatgcatcattttagtttttttttaagagtttttttttataattcattttgtcctattataccatatttttattcttgcgcttgtccgtgtattctttttgcaatgtatttccaaatcgagctacatatttttgtcaactttatttaattatcatctgaaacgtcaattaattattttattgtttatattgagttaattaaagttgcattattttccctaattattcgagtctctgatggttgaaaatgattgtataatctattttgtaaatatttttattatatttttttatacgaaaaccatttattgttatttacatcgtaaaattaatttatttaaattttgtctatacaatatattgtattttag

SEQ ID NO: 34629 - DNA, 933 bp, Heterodera glycines
  misc_feature (871)..(871): n is a, c, g, or t
aaaaacaaaaaatgacaatcctaaaaaaatcatagatttctttcagggtgaccaagattcttgattagcgcctaaaacttccccagaaaagtgctttccttcgttgggattatgatattttaaggatgcaaaactaaaagtgccttctatggctttgttctgcccttgttgttttgccttcttcagcttgtccgtgatgatgccctgctctgtccgaatctgatcagtctcgactccctcgagtatttggtcggttatttggtcatccgttcctcgtttcacttctctccccctttttttttggtgctaacactttcggtcgcttttccggtgccggagggctttctctccgatcccgactcaattgttgcggaggatttggagctgttcaccggcttttcgcaagtgctttcattcattttttgtactgggccatcatttggttgcccaaattgtcctcttttacgactgatcgttccgtctgagactttcttttaggccagcgttctctttctccgcaaggtctcatttctgtcaaacgtttattttatttggcactaattgccacaactcgcttaaatgctccccccccccctaattaaagggctgttcctctgaccatcgttcgtacattttccaatttgccattctccgccactccgttaatccgccgtttaatgacactgatttgcgcctaatttatccacgaatgttcaaaagcaaaaggttctttatgcgccaagaggggctcataatagcgcgtgttaaacaggtgaacgaacgaagtgaggagaaaacgggggaaaaaaccgccaattacgaagaatccgataccgtgagaaaagttaaaaaatgaaaaatgagacaccgnaaaataggacactaatatgcttttataatagggttgggaattaatcactaaaatcttcaaaa

SEQ ID NO: 34630 - DNA, 251 bp, Heterodera glycines
ttcaatccctctacagaaattagattattttcaattttttttgtatactggtgggtttcctatagagaaaatatgattactcatagtttttttaaaattgatacatattttatcatttttaaatgaaaatcctaccaattgagcttaataatcgcaaaaaccaacctttttttgttgaaaatctgctaacaaattgcacccaaatttttaaaatttcccccggcggcgcctatcggtaccgccggacccct

SEQ ID NO: 34631 - DNA, 562 bp, Heterodera glycines
  misc_feature (87)..(87): n is a, c, g, or t
  misc_feature (97)..(97): n is a, c, g, or t
  misc_feature (103)..(104): n is a, c, g, or t
aacgagagagggtgggagctgggagagagagagagacttctgagagataaagagaggaagagagagaggaggagagccttagaaaanaagagaggangggagnngggagagagaggggggggggagagagagagaaaccgagagagggtgggagctgggagagagagagagagagaaagaaaaataaagagaggagagagagaggaaaataagagaggatgggagctgggagagagaggggggggggagagagagagagacaggaaagaaagaaagagagagagaaaagaagagaggaagggagatgggagagagaggggagggagagggaaagagaggggaaagaaaaaaaacaatgtggcagaatttgtagggaggggggttgaagaattgagatgaaggaggttgcgtgatgggagaaaagagaatattgtttttgactaatttttaaattgatttcattaatataggaaattttctgaggagacgccttggctatcctatgtacagtactatacgattaataatgtgcctggatggattccgtgtccgaatttggtcg

SEQ ID NO: 34632 - DNA, 737 bp, Heterodera glycines
caacaataaattagataaattttcggaaaatcccacttaaaattattatgtcagattcataaaggcaatgaaagatgaagaggaatatcaaaacaatcgtgttcggcctttcgaaattgatcagacaaggggcattgccgatcgaccacgtcttaaaaaatacatcgaaaatgactcagctattaggcaattggtaattgcttatgacgcgaaagaagaaaaaaatgacgatgatttgatccgacatattcatgcattgcaataccgtgtggggatgaagggattcgaaggatgggattagaatattgttgaaaatattaattttgttgcgttgttaaaaattagtatatgtttgtttcgcttatgtcaaaataggggggggggcggcgcaagtgtctgcggcgcaactgtcgcggcgcaagtctcggcggcgcaaatgtcacatcaccagaaaaactgactaattttgtccccttattccgtttacaatgggcatgttcattgccagaaacgcgatcagagggaatcaagcaaagggtgcggcacgtggggatggggaaagagtggaagagaagggatggatggtgaagtgacaaaaaactaatattgcaacattgcggccagggctgccatgtcaaaaactgcatttaccacatgtgcctgcctgttctggcctcctcccctgcccacctcacactcacaatcaattggacaccgcagtttgccccgttcgtcgg

SEQ ID NO: 34633 - DNA, 971 bp, Heterodera glycines
ataatctgtttttgaattaaatttgaggaatgttgtgagtgacttcagttttctttaacaaaataaaaagtgtgcatatttaaagtacaataatattaaacatatcataacaaaataattaaattaaaattattttatgtaaaatttgtaaaaacttaaaaaaattcgccaaaaagataagcatatgcaattatattgcaaatagatactataatgaattaaattaaaaagctaaaaagaaaagacaaaataaatcataaaaaatattttgaaaaccatctatttgttgataccaaaaatgataatatatgtccagtttattgaaggatataacaataaatcgaacctaatacatataaaaatggtcgtatctattattgtataatcatattattttaataaattatgtacaacttttaaattaatattttaaagatttattaatcaatattgaaaaaaagtaaattccttataaaaaatttgcttcaatttgaaattacgaagcagaattgaatgaattgttgcacgaaggacatgtggacaagtgtaacttaacaaaatcctgcttcgaacattgaaaatgaatatgaatctacttgaaaatcatgtatgaaataaatgtaatttttaaatatagtttttttaataaataaaatttataaaaccttttaaattttataattaacgacatgataattatatatattatgctgataacaaagtatttataaaacatgttcagttgtttgaatatattcataaaaatgtaaataaattagtatgtacaagatcaataaatacaagacaaatagcatttactgtgcatgatgactagggctaatatttttaggcaaaagcctattttttctgagctcccagtgggcaaaaacgctcaaaaaacatgtttttgtaattttatacccttaaaatgaaagatttttagtgcctattttacattttttgtgtccttt

SEQ ID NO: 34634 - DNA, 1224 bp, Heterodera glycines
  misc_feature (173)..(173): n is a, c, g, or t
  misc_feature (204)..(204): n is a, c, g, or t
  misc_feature (240)..(240): n is a, c, g, or t
  misc_feature (277)..(277): n is a, c, g, or t
  misc_feature (295)..(295): n is a, c, g, or t
agctttatagaaacggtccccgaatctgcgaggaactacttttttgagatttctatagattatatttgccatgaatccttcgctaaatttcccatttatcttataaagtcagattaattaattaccccgatttgtttagaatggtccaaacacgcttgctaatagatttcttntcgaaaagagaggcgaggaaaaataaggttngcatccaaatgtaatttttttacactgaagcattgngatggcttgctgttaccagttggctaagtcttattgncaagaagcagcagaactnttgtttgggccaatgaccccaaaccattcgaatagcaatcgattgggctgactagactgcatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtccccgaatctgcgaggaactactttttagagaatttctatagattattattttgcatgaatccttcgcttaaattcccatttatcttataaagtcagattaaattaattaccccgatttgttttagaattggtccaaacacgcttgctaatagcttttcttttcgaaaagagaggcgaggaaaaataaaggttgcatccaaatgtaaatttttttacattgaagcatttggatggcttgctgtttacagttggctcagtcttatttgcaagaagcagcacaacttttgtttgggccaatgaccccaaaccattcgaatagcaatcgattgggctgactagactccatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtcaccgaatctgcgaggaactactttttagagaatttctatcgattattattttgcatgaatccttccccttaaattcccatttatcttataaagccagattaaattaattaccccgatttgttttaaaattggcccaacacccttgctattagcttttcttttcgaaaag

SEQ ID NO: 34635 - DNA, 1775 bp, Heterodera glycines
  misc_feature (924)..(924): n is a, c, g, or t
tcttatttaacattatgtatttgttttattttcttaccgatgtcattgttccccctcctctccccttttgaaatccgaattattatttgggtacaaagagcacttttttactttccttttccccttctccttttgctcttttgctctgtgaggtgttttcttccctcctccctctctcctccactccttcatttattatttgattttgttcttctattttgtcatcccttgtgaacataatcatttggttttagaggatctcaaaacttttttattccaataagttattttacaataaatattttcgccgccattatcaattttaataattttgaagagggaattagcaaaattgtacattatagtgcaatcgggctcaaaaacttggttgctacccctaattcagaacatttcttaaaaaaggacagatcgcgaccctggtattaatagaaatcgaattcaacagttctttattatgtgaaccataacactaagggaccacaattattattattatctcaatccgaaataacaaacatcattcgcttcctcactttttgtcatcttctttcataatttcggttgttttgtttttgtctccataatcaactgatcacttctttttatcagtttattcttcacacaaaacaatgggagaatgtgtgtgtaagtcttcttcttctcgaaacgcatcaaaaatcaattgatttcatttccttttcgtatttttctttcgctttttcccctcccaaattttctcttaaatatattcaatcactttttgctaatttttattgactctttttgcaattacaaactcataaaaatttaaacgatcataaataaaaagttgaagggacaatttcaatgtttcataatgtttttatcctagcactattaaacaaagggctaaaacaaatcacncactttttatgggtcgtggtcattttattagatatgtatcacctataaattctatgtacttttagaaacatactaatttatttgttttttctttttatttcattaatcctatggaccggaacagcacaaaatacaaagacgccgttgtggccaccggggcactcggaattggagttgcaattgcgactacccaatttggacttttggtcggttctgcagcgaccaatttgctgttggactgtctgatttcgacaaaaaacgccggcaaagatgcgatcaatcgtggcctttccgtggaacagtccatcgagaaacgcatttatgccgccatcgaggcaactcaagaaatagccaaggtttgcattggctcttcccacatttgtcaaacggttttcaaatatttccttcaatttttcccacttccaattagaacccttctgagaagttgactgcccatgcgaattccttccttgacattgcgaattcgctcagcgaaagcattttgggactgccgcgtgctgtggaggaccccgagtgggggctgaaggagcgcgtcacgtttctcgcgtcgcgtatcggtcaccgaatcagctcaaagaccaacgaacgcatcgtggaaccgctgctgcagcagatgtgtgtcctcacagagcagttgtcgaagtgcattgtcctcgtaagttgttggatttgttttattggacaatttttttctaattgggttaaaaattggctaaactttcctgccttttcaggtggactacgccaagcagcgccaggaatggacgttcaacaaagtgagccaattgtcgacatcggtcgttgagttgcgcaacaaaatcgaaacggag

SEQ ID NO: 34636 - DNA, 436 bp, Heterodera glycines
gtttgtcccctaaaacatcaaacctgtcgatatcagtgccatttttaggccgagatgggcccgatcaaaaaatgggaacatgtccatccaaacaccagtgcaaatccaactgaaatacggggaaaaattccaatgccatttcgatttgggattaggccaaagacaaatggaaagccaaggatgcccagcgaattttcaatgtttttgctcgtgaaaattggccaatttttgcgacaaacattcactgtctgttctttttgtttggttttcatctgaaaaatttgcgtcgccgcacttcgcccacaattctcactaaatacggtttcaagactctcgaatgtatgaatttttgggtgaacgaaggtattggtagaataattaaacaaaagttttaaattattccgctggggccatgccgtggaagaaatatgaaaaa

SEQ ID NO: 34637 - DNA, 1427 bp, Heterodera glycines
atcatttcgtgattagcgcctcaaaactgccctaagaaatgtttttgattattgtgaccattgcctttttatttggaaaagatccgtgtactgtttcattttttgtctaatttaagtttgtcgtggagctgctcaacttctgttcgacgtcaccaccgctgtgattccgttgctcatttcttgctacggaaaagtgaaagggtccgccgaattcgacgttttcggagaggtcactcgcattctgacaatgagaatcgcatcattcattcatcccttttcaaatatttgtgcagaagtgcgtttttgtgctgagcactcttcgcattttgtcactttctccgcccacggccattttactcaaagacgagctgaagcatatccccgaacatcagctgaacgagaaattggagcagttcaacgtgtccgggatgaccaaggcacgggtgagcgaactgttggaacggcgatgcgatttggtgccacttgaaaaactcatttcatgaaaaccattgagtaaaataaacgggtgttgggcatggcatggacggcatctttctttctctgtttgttcatttttcatatgccaatccccgcttttcttgggtatttgaactttagcgaatgttcttttttgtatttgttattatttactcatcacagtcaaatgatttgaacataaaatttttaattttttctgttttccgatcattttccgattttcaacgtatttttgccattaaatttcgttggcaatgcattcatctgcgctttgctgaatggcatttcatatttttgattcattataatgaaaagctgaccgtcgccttttgaaatttgccgtttttgctcggaatgccttcgccacttttataccaataatttaattcgttgcttttcacctccaataccaaatattggcaattcctcaaaatgtacaagtaagaaagaaagtgaccgagaccgacaatgaacatcggtcctccctactcttaattatgccaaattagcccacttagcactcaaacaagtggccattgtcgtatttaaatagggcggcaaatgttcgttgggtttgttcagccgacgttcagccaatgttttggccgttccctcggcgccgcaggaaagcaacagatcgattttgtaacggttcagaatctcgaagaagcggtcgttgtccttcagagacagcacttccgtccgtctctcattgaccagcgacggatgggtcaaataaacgacgacccacggccgctgcgggcgccgatgcaattccttgggggtgggaggatgttaatgagtcaatcattggagcagtgggggggggggggggattaacaaattcatttgggctgacaatcatccatcttttttgggagtttcgttgccattccgttcatctttcttctgagggggggggggggggg

SEQ ID NO: 34638 - DNA, 947 bp, Heterodera glycines
ggtggctctaaatttggttggtttcaaacatttcacattagaggaacacggaaaaaaggtgcatctcagaaatgcatcaaaaatttcaaaaaaaaaaaatcgcagaaaatttttctttttttttgcttgaaatttccctattaaaaaatttcgggcggcgagattttgtccaatccccgcggaaataaatgcgaaatttcgatattggcaggaaattaggggattatttgtaattggttttcacttgccggtgaataaaagggatttggccggtgcaaaagcatcgccgccttgcccagcttcatcattgccaccttcaccgtcatcaaattcggtgaccgctgtgtttgtcagcgtcagctccgtttggaacgcggcggcaattggaagacggcgtgacgaaaagcactcagcaccagacattggatcctaaaaatgctttaaacttttaacactaatggcttcaaaaaacagaaaagggcgtcttattgttagttggacgacactcaacttgtttatgactcaattcattttttaattccaacaattttttatttatttttggttgaaattgaaccgtgaaaatctaggccaactcgacagaattttagagactttttaatctattccaatttagaaatgcttttcaagtggtttatctatcacattcgcgatcagcgcccctaaaaagagccggataaatgatatgtcttaaacatttaacccaaatgactttgcaatcaaatcacaaagccggacgacattcaactcgtttttcgctaactcttttttgctggcaagggaacctcgcgaactgtaactcggaaaatgagtataaatttggtaccattcgatagagcagggtcgacttctatttgtgatttttaattttacgtgcctatagcgaaaataaaaaagttatgaggcctcaaaaacctaattttccc

SEQ ID NO: 34639 - DNA, 1043 bp, Heterodera glycines
  misc_feature (9)..(9): n is a, c, g, or t
  misc_feature (974)..(974): n is a, c, g, or t
  misc_feature (982)..(985): n is a, c, g, or t
  misc_feature (990)..(990): n is a, c, g, or t
aataaatantaggaataaatcaaaatcttttttgattttactgagtaaaatgaaaatcaatttattaattaaaagttctaactaacaaaagtataataaagtcccaatttattttttaaacgtaatattatttaattgttcttccccctcacttttcgatcctcgctctctctctgtctcttctctctctctctctccctccctcccacctcctcgctcgtctctctctctctcccgcacctccttctctctcctctctctcccactgctaccttgtttttaatcaatataaaggacgcggcgtcattgttccattgccactgttctccatccaattgctcaaggttcttctcccaatgaccactatcattcattcattattttttgcacatagcaaaggtgcattttccatttttagttcctaaataaaaaaagaatattatattgtttctgtcggattaaaataattcaaaatcaaattttttaccaaatgaaaaatgaataaaaagttatttacgggcgtgctaggcgccgccggcaaaacttgaaaatttgagtaatttgttaaccgattttcaccaaaaaagacaaatttactattttgagccttttttatcaaaaaatagtttaggggccccagtggtaaaccgataattgctgccggggaattacattataaaaaataatctattataacgtacctacaaaaaatggatttcgaaaaacaagaaacgacgacggccgagaaatcgccttgacgtggaaatctattttatcatacccacactcatacttaggaagatgaagacatgaccgaacgagtggagcttggttggattaaaaaaaagttgtttatgaaaaattattacagcttaaataaataaacattataattgatcaaattatatatgatcacaaaataaaatattttaaaactttcgattagaaattatcaaaaaagaaataaaaagcanaaacctannnnaaaanataaaaagagcaacctcttagtttaaaactgaatttattttatttttaaataa

SEQ ID NO: 34640 - DNA, 975 bp, Heterodera glycines
  misc_feature (91)..(91): n is a, c, g, or t
  misc_feature (124)..(125): n is a, c, g, or t
  misc_feature (137)..(138): n is a, c, g, or t
  misc_feature (144)..(144): n is a, c, g, or t
  misc_feature (149)..(149): n is a, c, g, or t
  misc_feature (186)..(186): n is a, c, g, or t
aaaaatcaacttgtagtgactatataatgtttactattgaaaggcccgcataaaccaaaggaatcaaaaaaaatccttataaaggcaaaanaaaacaacgaaagaaaaacgaaaggagaaaaannaaaaaaaacaanncaatgncaacnacaacaaaagaaacaatacaagaaacacatagaaacncataaatcttaaaaaggaaaaaaataataaattaattgtttttgtttctgcacttcaagttttaagtgaaattgtaaacaattttaaaaaatgacattaaaatgtattaacagcagaattcgatataaaatcttcaaaaaacaaattattattattatttgaaaaaattgaatgaatatttatgtctttaaaaaatatcatgtagcagataaaattgatccagcgtcactctccagaaccaaaagactactcgagttatcatcaattttacacaaaaagagattttgttaataaaaaaccctatgataagttcatcaaacaaaaaataaaacaaaaaaaatatatatcagtattatgaaaaattattacgagataaacaaagcaaaaatgaaaaccattagaaaagaaatagacagcttgttatttcaatgaaaaaataatttaaaagaacgagaaataaaaattcattagcataatataattagaatcggtgtattaaaataaataaaagcatctatttaaaacagagttcccaagtgtgcttatttctaaaaatttgtgcttatttcagcattacgtgattatttagtgcttatttttgggttttgaaaataaaaatgaaaatttgaatgacttttgacttacattttttattttttttaaacgaatatttgacataattcgattttgaaaattgcttttttgttttattttcttgagtataaatgacaaaaaatttcagccgggctcacaaaacttattttcataaaaagatgcctcaaaaatttg

SEQ ID NO: 34641 - DNA, 509 bp, Heterodera glycines
ttttaattagagtgccacgggaccgggaccgggccggaattcccggtcatccgaggtcccggttcccggtcccgggttttgaaaagctcaggtcccttgtcccgttcccggtagggcaaccgggaaccgggaaaaacaagcactggtaagaatggggtctgagtgaaaaattagtgaagaaaattggagtcaaagggaaaaataaaaaataaaaattaatatattctttaaaagtaacactgcccaagtgtgcaaattgtctaatggctagtttccttgactttcccttcttccttcccctggttcaatccctctacagaaattagattattttgaattttctttatgtatactcgtgggtttcctataaagaaaatatgattcctcatagtttttttttaattgacacatattttatcattttttaaatgaaaatcctaccaattgagcttaataattagggatgcgattattaggttttaactaaagggttgcttaattgattgaag

SEQ ID NO: 34642 - DNA, 1332 bp, Heterodera glycines
  misc_feature (74)..(75): n is a, c, g, or t
  misc_feature (80)..(80): n is a, c, g, or t
  misc_feature (132)..(132): n is a, c, g, or t
  misc_feature (147)..(147): n is a, c, g, or t
  misc_feature (200)..(200): n is a, c, g, or t
  misc_feature (1326)..(1326): n is a, c, g, or t
cagtatcagtgttggtttttgtcgtgccacttatgcacacattggggaaaatatattaaaaaatgataattgtnntagtncaatttttgctcagctgattaaaaataatcaaaaatatttacacaacatttnagagaaataaaatanttgtagaatcttctataattaatatgaatttttacaatttttttgaaaatttntaatagaattaaaatttctgataaaaaatagataataaaaagctattaatataggaattagaaaaatattttttaaatttatgaatgagtgttggttttgctcggaattgttgctgtcaattttactcatttgtcagctgaatgaatatcctgaaacattttttaaaaatccgcatataaaataattcccttctttaacagaaattatacaagaccttaatagtaaccattttaggtaatattataatttatttttttacaaaatcttacaaaaattaaaatttaagaataaattaaatgatttttttggctctattccagttttgatccaatgattttttttaaatttatccaacaaaataggttaataataaattgaaaataaaatatttaacggaaggcaacctaaatttataaatattaaattgaatttagtaaatagttttcaaggaacaaatacatatgtgaaggttcaacttttggataaatgttataatcaaaaattaattttgttggattggagcataaaagaataattagtaattagacgtgtaaactgaaataaagccgattttattactgaaagaagcacaaaacaaaaatttcgaaataaaattaattaatacacacattatttttagttagcaaattacttggaaatcagaattgttggcatttcacgatgaaacatttattttggaacttttaactttttaaaataactttgatcagttctttctcttttttggggcgaacgtgtcagcagcagtcggccgggggcaacaacagctggatgatgaaaatgatcagtcagttgatgctgatcggtcggtccactgactcttctgctgatcaatcgcttgtccctgcttcttctcctcccccgtcggtcgtcctttgcttttttgagttcgcccgtggccattcattgcctttgactctttccgcgtatttgtcataaaatcactctgactaaaaatgttaagtgttattttggtcccagaagggctctaaaaagcattttcttccgtgaggtcgacgaagacacactttaagctgcgatgtgccaatcccttcgttaatttctcataagtctgatatttttattcagttttttaactctctnaataaa

SEQ ID NO: 34643 - DNA, 803 bp, Heterodera glycines
  misc_feature (19)..(19): n is a, c, g, or t
  misc_feature (23)..(24): n is a, c, g, or t
tcgccgccggtgaagtccntccnngcctcgtccacatacgccttctatagaccaagcagagctgcgccgcctcggagaaaccgtcgtctggagcaatggcggaaaaggcgatacgatatacaacaatacatgctggagaatggattcgcgctgccagcgccttcacaatactatggtgacttgcctgtgctaccagacaatgcggatgaaattgaggaaatggacactgttcaacaaagattggctagcaggaggaaactaaaaaaggacgacgacgacgacgatgatgattggcaagacaaaaaatacaaaatttactatccacctccccctgctcgccggctcccgtctcgtccagcaaaaattgaaccaatgcccctccaccacgtcctaacccgaagagagagccacagccaaaggtcgaccctcggccatccacatcaaagcaggccgatataaaacctaaaagggagccaaagtttgagccggatccgcgaccatccacatcacggcaagccgggtacaaccccgccccaccagctcccaaaaaagaaccaaaacatgagtggaaacagacaaagcggcgccattctcctcatcgcaccgcaccccatcggattccgaaaagccgcgcttacgtaagagagtgaggcaagcgagaagagcaagagtatattattcgccagagccaggtccatcgacctctgcacaaagtgatgaacaacaacagcaacgcgaactattttccattccgaacaatcagctgacgatggcaccaagagttgagctgatatgcatcaaat

SEQ ID NO: 34644 - DNA, 1122 bp, Heterodera glycines
tttttccgtgtccagaaattggccccccgaacatttgcgcttatgtccaaaatcggattaaaacttactttgccaaaatggcgtcgctgaaacggtcccccgactctgttcaaaaacaaataatacggcacggaacggtccccgtgcgaatacgcacgaattccggggattttactataaaaaataaaacatttattctgcattttattttttttgtctttgtgccttttcgtggctcagttggtaacgctttgcttttgaatccttcgcgaaggcaatgatgaaaatacgatcatttttaggagctaaacaatgacaataattttgccctgctgagccttcgaataacatttttcttgccgttgaattgtcaaattaagttatttaatttgatttgtcagtgaataatttattatttgaaaactacatattttaatttaaaaatacatttattatatatatatttgcttttttcaatatcaaaacactgctaagctaaagcattcattgtgtgctaaattttgtgccgtctacaaatgtttggtagcctaaaatatgaaaaaagagaccaaaatgtgatgcgataattgcgtctatttccttttatggaatgaatgtgattgctaccagattagagcgtaatcatctcgaaaacagcgaattgagaatttatcaactttttattttctaaatttgcgtattttttaaccttttttctgttaaaatgtttcttgtcgccaaaatggcgtcgctttaatgatcccgaaaagccaacataaatattttcatattattttagcacagaaaaaaaaagattaaaaaacccaacagcataaaaaaaacatttattttcatttttttctttttgtctttgtctttgtgccttttgtggctcagttggtaaaatgctttaatgacaaaaaaaagcatcgcgctgagccttcaaagaacattttcttgccgttgaattgtcaaattaattatttaatttgtctgtctgttttttatgttattattagggtgaggatttttaggtgcgaaaaagtccaaaatagggaactaaataggggcaaaaaattcgcgaaataggggcgaaaaagttccaaatttgggatataattt

SEQ ID NO: 34645 - DNA, 856 bp, Heterodera glycines
  misc_feature (17)..(17): n is a, c, g, or t
  misc_feature (37)..(37): n is a, c, g, or t
tctagagtctcggtttnattgagggaacatttataantcggcttaattggtctgaattcagaagtgaattcgtcctcctctgtccattcgcgtgcaatggccaccaaaatgccaacaattaatcccattccctccgcagttggctttgttttccttttcatgtcattttttgttttagactgaccaaaatggcactcaaatcgtcgcttcttcgtctgccctcccccctccgccggcacaacacgccgactccaccgattcaggtcgattaaattcaaattagtctcttttaaggcataacccccccccccatttaaggctcgcactgttcgtcggcactgatggccgagacgctgcagcaaattgaccaattgggcttagaattgaacagttattgcgacggattggacgaattaaacaatggaaacgccggggaaagggtaagcgaagcgatggcaaaggaaactgacaaaaatggcacacgcattcaatttgtctgtatttatgcatatttttatttgctacgccgaccattagtggggtgtcgtggcattttatccgaatttccttccccctcatttggaatttcctttcccaaattaccccccccccccataatccattgttccgttttcccttgcttaagcaccggtttgcgcttcctcctccccattctctccctccgtttgtcactgactccgtttcttccgccgtcgtccgttttcgcccttgcgccaccgccgtctcccaatttcaaaacgcggtcactccgcctccccctccgccccctcctcctcctccgccaccattgcctccccaacggcgcaattcgccatttcatccgccactccatcag

SEQ ID NO: 34646 - DNA, 1374 bp, Heterodera glycines
tgatcgtttgttacccttttttgctatttattgattattttcatttatttactttacgtcacccaaaataattatcagttttggtataaaaaaaaagaccataaattgaaaaaatgattaaaaggtaatggcagtaattagaaaaaaagaaaaataattatttgcatttaatttattcctattatttttggagataattgtatattttgtattttttattattttttttattagacttaacgatcagagtgatatttattattaaattttgtactctaatttatttttcgaaatgaattttttaagaaaataaaattcattaaagcattatttatgccgctacgacgttagtcaaaaaagcatcaaatgaaaaattttttgatataacattgcttaaaagtagagatcggatacggacgggatccgtatacggatttttacggatccgtagtccgggattttacggatttttaatccgtaaatccgtaatccgtatgggtgcctagtccgtaatcccgatcctgatccgtacaattcttcatacggattagggattttttttggcttttttaaagtgaaatggattatatttttaaattttgtgcagtcaattcgccaatactttggaattggcgggtctatttcgtaaaatttttggcaaaaatcgaaaaaattggaaaaaagcaaaatctttgtgcaaaaaactcaaaatccttacgttattgaattgcattagttgaacttttacaaaattctatttctttttttttccaatttgtaattttttttaagaaatgaatttcgtttttctatttcttaaattttttacgaacttggttttgtaaatttttcaaaattatagatattttttatgaaaatttgtcaacgaaattcatgaaatggttaaaaatcgcaagtttgctcttttttggtgaaagtctgttatcaaattaaaattaaatttttaaaaattttcccggcggcgcctataggcaccgccggttcctaaaaagttttttgaaaaagcgcgccgcaaaaaagtggtgtgaaaagcaataaattgtcgtgtaagaaaaaatttttgagtattctttgaattttttgcctagaatttataataaatttattataaatcttttagctttaaatattcaaaatttgtatttttataaatcagtttttatcgaatatgaaaaaatttttaaaaaattccgtatccgtatacggatccgtatttttcctggatacggatttatacggactacgaattttccggatttttagtccgtaagtccgtaatccgtatgtgtgcctagtccgtaatcccgatcctgatccgtattttctcaaaattccgatctctacttaaaagca

SEQ ID NO: 34647 - DNA, 1040 bp, Heterodera glycines
  misc_feature (13)..(13): n is a, c, g, or t
  misc_feature (28)..(28): n is a, c, g, or t
tccaaaaaaaaanattaatgaaaaatcntgttgcaaaaaatttgatctagatcagtgatcatttacccaaaataaaaaataaaaaaaaaccatttcttcaacaatttgtaggtcaccaatttcagcggttggaggcgggaattcgattacaaactcttgttgtatttggttgaaaagtgtagtgtccttaattagaaaaaaaaactgttatttataaaaaaattcaatctgacccgcgcatattatatatttttattcttttttttctgggtgttatttcggggtaataaggtaaataagtattttttagcattgaagcctctaggacacattttaatttcttttttttttgttcaatccacatttcgtccatatttcttgtaatattttccattttacaaaaaaattgaaaaattaaacaaaatttcaatttctgaaccaataacttaaaaaatcgaaaatttccccggcgtcggaaagcccaccctaccactagtttttaattcttgagaacgcacgcaaaaaaaatcagaattttttcgtccatatttatataaaccatatttttttttcttaattttggtttagtgctaccatttcaagctgctgcagatcctcgtcacgccattcaaaaaataatgattcttaattattattaattaaaatttattttatactattgtaaacagggacctggttcaggtgaaagactcatttgagtaagtgccagtaaaacttgaatagctaaatttatgataagtagggagccaagcattttacgaatttgatgcctaagatggcactcaaatgctcaaatgaccaaagtgagcatttgcgcatccaatgaggatgaatctctcttaaaaggcttttgccgcattcgctattgtccgtgggtggcccgcccaataatttatgacactaccataaaaatgccggaaagagaagtgttgattttgcctttttcgggaataacaaaaataaattaattttattacattttggaaataaaatcactaatatacatataatttcatttt

SEQ ID NO: 34648 - DNA, 996 bp, Heterodera glycines
ttaattttaaatgctttttcaatcatttaaattgttaaattctatttttcattttctctcttgttatctccgacacatatctctcgcaaattgacggcggtctcgtctgccatatttaagccatttattttttcccatctctctctcacattattcacttaaaaaaattgtttttaatcgacaattccgcttttttgcaattctcatcacatttttgaaattaaatttcttcattggaatttcattgaaatttgtgttttgcaactacagcaaaccggaggttttctgagcaagttttccgccacacaaaactaaactgctcgatttcaaattttggcggaaaaccggttccagcctaaattatttcttttcttcaattaattttgtctcatcaaaatttcataattgttttccccttttacaagtgaaaagtatctgacattggacaaattggaaattggacgagccgaacaaattgtaaattggacgagccgaacaaattggaaattggacgagccgaacaaattggaaattggacgagccgaacaaattggaaattggacgagcggaacaaatcgcgaattggacgcattggacaaattgacgcatcgaggaccaattgagtgcactgtcttggtgcacgtctcagcgcgccggccaaccccatctaccaagacgtgccccggacaactggcgaccttttgtgcacaggcgggttcaatttttttttcccaaggggaggtctgattaatctggtctcatccagaattaatcagtgctttaatttccgttcccacctccctcccaaaaaaggcaatcaagttcagtttggactgaaattttcgaagtctcatcttcgaacagtcaaacatttaaattgcccaatttgaatttgtccgaaaaatctcggcatatcatttccatttcacattttttttgtttttgtccaattcaagttattcaaaaatctcgatatctcattttcgagttcaaagt

SEQ ID NO: 34649 - DNA, 645 bp, Heterodera glycines
atgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggccatattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttattccagaaaatctcgcatgaattctcatttttaaattttttatagatttttaaatgtttggattttttttggcttaccaaaacttcatcgaacctggttctttctattctctttcaaatcgcccccaaattttttttacagcttaacaaggccctattaagcttatttccagaaaatctcgcatgaattctcatttttaaattt

SEQ ID NO: 34650 - DNA, 707 bp, Heterodera glycines
ataataatacgaatttagtgaatcgtttaaattaaattctttattttatcagtcactgagtttttttgaattgacctagcaccgtttttcttacggtgtctgttggataaattagtatattaccgcctcattttccatttaattttccccataaatcaagaacttaaccgatttccaactgattccataaatgaccccaacgattgtggctgattttcactaattaggcggcggttgtcggaagaaaaagttttgggttttttgacgggcggtgccatcaaaaaaaaataataataaacatgcttaatggaaatttttgtatagtacaggaaggaaattcttcaaaacagctgtgctaatttcctgggattttatgtgcccaggaatggccaccataaggccggccgggggggataattttttcaaggagagagagcgagaggcatagagaggaaagcaaatgaatgaagaatggattaacccgaagatctgcgcttggcttggtaataatgggcagagaacggcacggcgccgtaagtgtggagcatagtcagagagaggggaagagatagagagagagagagagagagagctgagagatataacaagagagacggggaaagaacaacgaaatggattaatgccgcaattttcaaaaattgtgcggttgcggtctaagatcccgcgcgcaatcccttctcatccat

SEQ ID NO: 34651 - DNA, 813 bp, Heterodera glycines
attacaggtttaatttaataatattctttcatcgagaattttaacaataataaaaacaaaaagtgttatcgcatatcgttttttaattagtagtcagttgttgaaatttcaatgtaattcaaatatatctacaacatattgttgttataataatctatttaacagtggttatcactgttatgtaatcaagtgcttttaatgttcggttcctctagcaaatcaacctgttgttgtcgttgttgttgttgttgtggtagttgttgttgatgctgttgttgatgttgttgtggtagcaaccgctctgtctctctttttctttctctcactctctctttctttctctctccaaattagtatagttaataatttttgttttgtcccttttatacatattcacattttatttatcgcattgttaaacataaatctattgatttcagaagataataaagttttattgtcattagagaatggtggcggtgcaacagcttctggaacagaagggcgtcgtcaatggtatcaggtgaatgcacttttctggctatttaaatgaccaattctttccctctctcgcttaattatgcaaagttcgttcagggatgctttggtcttcgcggctggtgccagcaaatcatcagaagttcaccatggacgttgtgcgagtgaggataaaatgcgtgttgcggtttgttaaagtaattgagattaagcttttaaacaaatttatttcagatgagggacagcggttcagtcatcacatgctctatatgcctttacccatttacaacgacaaatccgctttttcctgtcatg

SEQ ID NO: 34652 - DNA, 219 bp, Heterodera glycines
aaatgcgcggtttttgccaaatttgaccgattttaacttatatttcttgaaaaaaaaatttcaacttttttgttagaattcgggtccgggtttcggaattgggcaaatccgagttcagattcgtaatcagcatcctagaaaacccccggaaactaattttgagccaaaaataaaaacgttaaattagggacacccattcttcaggattgccggattttg

SEQ ID NO: 34653 - DNA, 1213 bp, Heterodera glycines
ttcatataaaataattgtttgaaaaatttttcaattttccattggcctattgaaattttttttaaaaaatcggaacttggaatactgagactaagaaaatttcagaacagaatattgacatgccaataatattatttttttaatttcccagttcgctgtcccgtaccagcagtccgtcacggttttatgaaaaattgacacgcggcgcgtcaattggaggcggcggaggcggcgatttgcgcacactgaagccgttgccgagcacaatgtcctacgacttaaagtgaaaatttaatatgcattttaaaattattattttaatttactttttattttttatattaaaatcgctaatttaatatttaatttgaaatttatttttaaaactttttatgatttattagtttaattaaaaaattatttatttttcttcaccgataaaattgtaaaatattattctttttaaatatatttttattttataaattttaatataactttctctacgatttaaaatcgtataaaataataattaattaaattcatttgcatattaaattttgcagaaatatcatgagaatgaccgagattaaaactgacattggatttgctcgcgcatttgtacggttggcattggagcgaaagctgctttacctatacctaaaaaaggtgttgttttctgttcgatgcctttttggcattttgcttcataattagtgaaaaaataaagattaatcaaccataattagggttataaattgtatgcactaaaaaatgccaaatatgcgcataaaatatgcactaaaaatcccccaaatatgccctaaaaacccgaaaaatgcccaaatatgcactaaaatatgccttaaaaaactgccaaaaatggtttttaactctcaaaaaataccaaaaattgtgtataaattaagaattgactttaaaaacaccaaaacaatgactaaggagcgtttttagacaattgcaaaacattttaactttcgtagtgcgacatttgcggaccgacttttgcggaccactatttcccgattgatactgtcaaaataaagaaaaaaaaattttttttttaattttcgataagttaaatactcccaaaattgaaattagtgaaggtaggctgatgcaaggcgatctgtttcaattggagaattttattttatcttgaagtcccaaaacccaagtggaaatttttcct

SEQ ID NO: 34654 - DNA, 1217 bp, Heterodera glycines
  misc_feature (1143)..(1143): n is a, c, g, or t
  misc_feature (1149)..(1150): n is a, c, g, or t
cgcgttcaagcagtacaacaacggaaacaattaattcaagtagtacaagaagcggaaaactgccaggaacaccgcaacgaaattggaaaatgggagcaacatcgtcatcggcagaagtagcacaggcaacaactagttcgagcagtatgctgaggaacaaaaaaaagcaaaatcatagggaaaagcaacaaagcggaaaaagatgaaaaaaaaaacgaactttcaagtgacgacctaaaagcaaagcgggcgcataagcagcagaagaagcaatgggagaggaggaagagcacaggaaaaataagctcactaaaattaaaaccataaaccaaagcataatcatttgctaatgagaaggcctttggggcaatcagtcggaacaatcaaaagaatattaatggctcaatttgtcgcctaattatgaatattcgctttgttttttattatttattttctttcaaatcctttacatcatcttattttttttactttttgttattttttgttttgaagaattgctttaaacattgattaattcgcttttgtgttgtattaataccaacaatttatttaacttactgtaatatttatgtaccgtaacccgcccattttactaccgttttcctttgtctgtttgtgttgtgcgcctaattggtattaaccttttgttcagttgctattgtgaagtcgtgccccgcttctgtttaacataaatgggttcgttcgttttctttaattaattaccaaaattaacattttattatttttaattttaattatattaattattgacaattaactccactaactaattaattaaactatttttaacataaagtaaattgcaattttttctgcttattcattagcatttgcttctgtccgtccgctcgctttacccttttgccaaatattttttttgttttattttccattttttaggtttttccgtttcctccggcggtgcctttggtgcgtgccgtcgaattgccagcgctttcgctgcctcggccgccgccttcgccgagtccaccgccgcccgagccgacgccggtgcccgaattgccggtgccgaaaatggctgaacagctcgaacttgtggtggaagaccgcaccacacgcagccgacactgccaccaattncgaggnncgcagtgatggtaaagtgggaaaattaaactcataaaggaatgctaatgagaccacttgctgcccca

SEQ ID NO: 34655 - DNA, 779 bp, Heterodera glycines
tttccaaaattttttggacaaaaaattctggcttatgattttttgaaattttatgaattttaaaatttatattctgatagtgaataattaaggctattgtatgatagcatgaaatatttggtagaattggagctaagttatgaatttatatgtgttaccaattttttgttttcaaacccattttggcggatttacgaaacgcgcacgggtggcggtttttaggaaatgcaccagcaaccaaatatgtatgtaaataaaaattttttaattgttattttttgaaaaaaaattcttcatagagggtaagataggcacaaaatgtaacctaattagaattataatcatcttttagtattttaaaaattaattttagcattttttatgggtacattttcaaaaattctcaaaatatttaataaaaatgaaaatatgtacgaaaaaagtttaaatatattaatattaggtaagaaacgaaaaaagtttaaatatattaatattaggtaagaagcaatatttattgtttaatatataataaatacttttaggtatttttatgttaatttgttaataaaaaagttttttttatttaaaaaatacaagtacaggcctgggtccaggcctcgaggagcctgtattttttctgtacctgtattttcctgtacttttgtacagaaaatacagaaaaaaacatatactagtaaattgaatgttaaaaaaatttgaacaaatttggtatcattacgggtatttacaaaataattttattatttaaaaaaata

SEQ ID NO: 34656 - DNA, 888 bp, Heterodera glycines
ttttttggaattaaaattagaaaaaaaaaaatcaaactcgaattaaagaccgaccaaaattgaaagattttcgaaacttattaatcccataaattaagaaatccctgaaaaaaggaaacagaaaatacccgcgccagtgattggatgagtgaatggacaagttgagagtggaagcccaaggtgatggaggaggacagattggcacaaaaaacgggcaaaagcgtggcggtggtggtactctgttggcccaacatcagcgaaaacagtcgctcgaagagcggcgcgtcggcacgctccaacacctttggagggaagaaaatggtaaaaaatcaattttaaatgatcagaaatggaaaagtggtgatccaaaaaagcaaaacggatcaagaaatgcacccgaaaaattagaccgaattccgaatttaaaacttactgacgaaatttgtcggttttttaatccccagaaatcttatgaaaggtttggtttgaaagtgttgctataatgcaacaatctaaccaaatgtccaaatgtttaaaacccaaaaaagaatttaaaaaggcaaaacaataaaaccgcgtaccagcaatgagagagcgttcagacacaggacgagagaatgggtgtcaatttgaaattggcgctgttcaagcagttgcagcagaatctgttgaattaaacggttataaaatgtttggtttctctctgtctgcaccttttccgcgtccggatggttcaacgacagcagcgaggcgacacgaattgcacgggaggagaactcgtggttgcgcaccaacttttgcagggtcacaattgtgtccgtggaaatgaccgccatgtctgtgcaggggaagggacaaaatgggaaacagaaaaacggaaatgcaaag

SEQ ID NO: 34657 - DNA, 972 bp, Heterodera glycines
ttttctcacccgaaactctttcaccaagtgatgaggccgtttgatgccctcaatcacttctggatgcgtcaatttcagcaaatgttcggcatatttcaaaagtgggaaaagcccattggtcaccagcggtgggagggaacgaagataatctgtaaattttttgaataaattgtgagtttgcaacttaattagactgttaaatgaattagcaactaataatattgataataaaataatatgtttttaatcatatcagaaaatctttgaacttaccaatttcgtaatttttggtaggagtaaatttggccatgtcttcgttgtcgtaaattgattgaattggattataagtgtacgatcccttaaaaatcactttgttttatagataatgaataaaaattgaaaaacatttttgtgtatgcaaatattgaacaaattgacctggattttatatatttatatcagcatttgtggcctattaaacagaatcaaagttacaaatattgaatttttaatgcaaaattttcactttatgtgccttttttgccgattggcgtatgggtcttgtcataaaaattacaataatatttaaatgttctcacatcaattgcgttgcccagcaattcgtcgtagcaaatttcatggccatccgcattaagttgtgatttctgattttaaattcggttttaaagcaattaataaatttaaaaccgatttttccgtcatttcatcgctatttttatttgaggcggatgccaaattacaatggtttttgattccagataaagttgttgaaccattaacattatgtgcttctgacgacaattttctttggtatattcggtgtgtggccttttgtacaatttgcgcaatgaaacaccaaaacatttgattgaaatgcggaaaacgatactttttttcgggctaaatacaaaaaaaatttaatgatgtcaaaaattctaaagaatattatga

SEQ ID NO: 34658 - DNA, 1163 bp, Heterodera glycines
  misc_feature (43)..(43): n is a, c, g, or t
  misc_feature (111)..(111): n is a, c, g, or t
  misc_feature (127)..(127): n is a, c, g, or t
  misc_feature (1094)..(1094): n is a, c, g, or t
agcagacgatgagtgagagaaaaatagtggtaaaaatggtcanctgctgcattggcagagtcagagaggggtcacaaagagttcgcacagcatcgaatattcctttcattntaggcgtcattcttcnccactgcacttctttcttcggtttaattacccaagtttgaggtacttggcgtgtcctgcccataatatctgtggcatggaataaattttggaactgcgctgcctaacggcggtgcttaaagtgcgctaaaaatgatcaaatgattatcaatttttatttttcttaattccaaaatgaattgaaacgcaaaaatttaatcataattcatgtggtaaaaaatgcatttaaaaataaaaaaattcttgaatttgcttctgaattttttaattttaaatagaaaattactttttcgaaaattttgcacaaataagaggcggagaaattcaacgaaatttttattaggattttgatttaaaatgttgagaggtttaacaaatttgtacactgaatgttggatcgtcaacaccaatgagaaatgactaacagaaaagagggagaaaagggcgttggcttaggaaaatagcttataataaaggagagacgagcagacgatgagtgagagaaaaatagtggtaaaaatggtcaactgctgcattggcagagtcagagaggggtcacaaagagttcgcacagcatcgaatatttccttcattttgggcgtcattcttccccactgcacttctttcttcggtttaattacccaagtttgaggtacttggcgtgtcctgcccataatatctgtggcatggaataaattttggaactgcgctgcctaacggcggtgcttaaagtgcgctaaaaatgatcaaatgattatcaatttttatttttcttaattccaaaatgaattcgaaacgcaaaaatttaatcataattcatgtggtaaaaaatgcatttaaaaataaaaaaaattcttgaatttgcttctgaattttttaattttaaatagaaaattactttttcgaaaattttgcacaaataagaggcggagaaattcaacgaaatttttattaggattttgatttanaatggttgagaggtttaacaaattttacactgaatgttggatcgtcaacaccaatgagaaatgactaac

SEQ ID NO: 34659 - DNA, 878 bp, Heterodera glycines
ggtgctgttagttttcgacagtgttggtttcgacagtgattgatttcgacagtaaagcttatttttaaaaaattgttctatagggcataagtattgttaaattttgataattaaatgttaagaacatgactcttatacattgcagaggggttcgagattttcgaattcttgcttaagagcctgcagatttgaattttggcactcaaacccggcattagttagcagattttcccacacgattcgcgagatcttatcaaagaaatttgttgtatttttgactacattccaacaggagatatttgtataaaaaaagtgaaagcgataaatttttggcaaaaaaaatcatacaagtcttatttttcttacttacttctattataaattttgtatatgcaaattgtatattaatattaattcatttgtacaataaatcatgtagaacagcaataaaaaagtactgtcgaaaccaatcactgtcgaaaccaatcactgtcgaaaaaccacccgacgaaattgtgcgattcgttttttgttttctgtgatccgacccctccaaataagcacaaatcttagaaataagcatacttgggaactctgcttttcttcgataagcgaggctgtggtttctcagaaagtattaatatctctcttggtgtccgttatcccaccacccctccctccttcacgtgtacccgagtatataaagccgaccgaaaccccttccactcgtcgatatccttcgagcacgttcgttccgtccgcacttaattgataatttattcggttcacttatttttctaattctgtttgattacgatacgaaaaaaaatgtctgacggtccaagaggaagccggagaagagaaaatggaaaaagcga

SEQ ID NO: 34660 - DNA, 887 bp, Heterodera glycines
  misc_feature (881)..(881): n is a, c, g, or t
ccgaccgtcggtcgcatggcgactctccgcttcacctggtcctcctccccagacgcctttgtccaccgtctcgtgaaattcgggcgcttcaaatcgaatccatcgctccgtgtacattggcaaaatgtctttgcgtcgcaccacctcttttccctcgcggcgccggtcgttcagtccgatctccaagaaggaagtgcctctgagaaaggccaagcaaaacagacgaacgcgggcgcgctgatcgctcacattgtcatctatgtccaccgaagcctcgcactcgtcgtaacaattaatctgaatgcaaatgtgccaatatttaaagtactaaatgtccattgccgactaattattctctgtccctcccatttcaaagtgccaattttttccgtcgtaaactcttgaccagcatacccattctcgactattgctctttcactctcgcatcgttctcctctctctttttttcacctgcacttcgtcatatttgtaggtcggcgccgtctcgcgctttttcgggtaatggaacagcacattttctaatgcgtcggtgaaactggcgatggtccgttcgttcaatgacccaaacttagccagcactgtgcactgattgtgagccgcgtgctcaagaggaaggccatatttggtcaaatagccttcgacgaggtgcgagatttgaccggagcgaataccattgcgctcattgtacagaatgtgttgcaattttacggtgtgaattttggtgaaagcgtcgtacggttgcagcacaatgtccgacagcgaataattggcctgaatttgggcacaacggaagtgatcagtgaacaaacacaacaaatagattcattggtcgttaaccaattagcactaaattgcttctnttaatt

SEQ ID NO: 34661 - DNA, 716 bp, Heterodera glycines
tttttttccaaaatcctgtcatgttgtcgctgttagaattttcacatcttcagaatggcgaggtactgttagaatttctactcgatcggttcatgcgtcataacaaaaaatacgctgtccttatattaatgtaacacagtgtagtataaatcaagagacttattttaatccatgccgcgaatgaaagtcttggcgcaaatgtccgaaaatggcctctagaaagtgaccgcaaatatcctaggctcaaatttcgaccgcatttatcggggggagagaaattggcgaatggaggggggggggggatttgaggagaaatgaagcgaaatccaattcaaatttgacgcgatttgtgatgaatgaacaacaacagaaagacaaagcgaattcgaccaaaaagggcaaacggagagagaaaaaggcgaaccatcgccggaaaaggcgctgagagacaaattacgaggagagagaggcaaaacaatggacaattaaatgcctaatttgaagttggaattaaactaaaaacggatcttttaataagaaataaaattcaatatttaaaaatattgctaaatttcactcatcgatggaatcgcccgtgggcatttgaccatcagacggagacacggatgatagatttgctgacggaaaatgtgtggtgagccggatcccaaatgaaaaaaggaagaagcaacgaaaagaattggggggggggaaag

SEQ ID NO: 34662 - DNA, 610 bp, Heterodera glycines
  misc_feature (7)..(7): n is a, c, g, or t
atttttnagttacgaagaattggattgatttgatgatactttgttttttgctctttgggcgtacgatataaaagtgagtatttgaaaattttgattttttgttaaattccgaggttcgcaaacttaatttttaatttaatttaattactaaggttttcaataagatattaagtgtacatatgttttattcgaacgaaacaattaacaaaagcatttcgtagagaaaaagagagcatcaaatccgatttcctattggcgagatcgatcatttctcaaattataattatttttcattgctttcgtccgagtccttgaaaatgaaaatatttgagacagaaacccatcatcccaaaaaaaaaaaaagaaatgtccgcttaccgtatatgctctaattatagcccatgggtgattatttttcaacctcctcagaaaaggggggataattagagactgggggattatgatagagggattatttttcaaaacacctcgtagactgggggataattggagactgcgggattaatagagactgggctataattagagcatatacggtatgttgaaatggggaaaaacccaacttgtactaggccaactcgtactgttt

SEQ ID NO: 34663 - DNA, 926 bp, Heterodera glycines
gcaagaaattagataggcaataagttgtgttaaaaaacttttgggtatggaattattttttgaagtgagtcaaacaccctattagtgctttgctgtgccgagaaccggcaggcaatggatggctttcaatctgcaagaaattagattggcaataagtggttgtaaaaaacttttgggtaaggaattattttttgaagtgagtcaaacaccctattagtgctttgctgtgccgagaaccggcaggcaatggatggctttcaatctgcaagaaattagataggcaataaatggttgtaaaaaacttttgggtaaggaattattttttgaagtgagtcaaacaccctattagtgctttgctgtgccgagaaccggcaggcaatggatggctttcaatctgcaagaaattagataggcaataagtggttgtaaaaaacttttgggtaaggaattattttttgaagtcagtcaaacaccctattagtgctttgctgtgccgagcatcggcaggcaatggatggctttcaatctgcaagaaattagattggcaataagtggttgtaaaaaatttaaggaattattttttgaagtgagtcaaaaattagtgctgtgccgagaaccggcaggcaatggatggctttcaatctgcaagaaattagataggcaataaattgttgtaaaaaacttttgggtatggaattattttttgaagtgtcaaacaccctattagtgctttgctgtgccgagaaccggcaggcaatggatggctttaaatctgcaagaaattagattggcaataagtggttgtaaaaaacttttgtgtaaggaattattttttgaagtgagtcaaacaccctattagtgctttgctgtgccgagaaccggcaggtaatggatggcttcaatctgcaagaaattagattggcaat

SEQ ID NO: 34664 - DNA, 1110 bp, Heterodera glycines
attctcaattctcggggtcaatttaaatgtttcaaaagcctgtgctgacccttttggtaaataccgggccgggccacccggcgaaacgggcttttttaccgggcgacctgggcccgatcaattatcaaagcccaggctcgggttttaaacgggtataaacttcgccagtgaaactgtcccgcatttgaagattttttaattgttttggcgaaatttttaaatatagaattagtgaatttttagaaaagttaacacaatttcaacatagatttagttaaaaatctgaaaaacatttccaggcggtgtcggttggaaccgccggccccagatttcattaattgttttttttattatagaccaactcacaagtcctttttagtacaaaaattataaacaaaagcagctaaattttcaaatttttcccagcggcgcctttcggccttcccataaatatgcaagacacaaaaagtgtttcggaaaaaatatcaaattttgacagatttttggtcaaattataccgaatttgagttcatttggaaatctgaattatttctgtttagaacttaaaagcagcagcaattgtcgaagaaatttactgcaaattttgacggaggaagacgcaaaagaatttttaaaaataaataaaataaaatttgaaaaaagcgaatttaaaattcaaaaaaataaaattagtgaagaaaaaggaaataaaaattgggcaaaaaataaattgtcgaaaaaagaaaacaaaaagaaaatggaaaaaatttggtcaacaattgaaaaaggagaaacatcgaaaacagagaagaaaaatttgacaaaagaaacatcggaagaagtaaaaagtgacgaacgaattgacgaagaaaaaagtgatcagaaaattgaggaagaaaaaagtaaacagaaaatggaagagccaaaaagtgagggggaaaaaagtgatcagaaaattgaaaaagaaaatagtgatcagaaaattgaggaagaaaaaagcaagcagaaaatggaagagccaaaaagtgatcagaaaattgaaaaagaaaatagtgatcagaaaattgaggaagaaaaaagcaagcagaaaatggaagagccaaaaagtga

SEQ ID NO: 34665 - DNA, 792 bp, Heterodera glycines
aattccgaaggattactcttacattgattgattttgtgtgttttatgccaatgtttaggtgagtgccgtgctgtttcttctcagatgttttgttgagaatctcagggactttgccgctgccgactcatttaatttattctcataaatacattttttatgatggaatcaaaccatttttcttgactttataattgtaatttgattccaaaaataaacaaatatgtcaaatattaattttgtcggtcatttaaatagctttggattgaactggtagccccacttttcaaaaaaggcagctcaccggggacagtgccaaattctcctcctccccatcacaattggccgcccgcagcggaggcggctatggcattttgccgagcattggttttggtggcaccgcaatgctttacgagttgcgtcggtttggcggcattttcggtggcactggcgacaacccttcggcaccgaggccgaaagagttctcccttatcgccctccccttttccgcctctttcgacacctttccgtccacatcgctgccctgctctgctgctgatcctcctttatcgcagtcaattggccaggcctcagctgtcggcgctgcaatggcagactgcggggaaatgggggccactggaaggaaaactcaatttggcttaggccagaacatccctcgactgggaggaggggtaggaaaatcagcaggaggagcagatgttggagcaggacaaggaggggctggcgttggtgttccataaaaaggtgggcgatattggcattaattatgaacaa

SEQ ID NO: 34666 - DNA, 1565 bp, Heterodera glycines
aattaaggaaaagaaaaaattttattattttttaattgtcttttataggtatttttattggtgtattttaagtattttattctcttgctttccgccaagaattcattacgcagcatttccaagtccaatttttacttacgtatttaaattatattgctctatttgtcagtattaatgtttatttattaacgaccggcaggattcgaacctgcagcctcagcactgagtgctgcgctcttaccatttgagctacggtcgcccattaacctttaccacttttctttttaaattattaaaattgtcatatttatgtgaagaaggaaacatgatttaaacaaagtgaaataagtcgaaaaaaaaaacattagcttgatttaccaataaaactcaggagatttctggctacattgatcgcgtccagtgtcttcttcatcacgcaaaactaaagttttgtccgacagggttgacgagctgctgcaatgtcatccctctccttgaacaagttgcccagccattgcccgatcggttgttgtccttctttcacaatttcgagcagttccatcgggtagttacggttctccccacactcaaagcgttcaacaatgcacggaatgtaggggtgatgcagtttcacacggtgtcgggcataaaaatgtgccgccacatttatattaaacggctggcgaagacggccgtaggctggcacgaatgccgctcccttttctgttatcccatcaataaagaaagtcttgcgcatgccatttcggtctttgtaggttgtttgaacttttttgcggtccactctttcagtgcgcgttccccatcctcaggatggtttagaagatcgcgaagggttttaagaaaacaaccaaaaaactgggcgcaaaaattccctgaccaagaccaattttaaaaaaattgcaaaggattggcggaaaaagaacgggggaactcctttatctttgggtaagcccccccccaaattggcccaaaaaaaagccctttgttttccccctattaaaacaaaattttttaaaaatttttcattttaaaaaggttccccccccaattctcccccaaggaaaaaaagaaaaaaggggggggaaaaaaaaaagggggggaaaattcccccccccaaaaaaaaaaaaaaagtggaaaaacaacaagggggtggtatgagtttgtggggggaaaaaaaccccccagggcgaaaaaaaattattcacaccttttttttttttttgggcgggggaaaaaaaaaaaaaaaaaaaaattttttttttttttttttttttttttttttaaaccccccccccccgcccccgccccacaaaattggggggggcgcgcccgccccttggaggggtgggtgttattttattttttctccttcctcttaaaaaaaaaaaaagagagggggggttttttttttttttgtttttataaaaaaaaaccccccccccctcttttttttttcttttttttaaaaaaaaaaagggggggagggggggggggaaggaaaaaaaaaaaagaaaaaaaataatttttttttttttttttttttt

SEQ ID NO: 34667 - DNA, 819 bp, Heterodera glycines
ccaattgattattctagaaaatttaagaaaaacatatctttccattcgaaatatatgcaaagattagaaaaatcaaatcgaaacggaaacaagaaagacaatcaataattgaacagaagacggagttgtactcaactaaatggtcctttctgactgtgagtctgttaaatgttagcctttttcgcatgggcgaggagattgggcgaaaagacttcagacaattcttcttgcagtaggctcattctgtttgccccctttttggcggaagaagcgaactgcggagatttcttcttcccgtcgagaaagagggggtcgaactgttccaaatgaggcggacaaggtgcctttttgtcagaagaagccgaaagaaactgaaacaaatacaattagaaatagttaacaaatgtgacatatctaaatgtaatttccatacataataagtacaaatgtacctcgacggaactgtcgccttcgaatgcaaaatttttggcagcatgcacaatttggcctttgtcgtcgggctcaacgaaagaaaagccgaacgatgaacgtggccgattcggtgccgagtccttcgatgtgcctgcctttccgtcgacccttctcttttttcctctgtcttcgagaatcgcgcgcaactgttcgatctccttgcgcagttcgtcgttttccttttgttttttgaggcgttccaaccgttctttctttagatcgacgataattattttgttcttttttgacctcttcgtcgcgttgcctaaataaattcgtaaacatattaaatagttaattgaaaaacacactttctcatcaagtcga

SEQ ID NO: 34668 - DNA, 767 bp, Heterodera glycines
  misc_feature (5)..(5): n is a, c, g, or t
ctatnagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgtttttttcaactagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggctcgtggtgggcccctctgccgctttttctatcaaaaagggagatgaataaatttttaaaaatttttaattcctttttaaacaggccaaaaagtttaggcttaacttttttttcagaaacttatcagaagcgccccaaactttgcaggaatactgaaaggaaaagaattaacctgttttatcacattagcttgtcatcagtttttataaaaacttttcaaaattctgagtctcctattattttattttttttttcaaaattttgaagggcgggggggggcgggtg

SEQ ID NO: 34669 - DNA, 1230 bp, Heterodera glycines
ttctaaattttcccaatatcaaatggcaccggagaaggctttggatgatgcggcggtggacgcgtttgcctttgaaaaggatgggcgtcggttcttctgatggcgtcgggctgtcctcctcaaaatcggacgcattcagtgaatagtcaacgagtttttttgcggcattcatttttatgcacaaaaattatgattttttaaataaaaaaagattttaaatggattgtaataattagcatattggataattttttaacttaaaaaatttcgaaaatttgttaggtacataatcatttcacgaatagaaaaaaaattaaattaaatttttcccgctttttggcattcaaagtttgaaatttttttggtcttttcagtcctattcgacggatacggacaaagttcaaaggacaatagagaccccccaaaacagccttattccaatatcggatttgtatttggctgttaccggagaaggcgtgaccaaattttgcggaaatcttatatttcctcgataaaatagtgacattctgccataaaatttcaaattatgagtttatttaagaaatcagaaaaaattttggtcgactccaaatcaggacaaatcttacaaattataacatttttattttatcagatttacaaactgataaatcaggacagatccgagccctggtgttatgtcatcgtgcgctatttctagtataaaaaggttttttcttcatgagattggtgcgggtaaattaaaaaaatacaacacctttaaaattttgagatttttgaagtatttttgaaaaattatttatataaaggtaattttgttttagcttgttataaaatttaaaaaactcgaagttgctattttctatgaaacaatttgatttaaaatctttaatttaaatattttttgaagtaaaaaatgtaatattaattttttatttttcatttcacaaaagccaaaaattaaagcaaaaagttattccaattccgcactgtgatccgctaattgaattatttgaattaattttggcttttgtgaaatgaaaataaaagattaatattatttttacttcaaaaaataattaaattaaaaaattttaaaaaccaattttttcatagaaaaatatttttcccatttcctggcgtgatcccgataaaacttgacgcgattttagggacaaaggcggaaatccaaggcccggtaattttttacccgtcctattataatattat

SEQ ID NO: 34670 - DNA, 1184 bp, Heterodera glycines
aaaacaacccaaagggagggaaaacaaaacaaaggaataacggagtgttaataaattaggggagaacaaaattagtaaatcaaatcggaaacaaaataatttaaaggattacatttctttcaaatgttttctaggaccctgaaaagtgaaaatgaattgcgtagcattaagcagaaaaagtattacatttttttgtgaacttctgtcccctccgctacctgtaaaattggatgatttggtaaagagaaagagacaaatcggtgaccaaatggccaaagtgcaaaagtaagtcaggagaaagtccaaagtcggctcggttggtcagaccaatcaaagcggtaaaacaccgcaaagctcagaaaacaacgaccgttttgcacgtcaccccaactcacgtcacaaaactcctcgaaggatattttcccatccccgtccttgtcatggaaaagaatggttttatcggcgatttgctgaagttgagtggagaggtgataaaaaccgcacggttttgggtaattttcaaaaagaatttttaatttcaggatccgaaaaatcatcataaaaaaattcaggattgagaaaataaaaccggcccaaaaggtttgggatcaaaaagatttaaatttgcaaaagaaaaaattgaatttccttcacctgtcacttttggtgacaggtggatgattgatgaccttccgcggcgctgcgcggcgcggagagggggagtgaaaaaaaatcgccagtgcggatttgaggaaataaaatctacaaggcggcagacttcaaaggacttcacccctcctataggcttgggattgtgcgggaaaatgtccccgggcggcaacatcaaagggctgcgcccctcccataggcacgggtttgtgcggtaaacacccgtgcgcaaccgtgcgctttcggggtcatatactacttggctttttattttgttcgttcaaataacttaattattatgaacttattggttcaattattttactagtgttcgctatctttaaattacattataattgttatgaaaatcatttattatcattaaaataattttttatgtttttagatacattatttattggatgatataggaaattattatacctaatatttttaaatgttcattgtaaaaatggcaaatggtgtaaatttagtaaataatttaataatttcac

SEQ ID NO: 34671 - DNA, 605 bp, Heterodera glycines
aacgcggccaaagtcgtgacagtcggccattgtttggctggagaatccctggcgatgagtggggaggggagacccgtccccccaaaggataattaattccctccccgtcaacaacagcggagggtccccactctttgcgaggggatcccttcccctcccccccccccccttctcccaattttcctctcaaaatttgctccgtcggtgaacaattggcgtctgtctgaggtcggtcggagatggtaaggcttctctctccccgccgttggccccctcattaatcttcacgcgcagaaaaacagaacaatcccggtagaacagagcagcagagaatggcaggggaaggcgaaaaacgattaataaccatcggttggggagagagaagcaccatttttcaaatgaatattaaaatgttggcaattgggggccattgggtcaattcgctgaaactgcgaaagaaaaaaaatgcgtatttagggacaaatgggcagtttttgcttggccataatttacataggtgcacttttttaattataatggatttgctatttccggcaatcaccaaattattccaatgttcctaattcgaaaattgatctgctggg

SEQ ID NO: 34672 - DNA, 825 bp, Heterodera glycines
cgaagccccccgtacttggccgcgaagcggccgagccctccccaactgttcaacatcccaaggcacacaaaaagttaaaaattctaaagaaatttgctgaggttgagtccctgcgattggaatgttggtggattgagccccagtgattgaaatgcttgagggttgagtcccagtgattgaaatgcagaagaattgagtcagtgattgaatgctggtggattgagtcccgttgattgaaatgctggtgggttgagtcccagtgattgaaatgctggtggattgagtcccgttgattggaatgttggtggattgagtcccagtgattgaaatactggtggattgagtcccggtgattggaatgttggtggattgagtcccagtgattgaaatgctggtggattgagtcccgttgattggaatgttggtggattgagtcccagtgattgaaatgctggtggattgagtcccgttgatcggaatgttggtggattgagtcccagtgattgaaatgctggtgggttgagtcccagtgattaaatgatggtggattgagtcccgttgattggaatgttggtggattgagtcccagtgattgaaatgctggtggattgagtcccgttgattggaatgttggtggattgagtcccagtgattgaaatgctggtgggttgagtcccagtgattaaatgatggtggattgagtcccgttgattggaatgttggtggattgagtcccagtgattgaaatgctggtggattgagtcccagtgattggaatgttggtgggttgagtccccagtgattaaatgatggtggattgagtcc

SEQ ID NO: 34673 - DNA, 912 bp, Heterodera glycines
taccattttccgctgaacagaaaatggcgccgcattttccattgtaagtgtagcaaatgtttctttttctgctgctttattcctcatcattatcttttaccatcatcccttcttcactttgtttggcttttttgcattttattgctgacgagtaaattaattaaatttgaaaaaatattattaccattttttaattttaattaattaaaaatgaatcggacaaaattatacttttttagggagcacagctcacccaccctccccccgtattgtcttcccccaaaaatgttttcaaaaactgaatttttttaagtttctcactttcttagaaggtttttctgggaaaaactctaaacttttttttcttcaaattcaatttttcataaatttttttaggtttttcctaggaaaaaaactctggaaaggtcaattgttaaaaaagggggctattttgctccaaaattgcttaaattgagtttaaaaatatcctaaactcttgcacattaaaaaaaataggctcaatgtcattcaaattagagaccaactcaatcgatgttttaatcggatattctttcttgcgattgattttgtgtagaaaaatcgattaaaatccaatttctctacttataactcattagacaattaattttaatattttcacgtctgtttacacacctttgaccaacggcggcagaaacaatgcattgctcatgctcacaccggtctttccaaattgtgccgtgcattgccactgatcgccggtggcacggggcggcaagttgtcgatggcacggctctgatcaacagtgtccattctgattttgctcaaacgttgtgcactgtattcaacaccgtagaaaccccattcgttccacaaaagtttgcctgaaaatgggcaaaaaaagagaaaaa

SEQ ID NO: 34674 - DNA, 976 bp, Heterodera glycines
  misc_feature (5)..(5): n is a, c, g, or t
atccncattatgagcgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagctcctcaaacaattttagcgcttccaattccttctacatcgcctttatacatcccattatgagcgctaaaatatcagagtgccgaaatcgcatgtgatctaagctagcaaaaa

SEQ ID NO: 34675 - DNA, 935 bp, Heterodera glycines
  misc_feature (67)..(67): n is a, c, g, or t
  misc_feature (880)..(880): n is a, c, g, or t
agttcgaaagttaaaaaaatatgcatataaaatcacaaccttctgaggacccaacacagaaactctntggaaaaatattaatgttaaaacccggagacatagataataattttagaagctaaaaaaatatttttaaaaaactttcttaaaacaataaaactctctaattatgttccaattaaaacaaaagtattcatttttattcccttttgaaaatagtttaatttaaatcacatttaatataatcgccaataaataaattattttcttaattaaaaattagctataattaatcaatttaaagtgtcataaatttgataatattcacacaatagttcataaaattttataccacctccaaaaaaaatcaagtgttaattgtgtcatggtttgaaaaatttggtagttagaatattaacacaataagaaaataaaaatgattaaattttataaaagcctttgaacaagaatggggaaaagcgtcttcttgacatgagtgatataaaaaagatcagaaattttgatatgtacaaaaaattaaaatatttttaaataaaatgaaaaagtattgtaatacaataaaacaaaataaataattgtgtctggaattgcaaatcgaaatgctctaaacgatagaagtgggtttaaagtgatttggacaattgcagttagttgggtatgtgccattgtcaaatatttttcttcttgaagttacggattacggtttgcggaattttgggattttttccgtaattttgatccgtacctgggcttttggatttttttcgagacgatttcttgtaagattatttttttataaagggtttttgttaagttttacgtgttttgctccctaaaaatccttaataaaaaattttanatgccttttttcatgtctttttccggattttcgtgcctttttcatgcattttttt

SEQ ID NO: 34676 - DNA, 1347 bp, Heterodera glycines
  misc_feature (1321)..(1321): n is a, c, g, or t
  misc_feature (1338)..(1338): n is a, c, g, or t
aaagaatgatcggatgcagcgctagaggggactgaaagggacgcggaggatggggggggacggtgaagcaaaagacggaccaaaataacgggagaaagaatgggaggcgatagaatcaacgggtcgagcagacggggcgagaggatgaccggcacgaaagcccacggggaaaggatcacctgaacaacggggcgtataaaaggtggaaagggagcgggggggggcggcacagggcccaagacggcaggggcaaggatcagcggagagaaaatgattggagaaaggatgatcgggctcctgtcgaggaaggtctgaagacaaatgatcggattggaaggccaagcccaactcacgaggataaacggggaaaagctaatcggcgacagaatcaccgctctctttgatcgcgcgtggtgctgcgccttcgcgggcgctgacttccgcgtgattttaaatgattttatctgcgcgagcgaatgaatgtcgcgttcaatgtgctgctgaatcgtcgatcggttcaacgccaggaaccgtttgagcaccttaagctcaagcacttcttttggttcactaatttgtaagccacgagtttgactttctcgtcgtggaactccgagttgggcccgtacagcaaatccaactgctgcttggacaggagggcgaagcccgtcctgttcatgtctttgatctgctcactgcccatcaacttatgcaattgttcgaacacttcgactttgctcacttcttttgggccaaagccatcgctgaaaatgctaaactattacaaacgattgccactttttttggcactgtttttcattcactttggcactttttccctttttccatctccccaatggtcgaccttatgttttgtttggtaaagtacaacggagtgccctctttggtgcgtatctcgcgctcgtatcgctccctgtcgtaatgcttttcccacaccgttttcaatgggttttcccccggggccgtcacattcgtttcctgaaattgtccaccgccatgagaattcattcattcattcgctcgttcatttcttttcttaccgcctcaattttctcggcattttccaccactcccgacgcctccataataaagtccatccaaagctgttggtctttggcactaaagccaaatggtcccccgatattttgtatcatattcggaaggcttgtcaaattctaaggaaggatcaattaaaacaattcaaaagtcattccttcactcggttcacctcaattcccgtgcccgaatttatgtacgaaaaaagcgaaggcgacagaaaatcgatctgaccaaggaatangggaaatgtataattangagcgagcg

SEQ ID NO: 34677 - DNA, 248 bp, Heterodera glycines
cctcatcgcatgttgtggcgacaccccacctcctccccaatttcgcatcatgcgttgtgggcaaccgcatcgcatgttgtggcgacaccccacctcctccccaatttcgcatcatgcgttgtgggcaaccgcatcgcatgttgtggcccaccccaatttcgcatcatgcgttgtgggcaaccgcatcgcatgttgtggccccctcccccgatttcgcagcatgcgttgtgggcaaccgcatcgcatgt

SEQ ID NO: 34678 - DNA, 951 bp, Heterodera glycines
aaaatttagcctattaaaatatttagaaacttttttattatattttttattttttgaaaaatttccgatttccgacgtttttggggtcgaaattccgatttccgaaaattttttgatccccgaaattccgatttgcgaaaatttttggggcctcggaatgccatccctggtggctggggaagctccaatattttcataataattaaaaaaaaattattttgctaattttcaggtggttatacacttggccaatggttataagactgccgatttcacctggttctttgatgggctgaagaaagctggtggcagttttgacgttattggcatctcacattatccgagctcgtcaaattggaaaaccctagacgcacaggccgaaacaacactgaaaactatgatcagtcggtacggtagacgactgttttgtagtttaaaaaattctgagatttattggaggttcggttcaaatttttgtaatctaggatatttaaagtttgctctttaaaaatgggtaattcttaaaagagaaattcaaaactcccacagctttaaaaattttaacataaaattaggcaatttttcaaattttcataacaaattatcaaaaatatatgtaattttcagcggccctttttgttaggcctcaatatagccactttctaaaagccgaactttgccattttaacagatatggcaaaaaggtggtggtggccgagattggcttatcatggaacgagccaagtgccagcaaatccatgcttgacgacatgttcaagcgggtgaaagcattggggaacaacggcattggcattttctattgggagccgcaggcgtcgccaggctggaaccattaccagtggggcgcgttggacaattcgggcaaatttacggccgcaatggaatcattcaaaacaactgaagaatgattattgttggcatgggtttttt

SEQ ID NO: 34679 - DNA, 1022 bp, Heterodera glycines
tgggaattgaacccaggacctctcgcacccgaagcgacatcttacgactagaccaatcacccagttgacagagtggttttatttctcaactaaagtaaataattttttcgccgtttttcttcaaatattcagaagagaatctattggaccaacgatttataacatttattaattgattagtttagctaaatgtttatgaaaataaattgaaatagtttttttttggtagaaaaagaaaatgtaaatctgccgaattttcgttgtaaaattaatcattttcgattggatcaaaacattaaataattgcttttggcatactaactgtgtccatcaaggattgaagccattttaggttccggatttccgaaattttttggactggtacgaaatgcaattgccaattttgggcgaggacctaggaatcggatttccggaatttgtctttttgcttaaaatttcgatttttttgattcggttctcatccccaattgtcctccaatcacctcataaatgccgtcctcctccttgatgatgttggtgttctgattactggcaaatgcataaaaaatgacatttccgccgagttgggacaacacggccaaagtgacgagcaccgccgcaacacaagtgcaaagacttagggagagattggtgatatatatttctttgatatttaacattttttatggcactattaaatttcgacgctaaaatttaaaaattatgaaaatattttaattgtttttaatttttgtatgatcaaatggcgaacattttgtgtgcacattacaaaggctaaaattatttgaaaatatgactgatttagcccagtttaatcaggtcaataataatcttggtcaaaaaaaaataaataaataattggtttttgtattcagtttggttttttaaatttccatctaattattttggtatttttccgttttggggccaacgtttaatttttttaaatcaacagcgggcgcatagaattgctaaagctacgcgccaaaattatttcggag

SEQ ID NO: 34680 - DNA, 1543 bp, Heterodera glycines
ttagataaaaattgaaaatgttttgttaattgttgactttttatgcttttttatggaaaactataataaaatagaaaatataaataataaaaaatttcaaatttaaataatgccatactacatgtgctaaataattaattgatctagaataaaacaaaaaagctacacaaactcacaaatattaaagcataaatataaaccaaaaattaaaattttacatttaaaaaacaataattgtgatcttaaaaaatatatttttcgactaagatagatttatggcaagagaattgaaaataattaaaaaatttaggcttaaatgaaaggaataataataattttctaaaagaaaaaatgttgtaatatttcttatacaacaatttaaattttgtaattgaataccttttgtcctctaagtcaacaatttttaattatttcttaaacatatttaataattatccctttgctccaggaacatgcttcacacaattaccatacattaaaaagaagaggaagtcgatagagatcttattaaaatagaaggtaaaataaaaaaaatagatgcgatttcataaaaataagattgctaagccacaaaacttttcatatttacatttcctgaggtttggaaagatttttagaaaaaattaaaaatttcaccgaataaaatacttttgaaggtaaaactttaaatataaatatcgttaataaagaaaaataatactcctgacatcttttaaaagaaaaaaatcgattttattttcacttattcaataaattaaaagtcatttattatataaacaatttaaactaatacaacccaaaagtcaaacatataatcttattttttatcattgaaaaattctttaaaaatcatattccatttctactaataaaagaaataataattcaattgatattatttctaattattgttcatgcatgagtttttacatattaatattaaaaattatacaaacaaataattaaaacacggaataaacaaaatttattttggttattcaacatattttatgaattatttgatttattcaaagttaatgtccatattttaattgaaagaatttatttttattataaaacttgcaatctaaaagctatgaaacgggtaaacacatgaaattaattagacgataatgcgatacatactttatgaataattaaatataactttatagatcaattaatgcatttaatttcaccaattttttgaaaccagcacagtttcctcagcaagattaaaaaatgcccattatttttacttatataaacacattatattgtgaaataattaatacaaatatatcgactaaaatttcattgtttattatctaaaaggttaaattccataattctaaattaattttaattattaatttattattacttttaaaacgcaaaataataactcgcttatataaattatacaaaattacatttcagaaaaaaatttaataataattgcaccaaagcaaaaaatgattagacattagggaaagaagaaattaatcaagtaaatgtataa

SEQ ID NO: 34681 - DNA, 973 bp, Heterodera glycines
  misc_feature (25)..(25): n is a, c, g, or t
ctcaaagacccgaaagtgcttttgnccggcttccgcaatccccaccccttagaacacaaaattttgatccgtgtccatacaaatcctgaaacaacgccaatgtaagctttgaaccaatgccattgagcatttggtggctgagttttcatttttggaacagcgatttcgagacgcgataagtgaaaaacgggaagaatgatcaaattgtttactgtttacagaactcattcttttattcatttttcaataaataaataaaagtaaaacgaacaaaaaaaaagttttttgaaattttttgagacaattaaccgtttttatgaatgtgatgaaaatgatttggtgtgttttggaattcaaaagtttttttccatttggtcatttgaaatcgaactaagcctaagccctacttctgctttcacgagttgttgctgtggtggcacacacgctgtgtgccaataccgctatgaaagtaaaaaatgtttttttcaaaattttattttatttttttgcgaaaattcttttaaaaatgaaagttataaaaaagaaattcaagcactattttctataagtagaaaataaaattttgatgtatttatcattggcaaatttaattggcatggcattgaaagtatgctggttagacgggttcgttaccatttttactattttataaatttatttggcaaaaatatggattattcgtttttcatcttctaaatttactaaaaattctgaccaaataataataattcttacattttcccattaaaaatgaagccaaaactgtgctcccaaatgaattgatttatattttaaataaactggcaaacaaataattgatagtagaacagtgaaatagtcagcccaaattaaaatctattatttttttttatctgttggaatcagggctggacgtaattacggattacgtattacggattacggaaattacggcctttttggagttacggat

SEQ ID NO: 34682 - DNA, 1120 bp, Heterodera glycines
caaaaataaataaataaatcgatcttccaagagcacaaacgttattttaaattagaatcgactcactctcgaccgaataaatattttctttcattttatatcccttataaaatgctatttttagaaacgatttccgaagtattcgaataggtaaaatttaaaaaaatctctggcaaggctatcgaaagtgatgaactaataaatgtgattatattaaaataatcaaattgcagcatataatttgattgatcagcaaaaaaaaaacagcaaaaaattgaatggtctgtaataaattcgttatgcaaatgtataaaatacaaataatcgccccaatttggcattgagtcaatcaacattttaaattacaaatcacaatcactttggaattaataatcgatcggtccaacaacaaaaacaatagccaaaaccatcccccgatcacccatccgatcaaaacaatcagaaaaaattgaagaattaaaaaattgtgctaaaaggaaaagtttagaacaatcggataaaactttattagttatcaatcattcatcattcaatggtccccatttgcaattagagcagttcctccctccctccgtcagtcattcagtcctccgtctccgagtcggtgccctccgtgtagtcgtccgtcgacacgggctcgtcatccttgtccacctgcgcctcgtcctccgtgtcctcgtatttgacgggcggtggctcgcgtgccgggtgcacttccatctgcggacggagggaaaaggatgatgggattcaaaataagaatttaggaagcgaaaaaatcgggtaaaaaccctttaaaaaatgttttgctatttaaaggttcattagcagagttaaaaaaaactgaacagccattagagggctttgaaatatgtaaaaattagtcaaactaaccattcaacacccaaaaaattatattatttttgagagtagaaagagaattttaaatttggttttgaaaaaaagaaactgatgaacgcggaccggatttcccatttttggactctacgaatcctatcctctgcccaccttgacgtccacggagtagtccatgtccatgtaggagtcggaacggatgtgcagcggaagaagtagtgcc

SEQ ID NO: 34683 - DNA, 919 bp, Heterodera glycines
tagtgatgttcgagaccgaaaatttcccgagactcgagaccgagacccaaaaagcacgagactgggcactacacgaatatgacatctattttaagcagatttcgagtcgataacccgaacttgaataaaaatcgaaaattcaagtttctcgttcaaaatctttgttcaattttagctagaagtcggaattgattaaaacaaaatgtcatgctcgtgatctaaaaaaccctccgggaacaaatttttattttttatttggcgaccgggaaaatgcgtcagtttagtcagtttatcactgaatcagtgtatttattgaaaacgagatatgtgtatattataatagttagaaattttaagcgatatgggaacgaacttacagcaacccatttaccagaatattacattttatggtttttgaatttttttaaatttattaaagtctatgagtttcctaaaaacggaattgttaaattcagaattaggttcctaaacaattttaacccttttattatgccaacaatagattcatatcattttatagtttatttttatttttaaaaatttacacattttctaaactctgttttgttgatattttcacattgttatacatatatacgcagaagatcatttttggatttcttcgtgtttctatttgttatattttttggataaatttggtgaaaaaaaatttaacagaaacatatattttaatgcgtaattagctaattgtttaattaaagacggtttgaaaatttacattcactaaaagtttcaaaaaagaagcaaaaacactaaaaaaacatttaaaaaaatataaaaatttgtatgaattttgcaaaatgttcatcatttagggatgcgatttttaggcaaatgcctaaaatttctacgtacttaatacgcacagataagcacg

SEQ ID NO: 34684 - DNA, 737 bp, Heterodera glycines
agtgtcagcaatcgtcgtcgtgtccccgtccgtcccgctgctgtttcttctgctgatgctgtcccattacagcaaaggaggagccccacatttgtgtgtttggggcggaacacacaacaaacagcccctttggggacagcagcaggacaaaccccggaggggaaagcgggcaaagagtgtgtgttcctatgagacaagagggtgtgaaaggaatggggagagagttgtgggcatgaagtgaagagcgaagatcgcaccaagacggacagagtgcagcgtatagagtggaaagagacacggggtgggagacgggcagagcgagtgagagtttggctttacagcggaatgtaaatcacagaacagatgggcagagtgcggtggagagaatgtgcagcgggataaaaccaaccggatagagaaacaaaggactgagaaagtatcgaaaggcatgcggtaggggtgtgagggcaatcaaagagagttgagccaaggaagagggttgtcgagacggacagagtgcggaggtagggaatgttgtggaagaaaaaggtgggggcaagagattatttagtaacgtgatactgtttggcggccaggggtgtgagagccgagaaagttcagtgcgagcagagagcacccgagacggacagagtgccgcactgtggtgagccaatgggcggaagaatgtgctttgcatacataaaaagacatggcgagggccggagcggggggggggg

SEQ ID NO: 34685 - DNA, 939 bp, Heterodera glycines
  misc_feature (492)..(492): n is a, c, g, or t
tttttgctaattgagcagaagcataccaaactttgcagggatactccccggtaaaggactaacttacactgaaatgagcgccgagctagcttgctctaaaaaatttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagnccggatctttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaactgacacttgaaaaaatcgatttttttgttt

SEQ ID NO: 34686 - DNA, 497 bp, Heterodera glycines
gttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccgaaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagtctgtactttaattctgcgttggatttttgctcccccataaatgttttgattaccccaaacgggacactttgaaaaaatcgatttttttt

SEQ ID NO: 34687 - DNA, 718 bp, Heterodera glycines
tgtatgcatctctctctctttctcttctctccctcccttgctatctctctctctctctctctgtctctctattcttgccgatctgggctctctctctttctagccgatctgtgctctctctctaatctctctctctctcttcccgagtttgttctagcgcctctgacggtgtgtcccatccctttttgtggttcaactgctgatttgtgagcacagcgagaacagccgactttcgtcgcggctctcatatttcaagtgttcaacccctctgctgaacagaagttgaggaagtgaaagaaagaacactcactcatccgctgatcggaggacaaaaaaaaaggacaccgatcaattgggaagtgatcggaagggatcaatttttcaaaattttcactatgagacgattcttttggggaggcataagtgcagggatggtatcgtccgaagtcggtttccaaggacgggtatgccgatttgcaaggacatagtggggaaaattcatgaaattcaaggacatttaaaatttttattatatgcaatgcaaaatggttaatatttattcaaatggatttttcaccggaattgattttttccaacacttttttgttttcacttatcattttcttcatttacgacgacttttttctgctttaaaaacgctttttttgtggcgcgctttttccaaaaattttgtgggacagagggggggggggggggg

SEQ ID NO: 34688 - DNA, 917 bp, Heterodera glycines
gcctgcaggtcgtaattttaaacaataattttggggttgttcagtggtgttggacatttggtgttgaaatgcttttggtcattgtctttgcatgtggcgcccattggcaatttaattggatgcctaattgggccaatttacacagaaaagtatgggcgaaggggtgagaatgcattaataattttagttttcctaataattataatatttttaaatgaaattttataatttgagaattaattaaaaagtcaaaaatttccattttccttcattttaaataaagaattttttattaataatctatttaaattaattgctcatttttcaaaattccatttttaatatttttcctaatttttttgaaacgaaacaaaaactattttctgattttaaattgcactttcattattttaatattttaaattttctttaataaattatctttttatttcttccacatttttcaaatgttttaaatctaaattttatttaatttattttttggctcccttctgttggccaatctgtacagcttggttggctcgctgatctccattgtgtccatcatttttgagtttcccgaactgctcattctcgcccgacttgtcgcatcggcaagtgccaccgttggactgttggcattggtcctgttcctccaggtcattaggcaaaattcacccgtgattggaaactgcgtcggaaattttggaaattttaatacttgtttataaaattgagtaaattttcaaaaaaaaaattgaaatttttttttgcattttgggggctaggaattaaaagaaattcttcttctttttttttgtatttctctccaaatttaatcacaataattatcttttcctattgtacaatatatttgtatcgtcaatgtatgggtacggtacattgatttttatgct

SEQ ID NO: 34689 - DNA, 931 bp, Heterodera glycines
  misc_feature (73)..(73): n is a, c, g, or t
  misc_feature (90)..(91): n is a, c, g, or t
  misc_feature (100)..(100): n is a, c, g, or t
  misc_feature (103)..(103): n is a, c, g, or t
  misc_feature (105)..(105): n is a, c, g, or t
  misc_feature (109)..(109): n is a, c, g, or t
  misc_feature (114)..(114): n is a, c, g, or t
  misc_feature (120)..(121): n is a, c, g, or t
  misc_feature (123)..(123): n is a, c, g, or t
  misc_feature (126)..(126): n is a, c, g, or t
  misc_feature (132)..(132): n is a, c, g, or t
  misc_feature (137)..(138): n is a, c, g, or t
  misc_feature (140)..(140): n is a, c, g, or t
  misc_feature (142)..(142): n is a, c, g, or t
  misc_feature (156)..(156): n is a, c, g, or t
  misc_feature (159)..(159): n is a, c, g, or t
  misc_feature (175)..(175): n is a, c, g, or t
  misc_feature (179)..(179): n is a, c, g, or t
  misc_feature (186)..(186): n is a, c, g, or t
  misc_feature (189)..(189): n is a, c, g, or t
  misc_feature (193)..(193): n is a, c, g, or t
  misc_feature (195)..(196): n is a, c, g, or t
  misc_feature (211)..(211): n is a, c, g, or t
  misc_feature (218)..(218): n is a, c, g, or t
  misc_feature (224)..(226): n is a, c, g, or t
  misc_feature (231)..(231): n is a, c, g, or t
  misc_feature (234)..(234): n is a, c, g, or t
  misc_feature (273)..(274): n is a, c, g, or t
  misc_feature (306)..(306): n is a, c, g, or t
  misc_feature (324)..(324): n is a, c, g, or t
  misc_feature (334)..(334): n is a, c, g, or t
  misc_feature (355)..(355): n is a, c, g, or t
  misc_feature (378)..(378): n is a, c, g, or t
  misc_feature (395)..(395): n is a, c, g, or t
  misc_feature (398)..(398): n is a, c, g, or t
  misc_feature (401)..(401): n is a, c, g, or t
  misc_feature (404)..(404): n is a, c, g, or t
  misc_feature (419)..(420): n is a, c, g, or t
  misc_feature (426)..(426): n is a, c, g, or t
  misc_feature (428)..(429): n is a, c, g, or t
  misc_feature (441)..(441): n is a, c, g, or t
  misc_feature (447)..(447): n is a, c, g, or t
  misc_feature (454)..(454): n is a, c, g, or t
  misc_feature (460)..(460): n is a, c, g, or t
  misc_feature (480)..(480): n is a, c, g, or t
  misc_feature (504)..(504): n is a, c, g, or t
  misc_feature (517)..(517): n is a, c, g, or t
  misc_feature (519)..(519): n is a, c, g, or t
  misc_feature (521)..(521): n is a, c, g, or t
  misc_feature (527)..(528): n is a, c, g, or t
  misc_feature (535)..(535): n is a, c, g, or t
  misc_feature (542)..(543): n is a, c, g, or t
  misc_feature (549)..(549): n is a, c, g, or t
  misc_feature (554)..(554): n is a, c, g, or t
  misc_feature (560)..(560): n is a, c, g, or t
ctgcgattcttcctcccccccccctcattttccgtccccctcatgggttgtcgggacgattttctttgatgtnggaccctggaagatttnntgaatgtgntgnanaatnagatnaatggnnangtngttttntggtnntngnggaatgattatgtnggngtattttttggtgggnaggnaaaagtnttngtangnnttaaaggggaggganagaggtngttttnnngaaanatntttttttttaatatgagtagaaattaggtagttattttnngaatttttaaaattggggttttttaagaaatnattataattatttgtttnaatttttttnaaaaattttggtgaaaaaaanttggaatttgggaatttttattnattgttagttgtttttnttnatnagnagataatagaatgannggtttnannaaggaaaggtantggtgnaaataanattggnattttgtttgtttttttttngtaaaatggttttgtgtttttgtngaattttggtggnantnaaaaanntttaatnggagaanntttttntagantatttntaaaatgggtggtttagtaaaaaaaatggacattcactaaaattgttctgacctcgtcgtgccaaacgaatgtccgggtccgcgtcgacaaaactgaacaaaaaatgccattttagctgattcaaacaattggttaattaatttaattacagtttcaagtcgaacatttccctcaattcctaaagtgaaattggcgcagtgagcagagaaaactgattaaaaatggtgtgaaaatacaattatgaacattggttagacaacttgcctggtcaaagaaaatcagaataccctccaccaaaatgacatcggccgcttccaaacggtgcgacgcatcgtcgagactgaaagggggaaggatttcagtacggaaa

SEQ ID NO: 34690 - DNA, 613 bp, Heterodera glycines
atcaggggtggcacggaatttcgatttccgacatttttagggtcggaattcccatttccgactcccgaaaaaattttggacgtcggaattccgatttccggtgtttttgataaaaagtcggaaattttcggtcggcaatttctttttttttgatttttctaaaatggtttattttaaattgtgaaagaattaaatttttgtaagttcttttttcttcatttttactccaaaatgaaactcagaagcattggacatttttggacgatgttcacaaaatgagcaaaatttccccggcggcgcctatcggcatcgccggatcccctctccccaagttcccaaatttttttttgaaaaaagcgccgaaaaaagcgtgtgaataatccctcattttttaatttttggtttagaaatttaaaattttgccataaaatatttagatttttcaattacatttttatattttttcataaatttccgacttccggtttcctacatttttggggtcagttccgatttctgaaaaaatttttgggcctcggaattccgtttccgatttgcgaaattttttggggcctcgtaatgacatccctgtttacatatatagaagagtctc

SEQ ID NO: 34691 - DNA, 1168 bp, Heterodera glycines
cctattttttttccttttcacaaagagattttaataaaaaaggcaaaattcgccttaaattaataaggtgaaagtttgaaaatgtttattaaaaaatgtaaggatgaaatataattaaaataaatcaacaagaaaaaaaaatttatttttctaaataaataaaaaacattgtcagaggcagtgcctgccgaaaaaaagacaaaaaatttttcgaaaaaaagctaaaaaaattgaaaatttaaataaatttacaagtgaaaaaaggaaaaaaagcttacaacaccttcgattcccaggacgtctccgttccaagtactaagaaggcccaacgttgcttaacttgccagacggacgggatggcgtgctttcaacgtggtatggtcgtaagcgaaaggaaagcaatgaaagtaatttaaataggcatatttaaaagagcctatttttttgccttttcacaagagaatttattaaaaaaggcaaaattcgccttaaattaataaggtgaaagtttgaaaatgtttattaaaaaatttaaggatgaaatataattaaaataaatcaaaaagaaaaaaaatcaatttatttttctaaataaataaaaaacattgtcagaggcagtgcctgccgaaaaaaagacaaaaaaattttcgaaaaaaagctaaaaaaattgaaaatttaaataaatttacaagtgaaaaaaggaaaaaagcttacaacaccttcgattcccaggacgtctccgttccaagtactaagaaggcccaacgttgcttaacttgccagacggacgggatggcgtgctttcaacgtggtatggtcgtaagcgaaaggaaagcaatgaaagtaatttaaataggcatatttaaaagagcctatttttttgccttttcacaagagaatttattaaaaaagcaaatttgccttaaattaataaggtgaaagtttgaaaatgtttattaaaaaatttaaggatgaaatataattaaaataaatcaacaagaaaaaaaaatttatttttctaaataaataaaaaacattgtcagaggcagtgcctgccgaaaaaaagacaaaaaaattttcgaaaaaagctaaaaaaattgaaaatttaaataaatttacaagtgaaaaaggaaaaaagcttacaacaccttcgattcccaggacgtct

SEQ ID NO: 34692 - DNA, 174 bp, Heterodera glycines
aggacattttaaacaaaaaacttgaaaaaaatagaccaaaagttcaaaaaatttaaaaaattgttctcttttaaagtagcgccgatttttttacaatcaatttgccaagaaaaaaaatatacctaattataaactcgccttacaaattataaaccctgggtctgtatcgtttcg

SEQ ID NO: 34693 - DNA, 1359 bp, Heterodera glycines
tggcatacaattttcataaaaccataaattttaagtgccctttaatttgaaagttcgactcaaaaaccaatataccgtattatctctaattatggaatctttattttttcgaaaaaatttctttttaatgttttaataaaattaattaattcaaatctaaactcattatattaaaaaaaagaagtttttaaaaattgtgaaattttgatttcaaaatttattaaaattaaaaaagtaaaatttttaggaattctaatccacctgcaatttccgcaaacgggccttgcgcaagcgcttgcccaccgtggcgggtgttttggcggcggtgttggcattcgtggacgatttggcagaaaatggctaaattttagaaaaataaatgagaaaattcatataggtaaccctttaggtaattgaaatagtcagggaaaattttccaatttatattgtataaagccggtattttacattaaaaaataataattttttttttactctaatctactcaaaatggttcagaatttaataaaaataccattcacggtgccaaaaatgagaaatggaaagatttttttgccatatcaaatttaaaagttgaaatatataaaaaataaataaattgaaaaaaattcccagttaaaaattcaatttttttttttgttaccttatggtccatgggggagggcgactttgcttcaccactttttgctttgccgaacaaatccttcacaatggcatcaatagctttctgtgaaaaaaaaataaaatttaaaaaattaataaaaattatgtttatttaagaaataatcaaaataaatttatgaaaattaaaatttttttttttcaatttccaaccgatgtaagtccattgcggcgtaatgcggcggggattggttgccgcttggagagcaaataaaagcgggtgtcctccaaaaaggtgcaaggccttgaaaagagttcagaatccttctgaaaattaaaaaaaaaaatttaaaaattattaggtgatatcggtcgaatgagaaaattctctttttctcaccctcctccatattggaatttttttcggcttctgttccacattgacaagctctgcgaataaatgaaaatattaattttttatagaaaaaaatcctataaatttctttaaattttttttttatcacacaatgaaataaacaaattttatttttggtaaaaaattaattcagtcatttttaaattgaaaaaatgtcaacattaaaacgggacccacgcgtttcagcgccagtccagtaggtggactataacttttttctttgttaaccaaatctatacgaaatggtggtatcattcgaaagccttaatttcctctattag

SEQ ID NO: 34694 - DNA, 709 bp, Heterodera glycines
aagctttcgaatgataccaaaattgtccaatttggttggcaaaaacctcttaaaacaattctcaaaaacggcattttttagttttttggacaaaaataaataaaaatattcatgttgcacaacggactcgaaccttcttcctttgtcccttcactatcttacaaaaaccactgagccacacgcaaaactttttcggtacagtagctcagttttggacgctgtgttcactaattgtctgtgattgaatccctaaccaaaaataaagcatctatctaaatccatttcaaagcacttaaatatattttttagcgtttatttgttagtatcagtggaaaatgggaagcaacggcaatccggaggaggatttaattaacttaacagacaaattaaagaaaaaactcgcaaagcatggagaagacgaagaagaagaagccaaactgaaacgaagaaaatcgaaaaaagggattttcgatagaacaattcaaaaaggtataaagcaattcttctaacttcaccaattgaaaatcataattttttgagtctgatttaatacatacataataacaataaattgtcaagctcattatctgcatcattcgtttttaagaaagcaaaagaaaaatgaagataaacgatcaggaaagtatttgcggtgaaattgtggctcaagaaagtggcgaaaacactgcaaatcaacagaatcagactc

SEQ ID NO: 34695 - DNA, 911 bp, Heterodera glycines
aatagtagaccctctattccaaaggaaattgggtagcaaattttgtgctctataaactgggcatactcaaaatttccagaaaaaattttcccaacccccttagaaaattttttttgaaatttacccctcgttcccagccaaaatgggctgatcagatcaccatgaaggagtgatctgatcaacttggtgttgctaccttttttgatcagcatccaaagttatgcttacctgaatttttttagatttttttaatgctgatccagagaagcaatattttaaaaatgaaatgggacaacacttttgaccacctatattttgatcaaattgtgaatatggtaaaataaatcaaataaatgtttatgtcacaaatgcaaatatggtatcattggaaagcccataaaaaatgctatccaatggtatgtagtagggttgagcggtaccggtaccggtactggccggtaattaccggtttttttggtaccggtaccggttttttcaaaaatgaaattaccgttaccggtttgtctagtaccggtaccccggtaaaaatttgcactggtaagaatgggggtctggtcgagaaaagagtaggaaattggtgaaaaaggagaaatttttgagaaaaaattaaattttatttaatttagtcatgggattacacacatgcacatgtggtgtgtggttaaactttctacccttcataatttttcgcctgggttcaattccccacttggatagaatattcctcacattttctttaccattattttaattaaaattttaattttaaaaaatattccaacttttttctttcattttaagcatcctaaaaacccaaaacttaatcaattggtcattttttttacaaattctgttaacaaatcgcattaaaaattacaaaatttttcccg

SEQ ID NO: 34696 - DNA, 1020 bp, Heterodera glycines
ccccccccccaccttaatggactgtccggttccggacgaacaattgatgtttgaatggcaccttcaaaaatgctacctccatcatctgaaaaaacagtgtttaagaaatataaatatatacggtagaaagtgatttagataattccattttatattaatttatgtctttaaaaactgaaaattcagattttagtttcccgctactatttctttttttaagtttctctatagccaaactttttgagattttttcttttaatcaaaaaatcacaataaaagggatgacatcacgttttcccccgtggaatgtttccccgaaaaaaattataatttagaaaaatttttagaaatcgttgaaaaaaagtggggaaatgaactgatcccaaatgaaaagtcgtctctacccaaaatgcgcaagttttccaggttcaatccgatttcttgtgagtccaccgagaacagcacgttcatttgccggtcgacaacttcaaaccgttcgcacatcacattggcacgcccgtccgcctgcaggttcaggctggcggtgttctgtccgctggcgttgtgcgcgttgatagatacgccgcgagcggagtcaatggacaatgcctgattttaccgcaaggggtaattagggcattgaaattaagaacaagtgcagagagttttttttttgttggaatatttgcatttgatttaccattaaaaatgccattgccaacatttgccaaaatttttaaattttcataagatgaaccattttcagcacaattataaaaaaattaattaattactagttttcattgttgaccaaatctaacaatcttggtatcatccgaaagcccttcacaagctctattagccttacaaaaaaacaaaaaaaaattagcttataaaaaagttattaagaaaaaactcaaaaatttcgtcttttttgcaattttcatgttataacttttttggtaattgtctaatcgctaagcaatagcttggaagcttctaaacatgtaaagctttcga

SEQ ID NO: 34697 - DNA, 384 bp, Heterodera glycines
ggattgatggagggagatgaaaatggcactcgatattcggtgaagaggtaaattctgaaagaagtgaaggatggatgaattcggaggaattggagaaacggacggacggagggacaaaggaaaaaaggggggggggggtaagaggggagagaggaggggaaaggcctttgtgactttgtttgagacaaattggaattgagaagggacctaaaaaaggctgaccgcggcacggcaccgaaccgcgacaaatggcacttttttgaaaatagttcaaaattcactcagtttttgctatatttacagcgaacaaaggtgcttgcttcttcacattgcttctcgtctccccctttccgattttagcttccgtttcctttgcttttgacc

SEQ ID NO: 34698 - DNA, 1285 bp, Heterodera glycines
ccattaggtcgtccgttagcgttcgattgctctagtcaatttttcaaaattttttgttgatatatttgtcgtgctctgaagggcgtgggaggggggggggcgaagggcccaccacgaggccgcgaagaggccgagtgagtaccttcggtgcaggaaaattattaaattttaaaatttattaattgctttttaaatatgccaaaaaatgtaggcttaacttttgtagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactatgatgctttttctatcaataatggaggtgaataaaattttaattgctttttaactttgggaaaaagtttaggcttaactttttagtgaaagtttgatcactcatatttttttagtctaatcttctcaaaacggttcagaattcaataaaaataacattcacggtgcgaaaaatggggtttgacaagtttattggggaaaaaaacactttacaaaataatacccctgggagaagggagtgggaaacatgatttcaaaattttcaattttttgtagtctaatcttctcaaaacggttgagaattcaataaaaataacattcacggtgcgaaaaatggggtatgaaaagtttattggggaaaaaaagactctttacaaaataatacccctgggagaagggagtgggaaaaatgatttcaaaattttcaattttttgtactctaatctactcaaagcggttcagaattcaatttaaataacattcacggtgcgaaaaatggggtatgaaaagttaattggggaaaaaaagactttttacaaaataatacccctgggagaagggagtgggaaacatgatttcaaaattttcaattttttgtagtctaatctactcaaaccggttcagaattcaataaaaataacattcacggtgcgaaaaatggggtatgaaaagtttattggggaaaaaaagactttttacaaaataatacccctgggagaagggagtgggaaacatgatttcaaaattttcaattttttctagtctaatcttctcaaaaccggttgagaattcaataaaaataacattcacggtgcgaaaa

SEQ ID NO: 34699 - DNA, 874 bp, Heterodera glycines
  misc_feature (72)..(72): n is a, c, g, or t
ggggacctctagagtcttcctcaccaatccttcgtggccaatttttttctcttccttaaatttgcgcaccgnccaataggctttcatcaattgttcttaaatttcgtccagctgctctttatgcttcatcttctgctgctgatatttctgctgatcatcgctgttgcgcttcatctccaaaaagaaaccaaaatttcaaacgaaacataattaaataaactggcgaattgattgatgtttgataaaataaaatttttgcactcctgacttatgctttggtttttttaaacggttgaaccctgatatgaaaaaggtagagctcggcctggtcctggatgcaggcctggatttttcctggatccagttcaggtccaggccatttttcggcaacctggatttttcctcgatttttgtccaggaaatccaggtcaaatgtgaaaaaaaatccaggtccaacatggcatccaggttcaggtccaggcttttttcaaaataccgagctctagaaaaaggcataagaaagtgaggatgaagttggttcaatgacgtctgagtttttgaaccggttcagaacactaatggactaaatttggcacttctagatttttaaaacgatcgtccctgtcaaatttaatatgagtagggcttatattatataaggcccgaaaaattgccaaaataggtagtgaatttatgtgaaatttttcacttcttagggttgtatttttgaaagttttaaagacgattcttaggattttattgtatttttgttaataaaaacataacgccaaaataggcagtttaaactttttttaggcttttaaatagggttcggaccccgtgggccgggggtggattttcccgggggcggggg

SEQ ID NO: 34700 - DNA, 1420 bp, Heterodera glycines
atgacaagctaatgtgataaaacaggttaattcttttcctttcagtatccctgcaaagtttggggcgcttctgataagtttctgaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttttaaatgagaattcatgcgagattttctggaaataagcttaatagggcctagttaagctgtaaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctattaaaaaaataaaatagtgaagttttaaaaattaataaaaatttttaaattaagagttactggcgttagcatcatagcggtgcttttccttgtctttttgatgcccttgcaaaatctggtgcgcttctgatcagtttaattaaaaaaagttaagcctaaactttttggcatgtttaaaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctgggaataagctta

SEQ ID NO: 34701 - DNA, 849 bp, Heterodera glycines
  misc_feature (789)..(789): n is a, c, g, or t
cctggattttcctggatttttgtccaggaaatctatgcccaggtctaatgtgaaaaatccaggtccaggcaaaacacaaaaaaaaacctggatttcatggacaaatttttagaattttattatttaaactgacctatgttttttcaagttttcagaaaattattaaatagattaaaaaacatatattattgtaaattaaatatttttaaaagtttgaaagcaattaattgattttttcaaacattgtttggctttttaaaacaaatttcaaaaaatccaggtccaagcctgaatccaggttcgaggagccttgatttcctggacttggatttttgtccaggaaatcagatccagatccaacacagaaccctggtacagatccaggctttttttcaaaatgtcgatctctattcattatgctcaaatataaccattatagcaagtgcaaaatagataaattaatattctaagattcacaataaatatatttaaaaaaaacaatatttgctgtaatgaaacaaatttaaagatttaaagtgtaaatcgctcatttaaaattctactaaacggctttcataattaaatgttgaaaattaataataaaaaataattatattttagatttatatttgttaatttaaatttaattgaaaaaaaaatatgaaaattataaatttcgaaatatatacagtttaatttattttttaaatttatccattgtagaaaatactttaaatttagcagaaattataaaaaatataacaattagaaccgaaaagttagaattanaatttttgtacatattttacaataaaaaatatcagaacactaggaaaaaaggattcttta

SEQ ID NO: 34702 - DNA, 1221 bp, Heterodera glycines
attttgcatatcatccttttctgttcgtaattttcccgttttaaattcgttaaattcggcatttgtcagattttgccattgtccgttttggtgcattaaaatttcttgcaaaatttcgctcaatttttcttcccaaatgattaaatcgttttgcctttccattttcattttgctgttttcctcccaaattgagattaaattttgtccaattttcgcttcatttccaattattttgcttgtttctttaagcatttgaattcgcttttcaatttcatttttgaatgcacacaaattgagaatgttcatggcatttggctgcatgttatgcaaaatttcatttttatatttttgaacaagcggctcattttcacacaaatctgatattatatatgataaattaattattaaatttcgctttacacttttttttacataaatatatcgtaaataataattatcattctatagaactctcactaaaagcagttaactgaaaattttccgatttttaagtgccaagggcacttgtacagaattttttttaaatgattacgaaaaaatcgacaaagatggcgcctgaattttcaacccaaactaaaaacatattttcaggatttttcatttagaaaaactaatttgcataaattgtgtaataattctaaatcttctaaaaaacttaagatcttaattatttttctgatttaacctgaaagtgttgcattgattacttttgcgcttattaattgcttttgtctttggctttgcctttttctttggctttctgttctttttctctcaattttgttccatttttcgtccatttcttcactttgtatgtcatattctgttttttggctaacatttgatgcttcttctccacttttattaacactttcatcaatactttctgaatttcctaactcatcaactttttctttttctattttctgatcacttttttctccctcactttttggctcttccattttctgcttgcttttttcttcctcaattttctgatcactattttctttttctattttctgatcacttttttctccctcactttttggctcttccattttctgcttgcttttttcttcctcaattttctgatcactattttctttttcaattttctgatcacttttttccccctcactttttggctcttccattttctgcttacttttttctttttcaattttctgatcatttttt

SEQ ID NO: 34703 - DNA, 1474 bp, Heterodera glycines
aaaataatgtacaccgcccggatccgaaccggcccccttccctcaaaatgatgcctcagaatccccaatcacacagggattctgaggtcttgactatgtcaaaagtaaaatctgatcacgtattcgtgatcagcgacccaaataacccctaaagacatatttttggaagatttttgtgagaaaaatttttccactcaaaaatcatggtcacacccctttgatcccgaatccaaaaatcacttttatttctataacttttttcaaaaaagtgataaaaagctaaaataaaatttatttggtagagcaaaaaattgcggatttttgttgtatattatttttacaaaatgacttttcagaaggtagttatgaatttttttctgaaaattcgaatttttccagaaattctggaataacttttttcctcttttagatagaaattccaaataaagtccataaaattctcctgatttttctctatttttaaggctttaaacctgtaaaattgatcaaccctttgatttgttatgaattttcaaatattaggccaaaatcccgtgggccaaaaaattgccaaaaaataaagaatttttaaaaaattccaaaaattatgaaacttaaaatagacatcatattcgtactcagcaccttattttaccccagaaaaatatttttcacccccattttcgtccgaaaaaaaatttccgaaaatttctagggggcctagctcgaaaatttttgaaaattttacatcatgtagtacaccattcgatagcatttaaaatgctctacaaaaatgttctaagacaatttttcgctaaaattaactcctgccgagttatgggactgggactgaaatgtcccgctcaggccaaaaattttttctatttccgggaaaaaatcgaaattttttcaaaaatatcaccaatcgatagagctcgaaaaacggttgcttcaaagtggtctccgttttccccggaaaaatcggcaaaaaatcataaaattcaaaaaccccaaaacctcttagggggcctagctcgagaaattttgaaaattttcgaaattttaaaatttgaaaaaatcgggcttacaaaactctacaataagtccgctggccaccccccgctcagttcaaacgctaatgagttattcgcccggtactgaagtggacaaagttggtactgaatttctagccaagtctacaagctttcctattataggtagaggcctggatttttttttgttttttagaaaacacttcaacttaggttcctaccagcagacattttttggttcaggttttaggaaaaaagttacgggccctgaactgtgagcaaaaacgggaaatcggcccctggtactcagttggccctcggagaaaaaaacctatagttttcccagatgcgccgtcccgagatgcctatgtgtgcaaaatttcagccccctagctattcccggtcttgagatatcctttttg

SEQ ID NO: 34704 - DNA, 739 bp, Heterodera glycines
atcaaagattctgaaaatttcaaaagacaagtcatggcatcccttgagacgaccataaaccaacaagctacttttgtatttgtgtcctttacataaaacaggatcaaaattaaatgtttgattccaatcttttcctgctaaatctgcgccataaaaataccatcaactttcttgtgaaaaaattcctgaatgaagagcttgcatttcaatacacctccatacaaagaaaagataaatgtttgttgttcagctttttcgtctttagagttgacaaagacagaaaagaatgttgatatcccattgtgtacttcttaagggatttcatgttctcaatttataattagaaaatcaataaatgataaaggatatcaaatgatctcttttcttctaaaatcccctattcgtctcctccagagatacaatcaagctcttcttaaatccccagttaagactaagatgacaaccgctggaactacatattttatcgcagataatatatgtcagcatttgattgaaaagaaatcaattcatgattattctttccaaagatcgtgtcgacaatccgctgtcggagcattctttgctgctccaagtcttcatatttggcactctttgcttcttcctcagatagttaagtctgtcgttggaagatttaaaaccgttttgctagctgtgttccttaatgaaactgttctggctagctactttattgccattctattgttttctttcgaggctc

SEQ ID NO: 34705 - DNA, 655 bp, Heterodera glycines
agaactgagtcccggtaattgtgttgctgaaggattgatgagattgagtccagtgatttgaattcgggagaattgagtcccagtgattgaaattctggtggattgagtcccagtgtcccaaggaacacaaaaagttaaaaatgctaaagaaatttgctgaggttgagtcccggcgattggaatgttggtgggttgagtatttttgattgaaacgcaggagaatagagtcccagtgattgaaatgctggagggttgagtcccagtgattgaaacgcagaagaattgagtcccagtgattgaatgctggaggattgagtcctgttgattggaatgttggtggattgagtcccagtgattgaaatgcttgagggttgagtcccagtgattgaaacgcaggagaattgagtcccagtgattgaaatgcagaagaattgagtcccagtgattgaatgctggaggattgagtcctgttgattggaatgttggtgggttgagtcccagtgattgaaatgctggtggattgagtcccgttgattggaatgttggtggattgagtcccagtgattggaatgctggtggattgagtcccgttgattggaatgttggtggattgagtcccaatgattgaaatgctggtggattgagtcccgttgat

SEQ ID NO: 34706 - DNA, 622 bp, Heterodera glycines
aaaatttcaaaaagttggttttctaaacatttttggccataaattttttgaaaccgaacgaaattttttgaaattttgcatgctaatagaggattcttagggctatcaaatgatagtaagaatgtttaatttggatgcttcttgaaaaagttatggtgcactaaagttgcaaaaaatttttatggtcgtgtgaactgtaatagcgccatttacagaccccatagaaatgcgaccgtaaccccaaccaccaccatacacactcccatacagtagtaactcctccccattcattaatttcagggcggctgctataatgggcactggtgttggtattgtctactacttcttatttctgtgctgttgttgtgccgtctgctgcattccgtgttacatctgttgctacgtgtatgtgtcaaatcaacgagaaaggcgtttcatgcgtcaaatgtcttcgcccacccgtggcggattcgatggacatatgccatgagagcattttggcatttggtgactgccggacggcacatttgtctaggaaagaaattgtggattttgaaatgcgaagtgaaaacggatagattaagattacggacgacaaaaagatttgataaatcatcatttg

SEQ ID NO: 34707 - DNA, 1088 bp, Heterodera glycines
gggcctcggaatgcctccctggtgtgtgcgtttcacatttattaaatttatgttgtttaaaaattttatttttatatcgacaaaatttttttaaagttcttccatgaacgttgatgtttattttttgaaaacttgaaaaaagcgatcattaatggtccattgtaatgtttttatgcaatgtcaaaaggtgtacgtgttttttacgcaaataaatttgcaaatttcatacaatgaataaatatgaattggttttgatcaatcagatcagtaattaagcagtatcggtgccaaatcaacgggtggtgcagcccaatcactgatttggggcacctcgaaatccaacccgagttcgcggacagtgtatttgtttcggcggttccgtcgtctttttttaaattgatttaatgtaatttatgtaattattaaaccgtacctgcggcggctgctgccccatccattgaacgacaacgaaggaacataatcataattgagtatcggcggaatgaccacctcggccgggacctccgttaaaacgagtggagtgcgattttgggtgggaaattggatggggtacaactcggagttggcacgacggtccgcgtgggcgtgggtcaggaaaacgccgaccaactcgtcactggtcaacacgccggaaggcactgaaaaaatgggaatttaaaaaaaacattttgttaaaatgatttgaaaaacgaagcatctgttgacggacgacctaccaacatggtcggagaaatccgaaaaagagatgagcggaaaacgaattttggacagtgccaggccaaggacaacacgacgattctctgccgaacattcgatggcattttgaaggcattgcgcgtcagcccaacggagtgcctgcgaaatgaatttcaattttaaatttgcatgataattcattagtaagtgccgaattccaaatggtgagttcgtcgtcgattttcaattggtcacgttcgagaatttcgcacaacaaaatttgttccatttccaaaaattcctcagattcaaacaaagtttcggcattttggtcaatgtaatccaagcagcgaagagcaaaatccttaaaa

SEQ ID NO: 34708 - DNA, 814 bp, Heterodera glycines
tataaagtgatagattttgaatgttatcaaaaaccatagagggggaccctattgttttgtaaaaaatttttttggataaaaatcgtgaaaatactttttattcaccataattgtgctattaatacttaattttcatcattatgtgtaaaaaaacaaaaaaaaattttgaccaaaaaaaagttgaaaaaattttcaaaacctgtcactttccatatagcgtcttattttctatatgcaattttttaaatttcagattgatgttgaaatattattgagacaagtcgagacggtaattcattttatattaactgcttttttatccataatttttacaaaaggttcgtgaaaaagtcgacgatgttgggacagcaaacaccgagaagcaattggtacaaacctaccgaaatttggaggtggaactgaaggagttgattgaaatgaccaaaaagcgagtccgggacgtcatagacccggcgatgcaagacgacatgcaggcggtcatttccgtgctgaacgcgaccacgccgataatgttcgcttcatcaatggtccgtgtcttcgccttttatttcttatccgctcccatttttaggcggtcgcttcacatcccaaactcgaaggcttatacataaaccgaaagtttgcagccgaagagatccatcgtgctctcggttgtctgaatgatgtgctccagagagagctaccgactgaagaccttgccatttcgcaacatggcggcatcaaccaactcgtcctcgacttcgacaaattccaagtgctcccatttcctcttgatttttttcgaatgcttttt

SEQ ID NO: 34709 - DNA, 907 bp, Heterodera glycines
ttttattgttgtaggctaatatttttttacttttgaccggtgctcgtttttcaaaaaattcaatgggaaactagggggtaggggggggtagaggtgggcaaattttgtttttgtttttttgaaaattctgtttgaaatttttgttattcatattttgcacaaaaattggtaggcaaagtcatgaaaacatttttttaggaattcctaatgagatttgctgtaaaaatgatacttgaaaaaattctccagccctcaaatttcagaaaaacctgaaaatttgtctactttgatttatttcattttttgattgcgcacgcttttcgcaaaaaattagctggcgaaacgagggggctggagatgacgacaggcaggcataggctgcaaatttttttttttttttttgtaaattctgtttgaaatttttgttcatcatattttgtcccaaaattggtaggcgtcgtcattaaaaaattacggaatttttaatgaaattgctgtaaaaaaataatttaaaaaaaaagttttgtcaaaccctcaaaattcagaaacacctaaaaaatcagaaatttttgtatttttcagaatgattttaccacaaattttttagcccatcacttacaaacactgcttgctcccaataaaatttagtttcatcatgaaaatcaaattttttattaaatttccttaaatgccataatttcttattaatattagaatatgtatttatcgtatttgctctaattatcccccatgggggattatttttcaacctcctcgtagactcggggataattggagaccgggggattaagatagaaggattattcttcaaacccctcctagactgggggataattggagattgggggattaatggaattggggggatattagagcaaatacggta

SEQ ID NO: 34710 - DNA, 949 bp, Heterodera glycines
  misc_feature (846)..(846): n is a, c, g, or t
  misc_feature (872)..(872): n is a, c, g, or t
aaaattcattgctttcattatgttaatacatgttacatgttacatgctcagagaggaaattcatgaactccctccgttttcatgtaacatattttgaagcgggtgcgaagcaccgaggccacgaagtgttcttacgagcaccacaaatttagaaatgggcgcgaagcgcccatcttagggcgtaaagctgcctacaaccccttaataacttttcaaaaattcattgctttcattatgttaatacatgttacatgttacatgctcagagaggaaattcatgaactccctccgttttcatgtaacatgtaacatattttgaagcgggcgcgaagcaccgaggccacgaagtgttcttacgagcaccacaaatttagaaatgggcgcgaagcgcccatcttagggcgtaaagctgcctacaaccccttaataacttttcaaaaattcattgctttcattatgttaatacatgttacatgttacatgctcagagaggaaattcatgaactccctccgttttcatgtaacatgtaacatattttgaagcgggcgcgaagcaccgaggccacgaagtgttcttacgagcaccacaaatttagaaatgggcgcgaagcgcccatcttagggcgtaaagctgcctacaaccccttaataacttttcaaaaattcattgctttcattatgttaatacatgttacatgttacatgctcagagaggaaattcatgagctccctccgttttcatgtaacatgtaacatattttgaagcgggcgcgaagcaccgaggccacgaagtgttcttacgagcccctcaaattttagaaatgagcgcgaagcgcccatctgtanggctggcagctgcctacaaccccttnataactttttcaaaattcattgctttcattatcgtgatacatggtacatgttacatgctcagagacgagattcatga

SEQ ID NO: 34711 - DNA, 1021 bp, Heterodera glycines
  misc_feature (20)..(20): n is a, c, g, or t
tgcaggtctacagggctatnagggaagctattcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaatttttttggataaaaattatttaaatgaactgactagataatatttaaaataggttattactcttcctttcagtatccctgcaaagtttggtgcgcttctgatcagtttctgaaaaaaaagttaagcctaaactttttggcctgtttaaaaaggaattaaaaattttattcatctccctttttgatagaaaaagcatcagagtgcctaaactaacctgtaaataaagttttgtgtgtttcagagcactttctgaaaaaatacttatgaattaattttgcaaaaaataaataattaatgaaaaagtcagaatttcgaaaaattttaaaaacaacaagcgttggcattttttcaggttaagttagtcctttacaatggagaaggcctgcaaaatttggagagattatatcgatgttagtgcgctaggttcgatgaaactttttaaaatataagcctaaactttttggcctgtttaaaaaggaattaaaaatttttaaaaattttattcatctcccttttgatagaaaaagcatcagagagccttatttaactttaaattaacatttggtgcgtttcagagcagtttctgaaaaaatatttatgaattaattttgctaaaaaaataaaatagtgaagctttaaaaataataaaaattttaaattcagaatactggagtagcatcatagcagtgcttttcttgtcttttgatgtctcgcaaaatctggttccttctgatcagtttataaaaaaaa

SEQ ID NO: 34712 - DNA, 1694 bp, Heterodera glycines
  misc_feature (1594)..(1594): n is a, c, g, or t
catgctaaaatagaagaatatttgtaatttttgttttacattagcttttccaaattttgaacaaaaggcgtgcgcccggccaaaattttgggccggaacagcgccgcgcggtaaaactggcttttttgcatcgggcggcacgggcgcggtcaattgtctatggccggtctcgggccgggtacttcaaaactccggtcttaaaaaattaatagaataattaattttgggctttgtcattaaaaatgaattaaaaaaacaactataatttgaaataaaatttaaagtcgttcttaataaatggccgtgggtgacacggagatccttacataattgttttttaagcataaaaaaatatttttttagtcggatgataaaaaaccaaaattaaaaaacattaattctcattaggtgctctttcccaattaatgatatgttgacaaaaaatctgcttacaatttgtgagcaaaactttcatgtgatttttgcatgagaatcccattttaataccaactgtttacgtcaaaataaaaaagccaaataaataattaacaaaaagtaaatatttaaataatattagatattggatgaaaaaaatatatatataaatcctttataattgacataaaattactttatttacccaccaactatgaaaaccatcttttttacatttattcttcttcttcttttgccaaattgctgcattgcaaaatcacttaacctttgcaccgtttatgacaaaatggaatcggaatatgaaataaaaattaatttaagtgcaattaaagtcagaggcaacgcagaatttaaagacacaaatttgcatcaaaatattcaaaacggagaatgtttgtggcgtttcggttccggacgacattgagacgaatttggttgaattcgtatttgacattggcattatgccattgcaaaacaatgtgtttaattcggagaaagggcaacaaagtgggaaaacaacgcgtgatgatgattacatttttgaagtaccaacagaccatgaccatggaaatgccatgaggagcagcagaacggtgccaattaccgtatacgaggcacacaaactgaacggaaagccaattgtgatcaatttgggcaaaattgatccatatggacagtttttgaatcggcgtttatttgttgagagaaaaaacgatttgggcagaaattaccacgcacttttgtatgcaattgcaacaaaaaatggtgaaacggaagaaaagaaagtttttgttggatttgcccaactggtgagggccaatggagaaacttccacttctgagcagcggcaggtgaattaacagataaatttctttttttaatgagactaaaagttctgcgatttatgagtcctaatgaagaaattcgaaagtgaactgttcgtctatggttccgacaggaaaggggcaatatcctcaaaatagggggcaaaatcgcatccataaaccaaatccaatttcggttctcaatgtcccgaatctttggttcccatttgcagtgccacatgaatccttttttcaataattttagcatgttttaataagtgcttcgtcaaattcccccatgattgaactgctanaaatttcggggggtggaaggggcattcaatgatagggaatctaggggacggaggcatcgatctttcgtcggtctctaattgtctgttctctatgtctctt

SEQ ID NO: 34713 - DNA, 1403 bp, Heterodera glycines
  misc_feature (116)..(116): n is a, c, g, or t
  misc_feature (144)..(144): n is a, c, g, or t
  misc_feature (226)..(226): n is a, c, g, or t
  misc_feature (1101)..(1101): n is a, c, g, or t
  misc_feature (1129)..(1129): n is a, c, g, or t
  misc_feature (1296)..(1296): n is a, c, g, or t
  misc_feature (1309)..(1309): n is a, c, g, or t
  misc_feature (1343)..(1343): n is a, c, g, or t
ggggcctcaaaaattcccatgagtaggcagagaagaagtcagaattctccgaacaatttttggttaggatatatgtaaaaagtcatttcgtccaaaagttcaggcggcaaatattncatattattatttgttgtggtaggaatntgggcaatttttcgtgtttcggtgaggggacaattttaatgggactgacttaggatgtgttcgacaattattttaggatatntaaagagacacaatgccaaagattagcaatgaaaattgctcaattggttttttaaaatttaaattcaacttacttggtcggctgacatgaatggagttaggtatttggataaaaaatgatttatgactcttaaaatcgttttgttagttaaacatattatatttggataaataaaattgacgaaaaggcaacgaatgaaaccatgcttaacaagttaaaacttgttctcgcgggggtttgggacaaattatcacgatttgagaacatttttgaccaatcctatgtaaaagtcgaacaaaaagctgaaaattcaaattttcaagcttcttttttttgttcaaattttacatatcgcccgtttttagtatttcacacaatttcttgtaagcgcattaattaaaattagagtgccacgggaccgggaatttttgccaaaaccgggaccgggacttgccgggacctgagaagccgggaccgggacctcgattttttttcgggaccgggaccgggaccgcaagaaaaaccgggaaccgggaccaaccgggaaattttaaaaattcaaaaaaattttaaaaatttaaaaaaaaattcaaattttaatttatatcaagtgaaaataatacaaaattatttggttttttatttaataaattaaattaatgaaaattttcaaacaaattttcttcaattatttcaagcaactaaatcatcgaatattaatagaaattcagatttgattttcacatcacttttttcggagcgctttttcaaaaaacttttgggaaagaagggggtccggcggtgccgataggcgccgccgggggaaattttaaaaatttgggtgcaatttgttagcagattttcaacaaaaaaanggttggtttttgcgattattaagctcanattggtaggattttcatttaaaaatgataaaatatgtatcaattttaaaaaaactatgagtaatcatattttctctataggaaacccaccagtatacaaaaaaaatgaaaataatctaattttctgtagagggattgaacaggggaaagaagaagggaaagtcaggnagactagcattangccattgcacacttaggcagtgttactttaaaangatataattattatttcttttttatttttccctttgactcaattttcttccctaattttt

SEQ ID NO: 34714 - DNA, 1231 bp, Heterodera glycines
  misc_feature (10)..(10): n is a, c, g, or t
  misc_feature (45)..(45): n is a, c, g, or t
  misc_feature (65)..(65): n is a, c, g, or t
catataattntagaccacgaggatacaaaattgcataaaaataanaattcatagtcaaagaatgnaagttttcagtgttcggtgtcagagccttgtgaggtattggttactggcgggccaagcttaattaggtattggctaccggagagccgagccttgcgaggtattggttactggcgggccaagcttaattaggtattggctaccggagagccgagccttgtgaggtattggttactggcgggccaagcttaattaggtattggctaccggagagccgagccttgcgaggtattggttactggcgggccaagcttaattaggtattggctaccggagagccgagccttgtgaggtattggttactggcgggccaagcttaattaggtattggctaccggagagccgagccttgtgaggtattggtgaccggagggccgagcttaattaggtactgactaccggagagccgagtattggctaccgaaaattcatcttttattattttccttgtttttatacatttctaaaatccttgcggctgtaataattagttacttacttaaaaaaggtttatcgctacccaaaaagttgcattctttttcagatattttagaattaattaccatatttcctagccatcaataccataactaagttaatctgtcaacaattatcatactcatttagtgttcatcatttcctttgtctcagcttcaagtattctgcttcattgaattacagcaaaaatgtggcacataatttaagttccatcataacccttctttcccccagaaatattcagtttgtaaaaattaaagaataattggttataattataattaatgcagatgtcataccctattagcaatttggagtattttagcatggggattcgaccccatgctaaaatacaaatgtaaaacatctcgatcaaaactttgttaataattttcccgcattttaatgattaattggctcttaattaaattacccaaaaattgatttaacaactgttactattaattaaaattatttgattttttcttacttcccacttataatatgttcaaagcttcactacaccttctcatctaaaaacaatggcatatagatagtgattatttgattaatttgttcttaattaaattacccaaaaactgatttaacaactgtcactaataattaaaattctttgattttttcatacttcccacttataatatgttca

SEQ ID NO: 34715 - DNA, 1847 bp, Heterodera glycines
caacataatgtacccatagaaaaattgggtcagtgcttcagcaaaactttttttttacctttgcataacgcggcgtttcaatggcccattggcgaagcagtcgtttctcaattttggcacccgagcgccatgaacaaccgttgtcatcaatctttaatgaaaaaaaaattgtaatttgcggtggtagagaatgaagcaaccagaaattgaaaacgaaaaaatgaatgggaaaaaatggggattttttaaaattatacaattttaaagacttcgtcaaaattctcagaattttctttctccggcggtgcctataaaaactaagctatttttaaatttttttgaaaagcgcaataaaaaacggtcgctcgcccccccccctcgccgaagcaataagggtcttctgggtacggcactttaggtcacctgttcatcggccaacacagtgccgtcaactgggtcccagttcacttcggaaagcgtcttcctgacgaatccatgcctgaagagttggataaaaatccactgggtccagcgaaagtaatctggtcggcatgtgaaaatctcctggaattgaaaggggggagaaatcgcagtttcggtacaattggacgagtgacaaaggagggcactcacgcgattccaatcgaaattgacgccagtttttgacaactgtatgcgcatctcctcaatgtttctagaaaaatttgtttaaattccgttacaactatgcatatcattgcaagagtgtcgacatttttcccccgccctccgaattttttttggaaaattgtatgaaattaaaaaatatattagaggaggaattccttggaaaattggggtggaacgagctgctccaccagaattgtattgtttccttagactcccaaaatttcatttttggtgtaaacgttagtgccaatttggcataaaacattagtgccgccaactcacttatacgtccattcggcggggtcaattccacgctcacgtgccgcattttcggccggcagtccgaacgcgtcccatccaatgggatggatcacttggtgtcctttcaacctgtggtaacgactgatcacgtcggacagtgtgtacacgcgcagatggcccaagtgcagccgcccggacggatatggaaacatgggcaaaatgtatttggaccgcaaattgcgacacaatttcatggtaaaagacaaaaaaaaagctaaaaattgaagcgtgattagactgaaaaccgaaattttttgtttaataattttcacaaaatagcatggaagcttttttcgccgattttttgaaaaataattcatcataaaatttaaaaacgttagaaaaaaactttctttaaatttctcggcgcggctttttactcggcaccataccaatttgtttttaggctcgtgccgactttggtggtccaaaaattggtagctttgcgatatggaaaaaagcggaagtatccaagatattaaaatgaatctgtgtgcatatttgtttaccgtttgactctcctttttctctcacctgtatttattccacaaaaatacaaaaaaaatggctttgcttttgattttgtcacaaaaaaagggggaggaaaaagagtgggaaagaaagtgtcgccgtcgtcgtctgtccgttttcttttccatccaagcaaacagatcacatatccacgaattaattcacaaaaacaaaaaaaagatgttcctccgcccctctagcgccagccaagccaagtcctcaccaactcacacagtaatcaggcatgcgcatacaatcgggtccactgaatttgcatggctcaattatagaatttttaggcttcaaatcatacataaaccactcaa

SEQ ID NO: 34716 - DNA, 1025 bp, Heterodera glycines
  misc_feature (912)..(912): n is a, c, g, or t
  misc_feature (974)..(974): n is a, c, g, or t
tttggggtggaaatcatcgataattgaagtattctgttattgtagtcccgtcagaggtcgaaaatttttacgaattgaaaaaaggcctcagaaaatttttctgacgacttttatactcagcaattttttgcgattcttgattttcaaaaattttaataaaactttcagaaaataattttatagttttttaagtaacgtaaacatatgccacgtgcttttcgaaacatttaatgtttaaatcactacttaaatctaaactttgtccctaaaggaaccaaacctaggtaatgcctaagaattttttaaaaattttaaaaatgtacatgagttgctcaagacgattttggcacttggcgaactgcaaacatgacaaattatgattttccatttcgcattcacggcacatttcgtatttacatgaagggcatttcaaaagcttttctttttgcttctcactcatatcaacggcaaagtcacattttgggcatcttttttgtttaaaattaatttatattaagaaaatagcaaaatttcttaggaaaaaacaggactcaaatatcgagttgcaggtcagaaaaaaaaaattaaaatttctccaaaaaaaaacaatgtgtcaaaacatttcctgctggttaaaaatttttaaaagcttattttcacctattttggcgttttgcacaaaatttgttaacaaaaatgcaataaaataaaaaaatacacccgtaagaatcgacccgaaaattttcaaaaatacacccctaagaaatgaaaaatttctcaaaaatttatctccaaaatttatttatttatttcttgacaagaatttgtgattttaaaaattttttagctcaatactgatttgggctaatttttttacttttttgaataaattttgtctttttacacccctanattcggaactttttggcacctattttccatttttagcacccattttggggcttttttagagncctaagcctacctattttggcagtttttagcacctataaatatcagcccta

SEQ ID NO: 34717 - DNA, 1149 bp, Heterodera glycines
ttccgttccttcccttctctccttctcttccctttctttttctttcatcctttcgtcaatgtttcttccaccgttggcttctccgttcttctcttccattgttttgcttccattcattccattcccatactttttccttccttccgtccctcttccatcagtcgtctcctcttcccctttggttcctcttccgttcattcttccattcatttctcttccatttgtccccctcatctcctcttccgcccttttctctcgtccattcatttctcttccatttgtccccctcatctcctcttccgcccttttctctcgtccattcgtttcccttccattttctctccccctcatctcctcttccgccattactcctcttccattcgtttctcttccgtttgtccccctcttgccctcctccactcttctctcttcttccattgtccctctgtccgtctcttccacctgtcttcctcccctcctcttcatcccttcctccttttcctcctcctcttcgctctctctccgttctcccctttttcccagaagacctctctcaaggacgagcaatttgtccgctaaaaatgagcacttttattccgttgatatactcaaaaagaattaccaaattggaatttatctgtgcgcatcaaataccaaatgaggaaagcaaacgccgtgcacaaaagcaaagtgccgaagattgcgccaaaaattgccaacgccaaattggagggatcgatgcacggcccaacggggggaattgccgccgcatcatcggcaggaacggaataggcactttggaccattagcggacttaaaaaatggcaaaagtaaattaaaatcggacggattaaaagaaactcaaacgaataaattggggaggataaaaatttgcaaagatacaccaatgaatgagtgaattgtcgagaatggaaatgtgggaatgttttgacacagtccgaagagaccgaaagggcgcagggggaggggacgaaactgaataaatgggggggggaaggaggggtggtcaaggccgctaaacgggggggggggaccgggagagattggatcaaacggagaggggcgggggttgttgttgtacggaaaatttggtttaaaactggcggatcagcacaatgcatccaatgt

SEQ ID NO: 34718 - DNA, 946 bp, Heterodera glycines
ttctgttttggtggttcctcctccttctttttgctctttttcgctgtcctccttcaaaatgttgttgctccttctgtactgctccagcacagtcaaatgatgcgacttcagatgactcttcaacgtactggtcggcttcaagttcttttgcgccggtcggcggtatggacagtggcggcaactgatcgcattggcatcaaaccgatagaagtaatggtagtcgattccctgaacaattagggtttggtctacatctaatactttgtatatatttttgtttaccctttccttcggcctcaacattttctgctcggtgccataaaatgatggcaattggccactttcaatcgattcgctccctttttccaaatttgtctccaattgtttcttcgaatggtttttgatgctttttcttgacagtttttgtattatctttgtgctacttttgtttgttttttggctcattaattcattcattttttgctctcttaaaattattattttttaataataattattttccccatttttacctcgcttctttttctttcaaaatggcattttttagttgtgcccaagtgtccaattgttgatttttcagcttttcgtgcatcagttgaaggcaattatccttataaagattcactagtggaaagaataacttctgcattatctaaaaaagaattaaatttcacaataagtgattgtaataggtgagaaaagtactcaaagtcaaaaattatctaaatttgctaatttaaaaaaatgaacaaagatttttctggtaaaattctgttagtttagaaagtggcattgaaattgaaattagatgcaaaaatttataaattatattattaaaaaaatgttaattataataaatcattttttcaaaataatgattttattggaaaaattttttgtttttctaaaacaaatttttagtgcc

SEQ ID NO: 34719 - DNA, 919 bp, Heterodera glycines
gagggggaattggctaatcccgaattcttccaattccccctctccccctatttgtcccggacgaatcggttcacccttccccagctaatcacacatattacacattatatatttgtattgatcaaccttccgaataaggatattattccatcccgctcgtgtaattatggggaggggctaagcaacgaatgccaaagggcatccgacatattcaattacatagagtcttagcggaacccaaaaaagttcaaatcaaataaataattaaagataattattttatttaaataattattgcaagaaatatttatggagcaataattaaatggtaattttgctcaattcaatcaaatttatcattcattattcattcttttccagacaattttactgggtaatagagaaattttgggccactgattgaataatgcaaaaaatgatagatatatggcttttaattccgattgcaaaatttcaaaaagttacgacaagtttcaaaaaaattattatgaccaaaagaacccaaaaaatcttgttattcgaacatttttggctgccataaaatttttgaaagtaataataaatttttgaaattttgcagggtaataaagaatacttagggttggttatcaaatgaaatcaaggaataaaaatttggttgctaagcaaatttttaatttttttaaataaagttccattttttaaataagcgcctatcccagtgcctccgttaaataggttctaacctatcacactgcacgttaacttttggcctttttaattttcttgaaaccttttaaaatccgttggctttaattcaactttttaatttaaaatatattataaccagccagcaggagtaaattaaattaaaaatttcccataaaaaaattgacaaattttctgaaattctttgtta

SEQ ID NO: 34720 - DNA, 1695 bp, Heterodera glycines
tctgtatgcgctggttgcccaaatgattggcggtcagcagaccggcacccaaactcagaatttcggtgggcgtgttgaacatgatggacacaatgcgttgcatttgatcactgatcaactcataagacacgggaatgaatatggccacaaagccgaagaaaaagctgaaaaacatcttgtcacggttggagtgccagtggcatggaagggataggcatagttggagttttggaattttttgaagagcctcggatttttattttcgaattggcattttgactataattccgaccgatggagtgattgagttggacgaatgattactttaacactattaaccgtatgtattttaacttttaaatgttgattgcttccacctaaaaccttgtcagtcctttcgtattgttaattggtctttaattatcagaagattagtctcagggtgcggaaataccgaaaaaaggaatttaaattcccccccccccccactgattgattgatcaaatgttatcccatttaacctgatcactgcaccaagacccatcgagttgtaagccatcgatgtgatcgagtcaatttgcatgccgtccgccgcacgaagacgacagtatcctctgaccgttttcgcatttaccgtaccagtgatcaattggtctttggtcggtgcgggaaagaagccaatgccgatcagtttgtagaaggcagcactgcgcagcttgtgccatttctccacttggagaggcaccatcgcagccgaagttgaggcggcaatctgacagatacggatttaaaaaaaatatttaaataaatttaaataaattttaaaacaaaatcctttaagtgtcatggttttttaaatttagtgaaaattattattttaaatttttggttaatatttttgatgataaattgagccgtcaaaattgaatttagttcaaaaaatatttcttgaaaactctatttatttattttttttttcgggtggaggaatttttcgtcaaactgcacctgatttgtaaaagcgttgagtgcaaatacgccaatgtatccaccaatgtttccggacctaaacaattattaatgtctttttaagttttccgctgaagccccctccccccataaaaggtaggaaacagattattggcaaaaactccgacctgattaaaccaactaaaaaccgttataagataagttacagtagtcgcaattttgtcccttacttaatgaattgggcgccgggcaacagtgccatgacaatgttgttggggatggcgccaagcgcggcaatgccaccagaaatcaccgattccttcaggtcctccttgaactgcttgaatgtgcgcggcaaaagcgatttgccctccaacgcgccaagcgtccgtttgatgacgaaggaatcgaacgtttcggcaaacagcggggttaatgagtcgaggagaaccatcacaataattgtcaccggatgaaattggcctaattggcaaaggaagtaatgattagatgggaaggggggggggggatttgcttaaaaacgctctcagattctcaaaacatttttaaaaacggcgccatagacatcgctttatgcacatagcccagttggtttatccttttttgccattcaataacattcaaaaatgtatttatttattgggaggtgttttcaatcaacctaatataattttctttccttgt

SEQ ID NO: 34721 - DNA, 926 bp, Heterodera glycines
  misc_feature (18)..(18): n is a, c, g, or t
tattcccagttttttttntatcgggacaagtccatccgcttatgaggcggattcctaccggggtgctttcccccatttttcttcattttcattgatttccaattcaaaatcgttacgctgatcccagtaaaataagtaaaatagttggcatagacaaaaaaaaagcaaaatagatgaaaaaaagtcgctctaacaataggtcgaaaattgttggaagctgttttttgcatttatcctagaaaaaatagtttaaaaactaaaaatccgttccctgattattttttaattttatttttctaaattaaatgcattcaaattttttggatttaattttacagcagcagcagcagcagtacagcacgttcagtccaccggaaccgcaccaccaccagcaacagcatcagttgcagcagcaggcgaccgccccgtcctttcagcacattgacgcgtcgccgacaccgttgcggcaaccgcagcagcaaccgttcaatccgtttttgcgggaccatcacctgcagcagtcgatgcgcggcggcttgacgcctgtcgggcagcgcatgccgccaccgtatttggcacattaggccgggggcaatgcgtcatcatcatactgtatttggatgccaaatttgaatgatggaggcaggagactgtattctctggatggacagtacttatccaaatttttgtgaagactgtacttgggcggttttgtctgttttttaattaggaaaacccgaaatttgtacggcattcatacacgcatcgttcaatacagtttcaacaattttctggcgttttcatttctcatcactttaatttctcgaacaaaatccatcattttcatttccaatattattagtcttccgaaatggaattaattaaaataaatggtttttgtttttaacattttctcaactttacta

SEQ ID NO: 34722 - DNA, 767 bp, Heterodera glycines
  misc_feature (12)..(12): n is a, c, g, or t
  misc_feature (237)..(238): n is a, c, g, or t
  misc_feature (240)..(240): n is a, c, g, or t
  misc_feature (245)..(245): n is a, c, g, or t
  misc_feature (247)..(248): n is a, c, g, or t
  misc_feature (251)..(253): n is a, c, g, or t
  misc_feature (255)..(256): n is a, c, g, or t
  misc_feature (258)..(268): n is a, c, g, or t
  misc_feature (270)..(273): n is a, c, g, or t
  misc_feature (276)..(279): n is a, c, g, or t
  misc_feature (282)..(283): n is a, c, g, or t
  misc_feature (292)..(296): n is a, c, g, or t
  misc_feature (298)..(310): n is a, c, g, or t
  misc_feature (374)..(374): n is a, c, g, or t
  misc_feature (379)..(380): n is a, c, g, or t
  misc_feature (428)..(428): n is a, c, g, or t
  misc_feature (441)..(441): n is a, c, g, or t
  misc_feature (453)..(460): n is a, c, g, or t
atatctcaattngatcgtccaaagtaacaaggattttttgtgttttatcagttggtgccgtgcggtttcttgtttaattgcggtgccgcgcagggatatggcggatttgttatcgatgttcgaccaatgcatttaaattatcaataaaacagaattttattttataaacaataaattggtatgattagttttatattttttgttgaatttattaaaaaattttttaatggcgggaannanaaaanannaannnannannnnnnnnnnnannnnaannnnctnntcggagagnnnnnannnnnnnnnnnnnttcgactcctcgactcaaaattgtttttaaaggtctgaaaaatgaaatttaacattaaatgcanattannctaaggaataaaattaataaaaaaaaatcaaaatatgtaacaaaactngggtttttgcatntttagatattannnnnnnnaacttcatctgcgctaatgaccggcctttgctgcttctactaattattgtgaaagcgcgccgaaaaatttatatggaacggtaaatctgaatttcatataatattcatcatttagtccaaaaatgattaattgtttgaaataattgaagaaaatttgatttcaaaattttcattaatttaattagctttaacttttgggttttataaaataaaaaaataattttatattattttcactttaaaaaaaattaaatttcaattttttaaaaattttaaaaatttttttgaattttaaaaatttaatttt

SEQ ID NO: 34723 - DNA, 470 bp, Heterodera glycines
tttttgaaaaattcttattttcaagaaaattcttagaatttaaggcttttattgttagagagatataaggtcatcatagattaataaaaaagggggcggaggagggcatcagtagagaccaattaggcgcgcaacaaaaaggcccagccatgtaaattgacggcaaaaaaaaaaatttttttttgaatttcataatcaaccgaccgcaattgttgaaccaaacgcgggcgtggagtcgcgaaaaatgggctccggactttggagcgcaagcataaaaatgagcacagtgccaactgaaaaaggaaggcaatgtaaaaaaaaggaatgacacattttatggcaacaaaaaatatttttatttagtttttcagcaatttttggaaaagtttttgaaaaatcttagcaattcaccataagaattttcaaaaactttcaacttttcttctttcatgaatttgaaggggtggggt

SEQ ID NO: 34724 - DNA, 1008 bp, Heterodera glycines
atgggagagagaaacatggcattcacaaaaaaataataatatttaactattttataaaagttttgctgccggaagaattccaaaaaagtctattgaatagtctttttcataacttattgaatttttggctaaaattagtaatttttgagattttaaatgttttgcatttggaaacataccgctgcgataaaccatgttttgtcgccaagttcagaaacaataataacagaaagggaggcaataaaagcatggtaaaagccaaactttgaaggtgcgtagaacatactgaaaatgtgaggaaaataaattaaaagggcggaaaaaataggaaaagcaattaaattcacgaactaatcgggaaatcgaggtcaacaattaggtatttattacctattcacgtttaaacggccaaaacaactctttataaaagaagaaacgaaaacaaaaagcatttggaattttggaggggaaaaggaaaagaaagcaatgcacaatttggaaacgaaaagccaaagtgcgagtgccaaattgcacaaattacgaattacctgttttttgtcggcgtacgccgcacaaaacgcgacggatcgaatttcgttgttgtgtctcgtcatgttcactttttgtttgcctttcctccacgcgccgatcgcacgtgcttttttcgctccctgtttctgttctccctttgcctttgctctctctttttgttccaatatttcgttcaattcgttcgttccgttgttttttcagcccatttctcattacacctttttttattcgtaaattactactaccaaagaggtattttaatttcaaaatgattgcctcaacagtccattcatccgtataatttgatttaatagaaaatgggccaagctctaagtgaaccgatcacaaccaaaaacagcgcctcttgttccaatgatcgctattttgtcggcgggtaatttttggtattgatccaattttaaatgcggatcttccctttgatttaggttcttcttc

SEQ ID NO: 34725 - DNA, 996 bp, Heterodera glycines
actttagaagaagaaaaaagtatgggaaggcacaaccaccaggccaccgacgctcacattggctttacattctttgaaaatgatattgaaaaggcaaaaaggaaaagcttcatatctcggccagaagcttcatttagcaaaaataaaaaaaaaatttataatacaaagggggggggtaatctacctaccctgaaagtttcattcggaagtcccatggtcacttgggtacctctcctttgtcagattcgtgattagcgacctttaaaaccccggataaaaaattatcatggttttttatcttaaaaaatttttgcaaaacaaaagggtccccccttttgtttcaaaatctgtcactttgcatatagtgccaaatactttattttttttttattaaattttcatcaatttccttcactaattttcactcaaacccctattcttaccagtgcttattttttccagttgaccgcaagcccgtagccagaaaaaatttcggagcggggaatccgaagacttttttttttgctcttcgggtcattttccgggggggttgttgggccattgagttttgacgaactttttgaccttctgaattgtctgatcctgatcagcggctctgatcagatcctcattgacaatcgggagccctttttcgatggcgttcagcacaaaacttccagcagtgctaatacttgccacaattcgttcatcgtccggaagtggcgtttttgcgatcagtcggtacaaaacatcggcatgtccaaattctgacgtgcttttgtattcgatgttgaagtcgtaccctaaaagtatgatggcccagcgctgcaatcgatttgtggtgcaagcttttatccccctttttgttgccaaaaatggccaacaaaggtttgggatccggtttgcagtgaaaaatgccgtccaaccaaaaatttgtggaacttttttactgcataaatcagaagctaaccctccttttcattttgggaataattc

SEQ ID NO: 34726 - DNA, 986 bp, Heterodera glycines
  misc_feature (912)..(912): n is a, c, g, or t
  misc_feature (948)..(948): n is a, c, g, or t
aaaaaagagaatatccatttttctggggataacctctaaatataaaaatcctctagtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatatccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgagggaaaaaatttctcaaaaaagagatagacatttttctgngatagagtataaatttaaaaattcccctcaaaatanaaggtctattgcgcaccgccctcctatcatgctcgaga

SEQ ID NO: 34727 - DNA, 674 bp, Heterodera glycines
tttatttaaaaaattaaattataatgtaaataaacacaccccttactgaaatttgagtctataaaattttaacaatgtttccatttcctgactaaattaacgaactgtttaaactataataaaacatgaatataaaaaactcgttaataaaaagtaataaagcatgaaaatgaaaaaaaattttatttttaaattgaaaattgaaaaatcaaaaatataattagaataatataaaaaatattaaaaataaaaatatagctttaaaaagaacataaaagtcaaagaattattttagaaattttttaagtctaccaaatataataataaaaatttggatattatcttaaaaattaaaaacgaacgatattaacgatatccgaaaattgaattattcctaaactagagtagagcgggaccgggaattttgggcaaaaccgggaccgggacttgccgggacctgagaagccgggaccgggaccgggacctcgatttttgttcgggaccgggaccgggaaccgggaccaatcgggaatttctaaaaattcaaaaaattaaaaaaaaaatcaaattttaatttatttcaagtgaaaatattaaataattaaatttttatttaggtttttatttaataaaacccaaaagttaaagctaataaattaatgaaaattttcaaa

SEQ ID NO: 34728 - DNA, 985 bp, Heterodera glycines
cttttctgttagtcatttctcattggtgttgacgatccaatattcagtgtacaaatttgttaaacctctcaacattttaaatcaaaatcctaataaaaatttcgttgaatttcttcgcctcttatttgtgcaaaattttcgaaaaagtaatttactatttaaaattaaaaaattcagaagcaaattcaataatttttttatttttaaatgcatttttaccagatgaattatgattaaatttttgcgtttcgaattcattttggaattaagaaaaataaaaattgataatcatttgatcatttttagcgcactttaagcaccgccgttaggcagcgcagttccaaaatttattccatgcaacagatattatgggcaggacacgccaagtacctcaaacttgggtaattaaaccgaagaaagaagtgcagtggggaagaatgacgcccaaaatgaaggaaatattcgatgctgtgcgaactctttgtgacccctctctgactctgccatgcagcagttgaccatttttacactatttttctctcactcatcgtctgctcgtctctcctttattataagctattttcctaagccaacaacgcccttttctccctcttttctgttagtcatttctcattggtgttgacgatccaacattcagtgtacaaatttgttaaacctctcaacattttaaatcaaaatcctaataaaaatttcgttgaatttcttcgcctcttatttatgcaaaattttcgaaaaagtaattttctatttaaaattaaaaaattcagaagcaaattcaagaattttttttatttttaaatgcattttttaccacatgaattatgattaaatttttgcgtttcgaattcattttggaattaagaaaaataaaaattgataatcatttgatcatttttagcgcactttaagcaccgccgtaggggcagcgcagttccaaaatttattccatgcacagatattatgg

SEQ ID NO: 34729 - DNA, 267 bp, Heterodera glycines
agtcttctaaatgcccctccctccaaatgtcccctccaatctcccaacatccccaattcatccgacaaccatcgctctctttctcccccccccccttctctcttaccgtaattccgccaacaaaagggaaggagaaggcccaatgactctcctctcatctcatcatcaaaactgaagagcaatgaagatggatggactggggtggggatgggatggcggatggatgatgatgatgctggaggaagggaggggagagggggtggccag

SEQ ID NO: 34730 - DNA, 906 bp, Heterodera glycines
  misc_feature (863)..(863): n is a, c, g, or t
cactccgcctgcaaatgccccattcgccactgaacagcatgacagcaaaccccagtctggaggctagcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctcgttagtttcttttcctccgcttactgatatgcttaagttcagcgggtgttcacgtctgagttcaggtcgaaaaatcaaagcaggaatgccagtaatccaggcactccgccacagcatgcaaagcattggtgcgcttgagttacggtccgtaaaacgcgaattagaaccacaagttcgcgccagcacaccaaaaccccacagccgagctgagcaagtaacgtaagaacacgtacaagtacatgatcccacgaagcaacgcacaagcagtgcattttatggtaacgaccctgaaccaggcgtgccaatggatgtaactccaatggcgcaatgtgcattcgaatgttttgtgttcaaggtttctgcagttcgcactaattatcgcagntggctgcgttcttcatcgatccacgagccgagtgatccaccga

SEQ ID NO: 34731 - DNA, 864 bp, Heterodera glycines
taaatgtttcaataattccattttcaaggaggagactaaacaggcccaattcctcgcgttggccgtcgtttactttctgtccgttttgatggtcagccgttaccgggacattcttgagccaccgctacccccgccggccacatcgtcccacaaaacgtcggccagttcgaggacggaaaacagtccaataaatgaggagggatcaccatcgatgggccggaatgagggacaacagagcaaaaacggttagaaatcagagggaaatggggaaagtcaattatacggaataaataccggatatgcaatttttcatctatttttcgatttcgcattttaaattatttccaatttttaatttggcatttaatggaagaaaattgaaattctttgattttattgttagacgaaccgacgtcgtcattaattggtgcttcttcaaatgcagctaatggtaacgaaaatgatggtggacaaaatcatcgagacgacggcaaacgcaacggtgaaaacggcaaagaaacagcggacggcacagagacaaacgatggcacagactcagaaaaagcgatgcgcggtgggactgaggaagggacggaggatggcacgattgaccatgagagtgaagcaaaagacaaccgggatgccaaaagggcgacggcaaacggagacggcacggagaagggaatagcggccatccgatgcgcagccaatgcgacggaggaagtgatcattgctaaacaagtacggaccagcgcatttggcgaagagagcaaatgtccaattcaccaaattttatttatatatttttaaactcatgattgaacgaaaatgaatcatccaaattttgttcattttcaatgcacc

SEQ ID NO: 34732 - DNA, 1092 bp, Heterodera glycines
aagtgacccaaattgggcgagggctatcgccgcgcaaacatttttctgcccgacgtgaactgtgaacggagctgcgacagcacgtatcgcgacaacatggccaaactgcgcaacttgtgctggtcggtttcagcaatgaccacaaattggtgccgaaggaaacggcggtgggttcagtggcaaatgagcaaagcaaaagacaaattggcacaatttagccaaaattggcggatttgtggattgatcaattaaataccagaccaggcattatacagatgcccaaaaaacccagaagataggtccaaatacagatcagtagtgttttttacaatctgtgcctcgttaattggtcattaattaatctttcagtggttcggtttctacaccgacaacgacacacaaacgatagtgccaatggagcagactgaactttacaagcaggtcattcactcatcactcactcaccgatcaatgaatcaatcggaatatgaaacacaattaaaccgatcaaaaactgatcagaaaagcattgatttactttttaggatcgcattggactgaaaacgctgaacgagtcgaaccgtctccattttctgactttcaacggcgaacatctccaaatacccaccgatgtatgcgtatgagggggtttttagaaggaaaacaaaatacgaaaatgaaacacgaaaccaattaaaaatacaaaaagaaagaaaatacataaaataaaaaacaaacccaaacaaaccacaaaaagaaaatatcaaataaaaacacaaatacgaaatcaaataaaatacaaaaagaaaataataaaaaacaaaaccaaataaaaatacaaaacaaataaaaaacgaaatacaaaccaaataaaaatacaaaaagaaagaaaatgcaaataaaataaaaagcaaacccaaacaaaccacaaaaagaaaatatcaaataaaaacacaaatacgaaatcaaataaaaatacagaaccaaataaaaaacgaaatacaaaccaaataaaaatacgaaaagaaatgaaaatacaaataaaataaaaatacgaaaagaaatgaaaatacaaataaaataaaaaataca

SEQ ID NO: 34733 - DNA, 752 bp, Heterodera glycines
ccccccctgggaccgtccctggaggggggggggggaggcaaaaacaacagtcatacaaaaacaaactaataaatggaaagtgacgtgaagagaaatattttccttggtaaggactgctggggaagagattacacaatcatttgggacaatctttcaaaaggaggcgaacaccatcaaaatgaatgtgacagtgagcattattcttccctttgaattaaggcgactacgccgttcagcctcacacggacccgctgagactggcgaacccccacgcctaaggaagggagcgaagaaggaattcgatttaattaggtcgcttgtaaatgtcttatttaaattcgttttgattctgttttccatgcgaatcaaaagttgtaaattgaaaataattctctattcgtgtcaaaatgacaataaatatttgttgtgcttatttaccgacgtcacacaaattcactgtcaggaaaaatggtgatgctaacagtgctaaaaaaggcaaggagaaaggagcaagaaatgcgagtgctcattctcggcctggacaactcgggcaaaacgacttttttgaagagaatcagtggagaagaaattggtgaaatcgcaccaacctttggttagtgcaatttaatgggggtcaaggcagttcgtacaatgttattgtattaaaacccgggattgtcaattgattggactcataaaatactttggactcataaaagtcgattggagtcacaaagtgcattagagccaaa

SEQ ID NO: 34734 - DNA, 675 bp, Heterodera glycines
aattggtaatggataagactttgaagtttaatgatttcatcccgctgataaatgtttacacgggagttcatcaagcacaattcgatcagaaattttgcgaactaattctttccatgttctgtcaaccattaaaaattaaaataatttttttttgaactaaccaaaaaaaatacaaatcgcatggctgaacaaaagccagtacaaccaggtgggattgtctggatgcaaatattgtccctgccaccctctttagttgatgaagagcaaacatttttgtgttttacatatttttaatttgcattcactgtcgtaatggagtctgtatcgtttcggcgcgaccgtttcggcgcgaccgtttcggcgcaaccgtttcggcgcagccgtttcggcgcagtgtcgtttcggcgcaagggtcgtttcggcgcgaaaccaaaaaaagggtcggaaaaagtcttgactcaaacttgaaaaactatttcacagcttacccaaaattctgaaaaaattcctatttatataacttttgataatgatcaaaaaagtctcttacatcattaaaaacccgtttttcgtgcgtattaggccatagcaagttagcaaaaaaaaaaattataggcatatgtctcaaaatccgggctgaaattttttcggaaaatttcgggatttcaagccatt

SEQ ID NO: 34735 - DNA, 822 bp, Heterodera glycines
aaaaatgtaggcttaacttttttagtgaaaattcgctctctcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataaattgtttgagtaccccaaaacggacacttgaaaaaaatcgatttattttt

SEQ ID NO: 34736 - DNA, 885 bp, Heterodera glycines
ttttaatcaagcaacgagattttcaacaagagaaaaaatatataaattttttggacatttatataaaaatgtataaaagagaaaaaactaaaaaaattaaaaatcaaaatttatttaaaaaataagcacattgaagctatagttttcttcactttatatgaaaaaattataacaactttaatttgttttatattcattaaataaagcaaaatttattaaaaattcaacattcaattacttgcgctatgtaaaaacacaaaaaaataaaaaatgaaaattaactgaaaaactaaacaggaaaatttaataattccttgaaaaacctttttacgaccgaattgtacgcctttttccaaactcttaaacaaatttcacaatgcaaaatcaaaaaatttaagggtaaataggcgcaatttttgtataatcaatatcaaaaagtatcaatcgagaatgataggaatttcgattgaatgcctttgattgccgagagattacgaaattaaaaattttattaaatgaatatagagaaaattcaataaaaatttaaaaatttattattgtagaatatttaaataaaaatcgagcaaaaactaggtattatgaataaaaatacactcaatccaatcaccttgatgtttatacaataaaagaaaattaaagcatttcaaatatttttaaataatgaaataacttttaaaaagtgatttgaatttgatacgtgctgattcgatccacaaaaactcagtgattgataaaaataatattatctacttatgcgattcactaaattcatgtttaaaatcaataacactcatattatatattttagcgctgcctcgtaaatgtaaaattaatattcatatgatgaatattttatatattttt

SEQ ID NO: 34737 - DNA, 955 bp, Heterodera glycines
ctaatcactgttgtacctcttctaatcactgttgtagcacttttaatcaccattgtacctctcctaatcacagttgtacctcttttaatcacagttgtacctcttctgatcactgttgtacctcttctaatcactgttgtacctcttctaatcactgtttacctcttttagtcactgttttacctcttctaatcactgttgtaactcttctgatcactgttgtacctcttctaacacatcttccaacaatttttgtacctcgtctgagctcaacaacatttaaattcgggcgcgaagcgcccgtttggcctctacaaaattaaacaacgtgcgcgaagcgcccgtccaagcccaacaaaatttgaaaaacgggcgcgaagagcccgactgaggccgcgaagcggcctaacaagctaaaaaacgggcgcgaagcgcccgtcttgagcctcgatgtggactaaaaacccctaataattttttaaaaattcaaaaaaatcactccaaaccctgaccaaaaagtttccgctggtaggattttaagttgaagtgttggctaaaagttaaaaaaaattccaggccgctatctctaaccccctgggctgggtgcttctagaacttttcagtaccaactttgtccagttcagtccccgttgaataactcattaggctttgacctgagcgcagggtggacagcagacttattgtagagctttaaaagcccaatttttccagattttaaaatttcgaaaattttcaaaatttttcgagctaggcctaaaaaacggttttcgggtttttgattttagtattttttaacgaattttcccagaaaaacgaagaccacttccaaaacatagtttttcgagctctatcgattggtgatatttttgaaaaaattcgattttttcccgaaataaaaaaatttttggcctgagcggaacatttgagtcccggg

SEQ ID NO: 34738 - DNA, 1112 bp, Heterodera glycines
aattggggacaaatcggaattgcattcaaaaatggattaaacaatttgatctacaaaaattcaaattaaaattggagtaagccatggaacaattaaaaaatggaagaaacaatttggcattcgatatatgagaataacggagaaagaaaaaatgaaaatttattggcaaataaaaaaagaaaaaccaaaagtgagtgataatgaaattgctaaaattgtgaacacttcaaatgcgaatatttgtaattggaagaaacaatttggagaagaaatgtttgagaattgaaaacggatgattttttaagaaaattagtgacaaagaaattgctaaaacattgaaaattcgtcaaaatagcctccgaaaatggaagaaacagtttggaagagaagaaaaataagaaaaaatatttgaaaattgattagaggaagaaaagtttagaaattttttgaaaaatattagatttttcattaaatctgaatccaatttgtaaatcgcattaatttgctgattattattttagtgatcgtcgtcaaagttttataaaatcagttccttcatctatgggagacaacattgagcaatgagtcgatcaggttgcttgatcagtcagtccttaacaccatgggaaattttctttcgactgagaataactgaaaacgataaagtatttgcaataagaaagttggttgagggagaaaattttcaatttttttgaaaaatattaggcatttcttaaaatccgaacagaatttgttaatttaataattgttagctaatcaaaatataatgtgaaacctgaaaaagtgtgacaagtaaagtctaaaaatattgaaagtttatcgacagggattgtgactggacaattcgacagtggacaatccgacagaggtggacaatcggacagagatggacaattggacaatggacaatccgaaagagatggacaatcggacagagatggacaattggacaatggacaatccaacagagatggacaatcggacagaggcggaccaatcggacagagatggacaattggacaatggaccaatccgacagagatggacaatcggacagagatggacaattggacaatggacaattcggacag

SEQ ID NO: 34739 - DNA, 1228 bp, Heterodera glycines
atagggttgtaaattatatggactaaaaaacccgaaaaatggacataaaatattgactaaaaaagcacgaaatatggactaaaaagctcgaaaatggccaaatatggaccaaaatatggactaaaaactgccaaaatatgtggtttaaaccctcaaaaatttcaaaaaatgtgtatgtattcattttgcataaataaacttaaaaaacaataaacgaccaaaaaattgatttaaaacataaaaatgcaaatttatttattgtcgtccatcgtataaaaaaatttccaagtttgccaaaattttgaaaaaaaaaattcatttaaaaaaaagaaaataaaaatgccaaaatgacgacgaaaactcaaatttttcggattttttgggctgtaatttttaaaaatttccaaaaagtctatctttaggggtgtattttttcgcttttcttgcatttttcttgtgaaaatttgccaaaaatggccgaaatatggactaaaaagacaaaaatggcgaaatatggatttattcccgaaaacccccaaaatatggatttatatggactaaaaaccttcaccaaatcaaaaaattttaacgtagaaatgctatttttggtcccctttcttcatagcatatgagcagaaaaaatatgttaatccatataatttacaaccctatgtatgaatgaacgttaaaaatttagccttaagcaattttaatagtttttttgcatctttcaaaacagggattgcacataattacgatttccaaattaataaaattgtcggaattttttaaattcttttctgaattttttgccttcaaaaagattattttaaactataaatttgctatttttttttgtatatactttgtactttattcacagattttttatttcaatttcaatttttttattccatttgccgcaccttcgcaaatgccaaaatcgaagcgcgacagagttggtcagcaatttattattcttcaaccaatttcgtctttaattcattaatttttgtttcttctttcagtttctcaacataaaaatgaagaagaagagccgcgagggcaaacaaaacacttttaaagaggcggggaaaaattcttttttttcgttttttgataaatttcaacaaagaatttcaggtcagagaatgcgttgaacagtacaaacatttgttggtcttcttgatggagaattgcgctctacaaggctggcggaggttaaaaa

SEQ ID NO: 34740 - DNA, 926 bp, Heterodera glycines
aatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaatcatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaactgtctaaaaatttttgttgttaatattcagaaaacgtgttttttttactgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaatttgacatccataaacctcatttttcatcagccagcgtgttaaagcaacccgaactgataggaatttaat

SEQ ID NO: 34741 - DNA, 957 bp, Heterodera glycines
  misc_feature (29)..(29): n is a, c, g, or t
  misc_feature (914)..(914): n is a, c, g, or t
agacaagctttcgtggcctatttatcttntgggattgcattctggctcaatctcatttgccaatctttttaaaaaaattgatttaaaattcaaaaaacactaaaaaataaaattgaagaagaaatattctaaaaaattaagaaatttatttctgcttattattttaatttttttttttgcttgattcgagatcatatgcaacttatttaacacatttgtgtggtggaaatgccagtaatatttttaaaaactataatttaatttatttattttaaatcagggttcgtccccaattgcatcgctgacagattatcagatatcgtggacgaatatcgcaacccgaccaaatctgtcagggattgcccggacaatttaagaatttagggcatgaaattttcataaaaaactcgcgaaaattaagcaaaaaaaaaaaatttcaaatgcaaaaaaagtaaaaaattataattaaaaatgattaataattttaaaattaaatagtttaattaatattgcacacacttgcacaacgtttgtccgtccttcagtgccgtgtgaaaattgtcccaagcgccgtcagtactgaatttgccgcccaataattcctttaaccattccagcaaaagctcgccctcccgttcattgtatttgttggtttgctaatttgaatgaatgaaattgatttaaaatttttttaataatttaattatataaaaaagtttttattatttatttaaaaattttactttgctcatttcactaactctaagcccacttgccgatgaacgaaaagccattttaaaacgcagaattttttgttaagaaaatattaaaagcaaaaatgatttttacatttttctcattaattaatgagaatggtatgaaaaaataattaactatttttaaaaatgtaatanaatataaaattaattaagcattttatgcattgaaagattgatt

SEQ ID NO: 34742 - DNA, 856 bp, Heterodera glycines
aatatgattaaattttagcttgtgctcgcacatcgtgccattctttcggcgtcttccgatgtttttgaggcgatgtttcaaaaggaagcgacggaaaatgcaaatggcaaaattggtgcaaaaagtagggaaaaatatatttttgaaaaacaaacaatctttaaagaattcgtcaaaatgaaaaatgcaattttaattcactttaatttttaaaataattttagcttctgctgaaaaggatggccctgtgctgctcactgacgtcgatgctgaagcgtttaaagtgatgttgcgcttcatttattcggatgatttgagcgaattgaatgggcaaaacgcaaccgaagtgctttatgcgggtgaataattaaatttaatttggtttaattaaatttttaaattagcattaaaattcaatgtcatcggattggtcaaagctttggccgattttcccattccaaaattgaccaatgttttcgctgcgctttccttcgctcgctttaatgacctgttgaaggtgggcaaaagcattcgtttaattattttattttatagggttttgttcaacaatgttttgaatacattgataaaaatgcggacgatttgttcaaatcggagaaatttttgcaaattgagcaaaatttattatgcgaaatttttgaacgtgaccaattgcaaatctgtggagaaattccaatttggaaagcagtaaattttattatttataaaatatttttactgtatttttttgggcactccgttgggctgacggaaaatgccgtcaaaatggcatcgaatgctcggcacagaatcgtcgtgccatgctcggtcctgcgctgttcaaaattcgctttcc

SEQ ID NO: 34743 - DNA, 528 bp, Heterodera glycines
ggaataaaagatttttgaatttggcgccttcgtttcaatactcatttttttttataatgataggcatttttattcaaaatgatgatatatgatcacagaaacgaaaagaaatcaatttcgataacagaatttgtttgtcttcctcattttttttacaaaaattggtagataaaaaaaacaacttttacataaatttagtcagacaaaaccttggcatcccttgccaaaatatgaaagtgattcacaacgaatcgaaggagttcaacccgtgcattgacaaaacaatcagcagaagagcgaccatcggaaagaaaaggagcagcagagaaagtgcggccaatgccctgcgacgacgggcgaattcgccgaaagggtcggcgaagatcaaaagcggaggggtggcgaggtgggcgggcttcagcactacacaaattgggtaattagtgcatgatcaatcaatcacctcttttgccgggatttcccctcgctcaccgcccgcagtcccatggaccaaaaatgtcggcgaca

SEQ ID NO: 34744 - DNA, 1608 bp, Heterodera glycines
  misc_feature (1465)..(1465): n is a, c, g, or t
  misc_feature (1526)..(1526): n is a, c, g, or t
  misc_feature (1547)..(1547): n is a, c, g, or t
atagggaaaagagaggaaaaaataaaaatgaaaaagaggaaatagggcgagaaaaaggggaaaagggaggaaaaagcgagaaaaaaaggaaaagaggaaaaagtgagagaaaaaggagaaaaaaggagagaaaagagggaaaaatggaaaatagggaaaaaagaaatagaggaaaagagagaaaaaagacgaggggaaaaggtagagaaaagggaaaagtgtagaaaaataggtaaaaaggagagaaaaggaaaaaaaaatatggatggagggggagaaaaaaaatgtcccaaatgtttgcattcccgacccatgattttacctcatgaagcgcgccaagttgtcgccaaaaagagatgaaatatttttttttttgagtcaagagcataaagtaaaatacaaaataaaggggtgattggctattgaattaaagatagtggtgggagaagtgaagcgaggagaagcaaaggattagcggacaaaatcgcaagtgttcgttcgctcaacactcggagattgatttcggagataagaggaggaggggaaggcaggcgagaagcagtgagggaaatccgcgaaatgcctgagggcaattgttcgcgcaaaaattggagattgaaatcggagattagaattgtgcggagaaaggagggaggggaattgacatgaactgaagggaattgcatggggaagggtggataaagggactaagctctcgctgggggggggggagaaagggacgcttatcaaaaccatgaagtatgaccggttaattgaattaactgctggggagggggtgaaaggaaacaacgggtagtccgtgacggcctggatgagggggcagtagctcgcgaaaatttggagatttaaatcggagattaggattaagtgaaagagcgagggaacaagcagtcgggtccaagtgacaccagacaaaggacggtcggcgtttggtaggaaaagctgagaaggggagggggttttgattgatgaaccatcaaattatcgcataatatgggcaaacattgtacaacgggatcctaggctccgtctagacaatatgcccggaggcgcaaaatgcggggtatttaatgcgtgatttgaacgccaaaaatcacatctgacaacgactccaccggtcaattgcccaacatcaacaactgacaaagcactccaacacattgacaacaatcaataggccaggacaacaaacgacaacccttggcgggcaaaaaacaatgaaaaagaaaaattatttaattttaaatacatttagatattatacaaatttaaaaatatttgaaatttttagctccaagactccggttagcacaacattgactacaaagtacaactcatacatctgcgtggacagccgtgccaaaaaacaaacgacaatccccggcggacaacggtgaggtagaaaaaataaggagaattttaacaattttttggcgtacataanatcgctgagtctaaaatgtttttttaattttatttttttcaatgttttctttttaacattntgtttttttttttacttttanatttgtccttttacaccccaaaaggctgaaatatgccaatattcgtcagcatttcgtactt

SEQ ID NO: 34745 - DNA, 61 bp, Heterodera glycines
acacgagacaaaggtcctaacagactcaatatagtatttaataacttagcgtatgaggaag

SEQ ID NO: 34746 - DNA, 972 bp, Heterodera glycines
accaaaaaatgtaagttcaaaaactgtttaaacgcttttctaatttttcaagctaatttagaatatttagtgctattgaatgatatcaaattgcattcaatttggacaactaggcggagttgttatacccgaagccccggagcaatattattcatattttcagcattaaaactctattaaaatgtttactctgatgggaattaattctgccggcctaatgaatggaaatccgaaattgtatccggtgcacaaaatgatcacatctgcactgaattcacgtccatcttttacacaaattgagtgttcgccaatggtggaaatgtcgtcctattaaatatttctatttttattattattaataataatattataattaatttcatacggtaattgtaatacggccactggccaacagattggccaaacagtcgttcactgctgggtgctgttgaaagaagcgatgtgctggacgaagcccgtacatgtcatggtccctggatttcgatgttattatgttttctcgaaatcttattctggaaaattattaaataccaatttttttctcatcttcttatttatttgaattcaaaaaagaatttttcacaaatagaataaaaaaataaaattatttttcttcaaaatttatttttaaaaatccattaaaatatggtaattggtaagaaaataatattttttattggatcatttgaaaaacttattattgtaatatctatttttgcttttaggctgaaagttctaattttgaaggttctagactttttgccttaataaaaatctctaaaataactcaatttaacatctttattttcaaactattatcaattttatcattttttaaaataatttctttattgaataaaatttttgaattttcttattgctgtcactactgtttttaattattattctatgcataacattctctgttgcatcgatgctcatgaaaatcgt

SEQ ID NO: 34747 - DNA, 1180 bp, Heterodera glycines
  misc_feature (75)..(75): n is a, c, g, or t
aatactttcctccccttcctgtttcgtgatgttcagatgcatccattgcattccccctagaccatttacttttcncacgggaaatgcaaaaattggcatccgccggagggatttcccttcgcatccgtaaaaattggcattagtctcatttctgcttttgtgcagctctgcattcgaaaaggtgaactgcaacatggccgtgtgtgtgtacccccgggggccgacttgttgtggcaatttcacaccggcgacagtgaacaaccaattccaatgcgtatgagaaagggcacaggggaagaagtgatggcacaacactgtcagatgaaaatttgtttggtttttgtttattatttaattggataatgggcaaaatgattgaaaaagccgtggccaatttggcccaatttgcttttgtctctccctctctctctctctccctttttcgcctctttccttcgctctctcatcgtttcttcccccattttctattccacaaattcttcagcaatttccgtaacagttgaggccgttttcttgtgattttgttcttcctcagactggctcattttgcaaattgccgctcaaataatccgccgctttgttcctacaaatgaatgcctttttctgtcaattgatcggattgaaaacccacccgatggctcttcccatcattcctcccatcggtcccattgccattgtgccaatcgctgcgcccaccccgggcgccgccactttcagcgcccgcggcgccagttcccgcgccacaggattagcgtaagaaatcgccttgcccccgacgcctctcactccctcccctatttttgaccagccctgacttgtccatcccttgctggctattttttcattattctcctttttgctattcgttttctcttccttagtagcactatctttggtttctgtctctttctctttccaactcactctcttttccttctttttctccttctgactgtctccctttttccccctttctctcctccccttttcttcttcttctttccaattaactcttttttcctcctctgtctcctccttccagttgtctctctcttccttcccctttcttttcttctcccacctctttcttctttgcttcttttctgctgttctttctaagtctgtattgttttcctcatcaccgttttgtttcttttct

SEQ ID NO: 34748 - DNA, 803 bp, Heterodera glycines
cgtctctgaagcagcggctgagcgacgcgggcgtggactttaaggaggacttggagaaactgagggagctgaagattctggtcgattttgacgagcagggctatttgctccaaatattttcaaaggtaaatttatgaaaggggaaaacccgaaaatgaataatgaagcctaactgatcaattagttgattaattaagccatgccaagaccgccccacccttttcctggaaatcatccaacggcacaaccaccaggcaagtgggcacaatgccaatgtcgtcggcgttaggttgccaatgccaaaatgaccaattccccccagggctttggcgccggcaacttcaaagcgttattcgaaagcatcgaggcggaacagaacgaacgtggcaatttgttctacaaagacgtggcggtgggaggagaaaaaatcgaagcgaaaaaaagcgaatgaaaacggacgaaagaaaagaaagaaagacagcactaattgaaaaccaatgagaataataagaaacaaaatatttatcaaaaaaatgcaaataaaaagtgaacgaaaaaaaagaaaaaaaattggggaaaaaaattgaattggaatttgtcggcattttcattgttaaattattttcgataaaataccgtattccgttccaaaattgaaatagcatatgtaaaaaaaaaagagtagagcggaaccgggaccaaaacacggacaactgagtacaactgagtaccgaggtcccggttttgaccgggaccgggaccagtcccgggttttttcccggttttcccagccaaaaattccc

SEQ ID NO: 34749 - DNA, 931 bp, Heterodera glycines
ttcagaaaatggccgagggaaaacactcagtcaacgacaaaaacggcacttccgttttgcagaaaagcgacactcgcaccgattgcatcgatttgcgatgtgacggtcccatcgatcagtgcacggaaatgctagcgggaaaggtaaatgggaaatgaactgttagaaagcgttttaatgaatgttgtttttctttacagatatttgacctttccttttggaacggtgccgaacaatttttggctcaacccgcccctttggggggttacgaaatgtaatttttgctcttttggctgctaatgacgaaaattcagagttcggaatgcgctttctcagcacattcgccacctgctgggcgagtccgtcccctccgatcaacttttgctcgtgccaaatgcgtccgtcgctttggagctgttcgtccgctgctgctgttcacccggcggtgatttcctttggctggcttttcttcaccctcccacagatgtcgtcctttgtccaattccctttgccgatgaattcctgtcggaggaattccgttcaaattcctccattgactttgttacggtcaatttcccggtacattttggcccttctactgatcagaggcgcttcctatgatttccagtggaattcgtctcttttgaactgtgccgaattacaacagacaacggaagggctggggaaggtgggccgtgtcattggtccgttggctgatcagccgaatcagaggacgaaaatcattgaaaggaggcggaacaaaatgagagaaactctttaaatttcgaattgatccaacggcttaaaaataatctccgccacctttcttgcttgaaatcagaaaaaattggaaactttcagaaaatgtttgtgttatgtttgttcaaaaacgagtatgtgccccttctgttgcacaaccccaaaccccaat

SEQ ID NO: 34750 - DNA, 722 bp, Heterodera glycines
gagcggaatttttaagatttccggtcccgtacttcttctccagcgcaattctttaccggagcggaatttttaagactttcggacccgtactttatgacccagcgcaattctttaccggagcggaatttttaagatttccggtcccgtacttttggcccagcgcaattcttcaccggagcggaatttttaagatttccggtcccgtacttttgacccagcgcaattcttcaccggagcggaatttttagatttccggtcccgtacccagcgcaattctttaccggagcggaatttttaagatttccggtcccgtacttttgaagcgcaattctttaccggagcggaatttttaagatttccggtcccgtacttttgacccagcgcaattctttaccggagcggaatttttaggatttccggtcccgtacttttgacccagcgcaattctttaccggagcggaattgttaagatttccggtcccgtacttttgacccagcgcaagtctttaccggagcggaatttttaagatttccggtcccgtacttttgacccagcgcaattctttaccggagcggaatttttaagatttccggacccgtacttatgacccagcgcaatgctttaccggagcggaatttttaagatttacggtgccgtacttatgactcagcgcaattctttaccggagcgtgatttacggtcccgctcgcgctcccggaaa

SEQ ID NO: 34751 - DNA, 996 bp, Heterodera glycines
acgcgaaggaaattgcggaactttcgttcgctttcctccgcacggtgtccaacttccgcgtcgaccacctcccctccgaacgcgtcaatctgcgcatcggcttccattccggtccctcccctcccctcccatttcaaatttggcattttcaggcccagcagtcgctggcgttgtcggtctgacgatgccgcgctattgcctttttggggattcggtgaacaccgccagccgaatggaatccaacggaaagggtaaaattggggggggggggggggggagaaaaaaaatgtgcaactatttaatttagaaaaaaacagaaaactttttagttttagaaaaaaattggaaacaatttaatttatgatactaaaaaattcgaaattttttaagaaaaattaagaattttcagcgccttagtaaaaattttttttaataataaagaatttgttcagcatttaaaatggttggttggtgataaatgttgtagaaaaatcggattccaaataagtttaaggctattgcttctcaattttctggtcgaaatgccacggcgattttgggaatgatttcatttttaaaaatttgtttcctaatttgttttcttgtttttttccaaaatttaatgtcaaattaacttgggtctccgtttgttgtttacattggcatttcttcaaatgttggcatgtgccatttccgttcctgttcaaaacttcagaaatgctcgactcctcccgttcaatccattaataactctcgaactttgcttctgcagcacattactcttattttagtgcacttaattttataaaaatgcttgtaaaatttcaaggacaattgagacgaattttcaaggaaaataataaaacctttaagaaattcaaactattgcaatatgtgtaaatataatttataaattagctcggtaaaaaacaatttgattttaattaatgacaaaaaaacgaatcccgaactcatgagcaaattgtttttttcatg

SEQ ID NO: 34752 - DNA, 673 bp, Heterodera glycines
  misc_feature (583)..(583): n is a, c, g, or t
ctctctctttttctctctcttcctctcccgtttcctctctctctatcgcactctctaccgctctctctctctctttttgtctctccatctctctcttctctttctctctctacacaacctctctctctctccctctctttctttctcaatctccctctcttttttcctttcctcttttctattctctcatcacatctctctctatctctctccttttctctagctctcctcacttttggtcatattttttgcagattttcatcaaaaattcccaattttgtaaaattgttatttttctggattttaggaaaaatttagcaaaattgtttggaaaatttggatgaggtaagtcttggaggggtaccaacaagaaaaaccgaaattttagcaaaaatactattttccttaaaatttcgggtgcggaagggtcttgggggggggggggggtacgtaccagggatgtgcctaggtttcgcttttcgcatttcgcctttcgcattattcgcattttttggcgtttcgcatttcgcatttcgctttttggcgcgaaatgcgacttttacacccctaagaattggattanattcccataaaatttttcaaaattttacctataaattggctaattttcagtgaaaaacagtttataaatgatcaaaatttcctatttttt

SEQ ID NO: 34753 - DNA, 726 bp, Heterodera glycines
aatatttggtaggtgttatgtggtgataccctccttcaccttagattttttgtaatttttttctgctgtattgtaaaaaaaaaaatgaaaatttgaaccttcattatcatcatcttaaatatcgaagaaaaaaaatagggagccgggtcacaaaagcaagagcaagtatgaaaattaaaaaaaaatttttttttgctttatctcgaaatagaaaaaaattacggggttgctgacctaataaattttcttaaaagatcaattaatgtattcatttggctaaattggccaaatgtgtacggctcggcctttacattttttaatagttttttttttaattagattcgtgttcgggcaatcaattcggtgggctgcagtgcatggtcacagccggtcagcttcaagacttgtgttcccggattcccaggctcgccgacaagcatcaaaatcacaaaatgtgagtctcaacggtgcctgatggattttgttcgttaatttaaaaaaaccatccaaaaattttcaaataaaaaaaaccattcatgcttaatatcattcgataggcctcccttacaaattaatgttcgctattaacctgcattaacgaaactttttttgtgctaatagagattattcaaggctatcgaaaggactaagaataaaatttattggttcttttcagcaattttataaacctttttttaatttaaaaattcaaattgtgagtaaaac

SEQ ID NO: 34754 - DNA, 1335 bp, Heterodera glycines
ttttatgtgcacggagaaagggaagaggaggaggaggaggtagaggagcacttggaaagagagtattacggaacgcaagttggtgcagggagcggcggaagaacggcgcaatttgctggaaggcgccggaaggacggcgccgccgacccgcgccgcccgaggcgccatcggcccgaatcgcgtgcctccgactcggcaagcattcactttttgacggacgaccgggaggagacgaggggagacggagccacgcgatgggaggcgaaggatcgggcggagatccatctgagaaaggtcggggaaagcaaaagcccaggaagcagtcaacagctcttcacttgctgtgcttttcgcgctttaagccttaagctgccccttttcccgcttttccccctctttttgccctccctttccccatttgtttggggcgcatcactttcattttcttaaaacttcctccattaccctccgccgtttgttcctcaattatattcatttctcggcccctcttttccaaatttgccgttcctcctctccccctccccttccctccctccgcttcgttcttcgcttttcgtctcccgtctctccgccctctctttttttaaatcgccaatggcacgtcaaaagtttttttaaagcaaaagaaaacgaaaggaaagaatggattttccagattgaaagattttttctaaaacaaaaagtaattaggagttttaaattggacgaattgccttcattcgcttcttcctctgcttccttcaattcttttttcagtctttttcttttccgtctctcatcccttcgcaatttccattcctccctcctttctctcttttccctaacttaactctctttttcctctttgttctctcttcacccaattccccccgccttttatttcccctttttccacttttctcctcctccccccccctctctctctcttttctctctctctctctctcttgttgcttctcatatccctccctctcttctgttccctcactctctttgtcccttcccattgcctcattttttattcagccgcttttccgccataatccaccgttgcggatgggcgaagtggactattcgccgaatgacttccgtcaggcgagggcggccattgaagacgcagcaacacgacaacaaaacgatgggccatcgagcggggggaggagaagcgcagggagcggacggagagtgcggcattttggggacacaacagtggtcgggcaataggacaaaaggggcgacggggaaattggggggaagggggggggggtaaaatggggaattaaaaaaggggatagagggggcgggggggatttg

SEQ ID NO: 34755 - DNA, 874 bp, Heterodera glycines
tgaaaatgttgcactttccattaaattttttccagccaaagactgtttcgccgccgaaattcaaaccgattggcgaactgtcggactatcaacagcaaatcaacggatcgaaaggcatgcagggtttgtctattccttttactacttgtgtactatttttcttgaatttcagaattttcaaacattcgattggccactcctccgcctcaaccgtcgccaatgcttcacaatgttccgttacctccagcgatcagtgtcaacgatatgatggtggaccgcaattacattgcaaaggtgcgttgccacttttattaatgtttatattagtaaatgtctcatttttcgcttttcggacacacaaattttcactcgctatccattaaaggggatacgaattacagaggagcgggatggttggcagggttagacgcaatcgcgttatggattacagaaattacgaaaacccagtcacgttgagccctgttgtacccgttgcacatgtttcattcggtttcaaaaccctattccgtttcatttctctgatttcattagtccgaccattttaaacaattttgtattccaattttttccaacgttctcagggagtctcttcgccgaagttcaaaccgattggcgaactgtcggattaccagcaacaaatcaatggatcgcaaggtaaatgcgttacattcggatgctgttgtaccagttttcttatttgaattttgttttagaagtttcaaacattcaattcgccactcctccgccgcaaccgccgccggtgcttcgcaatgttccgttgcctcccgtgacgacgaataacaacgaaatgatggtggaccgcactttgccgaaacacacagcaaaggtggca

SEQ ID NO: 34756 - DNA, 1537 bp, Heterodera glycines
attaataattaatttccatgaataatggaagaaattttaaaaatttattgtactatttcaattgttcttttcaagggttactgtaggagtgtttaaatttatctttttttttttctatatcaaaaaatgaattcttgaaccccataaaatgtccgaagataaaagagggtcaattccgtgaatatttcaagaccattttcacgaaatttgtcaccatgtctcccaaatcgggggggggttttatgtgtttgtcgcgcttatggcactttttggagtaatttgtacgatcgtccggttggctttgtttaattctgcagattattaggcatagattaagatgatctaatttttttatatctataggctcttcatcaacgcatatatcacacaatgcactaacttcattgtcaattataataaacaaattcactctatagaatcatcaaaatatgctaccgatggtagtgtagtactaagcaatgaattccaatcattagataaatctatcaacccatcgtatatgatctgttcatgtttaatctttgctatctcattcatttcctttatttatcatagtcaatccaatcctctcttcgctctcgtattcattatttctttaatatacttttacaaattcgtgggatataacatagtccatcttggtagattaaataaaacgaaaattagatatgataacttgttaattaagaacaaaatatctctctctcttattttagtttatcattaattagatgttctttaaaaaatgcatcagcatcaattagtcacatttattaaactctctaggaaaaaaacccaagaaattacacctcattcacaacactatgtatgagttctaagggatttattgacatttgcattgacattcattccattttattttattttactttacatttcatattgttgtatttttttacattatttattttgattttttttatgcgccacataagagcactaatgtgcctgtggtttgctcaataaatataaatagagagaaattacaaagaaaaagagaaacgacgagatagtactaggcttttctctgcacagtggagttgacccatagtgcactatcatttcggtttcagaattaaaaagaaactttcaaaaatgatatcacaagggaaaacactagagaccggacttttgaaagtacccggaccgggcttagataattgaccgggaccgggctgctcgttcaaaaaaagcccgttttaccgggcgtcccggggccggttcaaaattttgcttgggattaattgtttatagtaaaatgacgagtgattttaattccaaaagaataaagctaaaattcttcaatccgaatcttttttcaaaaaactttgaggaacagggggagggagggaggtccgggagtattgtttttgtcgaaaaaatgaccaagttttgtacttttttaaattttgtctttttgagccttttttaagagaacacggatttttaggggccgttggtaaagttttatacatttctacatacatttaagcaa

SEQ ID NO: 34757 - DNA, 834 bp, Heterodera glycines
attttctttttgtatactcattggtttcctatcgacaaattatgattcctcaatttttttaattgtattttatcatttttaaagcaaaaatcagccatttttgttgaaaatctgttaacaaatcactcaaattttcaaaatttcccccggcggcgcctatcggcaccgccggacccctcctttcccaaaagtcttttggaaaaagcgcgccaaaaaagtgatgtgaaaagcaaatctgaatttttataatattcgatcatttagtccaaaatgattaattgttgaaatgattgaagaaaatttgatttgaaaattttcattaatttaatttagctttacttttggattttattaaataaaaaacaaaattaaaatttaattttgtattattttctattgaaataaattaaaactatatattttttaaatttttttgaatttttgaaatttcccggttggtcccggttcccggtcccgaagaaaaatcgaggtcccgatcctggcttctcaggtcccggcaagtcacggtcccggttttggcaaaaattcccggtcccgtggcactctacctttttgaataaattttgtcattttacacccttaagaagaggtttttagtagagatcggaccggtcggtttttcggtatttttcgattttcgttttaggtttttgaccgaaaaaaccgaccgagaaatttttgagtttttcggtttttttcggtttttaaccgaaaccgttcgaccgaaataatcaaaaaaccgaaacaatcgaccgacttttatgaaaaatcattttcttaacaaaattcattaaaaattcttaaaattttccc

SEQ ID NO: 34758 - DNA, 1017 bp, Heterodera glycines
  misc_feature (11)..(12): n is a, c, g, or t
taaagtaccannttttgggcgccaaaatcaatgggcacagctttgtacaaaacggaatttcgtacaaaaatttatttttttttttgaaatttcaagtgaatttttttttgttagaaaattggaaaataataaaaaaaaattatataaaattaacttgtacaaattccattgtataaacgaagtggcatgaaatttccaatttcagtcataaaattaatccaatatatttcccaattgaaatttagagagaattttccgagaaaaattcaaaaaaaaaaaacaattttttttaaattttgaaattatttttttacacccaaaaaaacaatattaaaaaattatttaagcaacttgttattaaaggcaaaatcattttatgaaacaaataaatgcaatttttgaatcgaatttcaaagaaaaaaataatttctttaaagggaaaattcaaaggcctgaaaattaattcactgaaaaattaaaaaaatgaaattttcgaaaaaatatttgtttttttggcacacctggtcccgattcttgatttcctcgtatggcaatctggaggtgagcagttcgtacacgcatatgccgaaggagtacacgtcggaccgggtgctgtacggctcggggccgtccatgcgaatcacttcaggggcctggaaaaaacggtcaatcaatggcaatttggacacatttttttaaattttacaaataaaacctcgaattttttttcctaaaaaatattcaacaatttttttgcctgaaaattgaacaaaaaaaaattttttttttttttttgctaatgttcaagttttataatagcaatattctatttcgcaagtgccctatctaacaataagtaaaacatagtgccaactttatgccagtaaatttttatgactaatttaaaaaaaaattaccccgttttggcatttttcctacaattcgggaaaattttaggcatagcaaaaaatgtttttctccggggataaacaacattttttttttttttgctttttt

SEQ ID NO: 34759 - DNA, 935 bp, Heterodera glycines
aattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaagccaacgccggggaaagaccggcagaaagccaaccaaccagtaacacacaaagtgtgcaccggacgctagcacagatccactacgagcttttt

SEQ ID NO: 34760 - DNA, 1099 bp, Heterodera glycines
  misc_feature (57)..(57): n is a, c, g, or t
  misc_feature (64)..(65): n is a, c, g, or t
  misc_feature (88)..(88): n is a, c, g, or t
  misc_feature (94)..(94): n is a, c, g, or t
tttgcgagtcagttttgtcgacggattactttacggactgacaaaatgcgtgattcnttcacannttcctttgaagtagagggattgncttttnccgtttccaaacaaaaaaatccgccttgtttcgtctgctcctcgagtcgtttcccggttttttgttcaccctttttgtcgacagtccgttgaaagttgggggatgtttcccgtttaccggaatgtcgctttggctcgtctaatcgtgggttttactttacccgtttacaatttttagctgtccacagtcggttgattaggctcttctcttgttgggaatttgttttccctttttccgatttcttcaacacttgtcgagggatttactttcccttttttcaattcgaggccacgtcaaatttcttattgtccactgctgattcaccggtgccaggagcgccaagtcgtaaaaaaacagatatgattgttgtcagggggcttttaataatgttgttgcactgcccacggcaaaagacaacagcccaaagcaaacacaaaacaatacagcccaatgccgaagatgattatcgtttaattccaaataaaattagggcgaggacaatcaataggaaaactgcgacagcataaactaacaaccaacactccacaaaaatcacaaacaaaaatgaaacaaaataaataacaaaacgccaaatatattttaaaatcacaatattagcacaaagtgaatcaaacaccctattagtgctttgctgtgccgagaaccggcaggcaatggatggctttaaatctgcaagaaattaaattggcaataagtggttgtaaaaaacttgtgtaaggaattattttttgaagtgaatcaaacaccctattagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttgctgtgccgagaaccggcaggcaaaggatggctttcaatctgcaagaaattagattggcaatatgtggttgtaaaaaacttgtgtaaggaat

SEQ ID NO: 34761 - DNA, 851 bp, Heterodera glycines
  misc_feature (30)..(30): n is a, c, g, or t
attgctctccgcgcccctctgcccatgctngggaaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatagccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatagccattgctctccgcgcccctctgcccatgctgggaacatttgtatggtacaaaatttctcgcaaaaaagagagccatttttctggcatagagaataaatttaaaaattccctgtagaatataatggccattgctctccgcgcccctctgcccatgctgggaacatttgtatggtacaaaatttctcgcaaaaaagagatagccatttttctggcatagagaataaat

SEQ ID NO: 34762 - DNA, 1245 bp, Heterodera glycines
ttaatttcacaataattaaagtcattttgattgttcgtttagtaattaattttttaataaatattcgatttataattttatttatttttttatcagagtaactttgttaaaatttaattttcatgctcaaaaattttctatatccttttaacaatagtttaaattttacataaaggtattttatattcataatttaattatttacaaagattcacaaaaaaaatttagtttattatttaacctttttggctcattaagcatttaattttgtttttaattttcatcgaaaacgattaattctttaagtaaaattaaaattttatttttttaataagcataaagcgtatgttttcttgtttttaaatgatgctattataataaggtgtattaatatatttaatttaatttttaatttaacgtattttttcctatccggttctttattgtcattttatctatattaaattcttttattttattgacttgtttgtttagctgatacgttttaatatttttaaaaatttttacgatttatcgtccaaattcttattataaaattataaaagttttctaaaatattatcaaataataataaaatctttaactttttcatttatttcacccaaaaattaagaaatcgaatttaataatcttatttgtttattaatgtcttttttagtataaacagaaggctctccgtaaatgttgtctgtaaatactgaccatatccgacattttttgaatttggaatgccttaaatagtaatttttggtaattttttaagaaattgtaaaaatatacttaaaaaatatttttcataattccaattcgtaaaaatatacttaaaaaatatttttcataattccaattctcttgattccagtgtattattacgtttgatgtgttttaatgaattaagctttccattcctcaaacaatccaattgcgatttttatttataatatgctcatcttcattgtgaacaattttttcttattttaaaattatccattatgcttattttacaatagtatttttattaaattaaactcattaattttacacgaaaaataattaaagaaattattttttattaaattttacattttgttttcgcgtttcacctccgcatctttgaatgttgagactttattcaacgaatttttcaaaaaatgaatgttcttttaaaaatttatttaaagaaactaattttttgattattttttgttattttttatttttttt

SEQ ID NO: 34763 - DNA, 1422 bp, Heterodera glycines
  misc_feature (737)..(737): n is a, c, g, or t
gtactgtatggacgtgtttgtaccgtaccctctctcttaacttcgtcgattgtttgtttttacctctcccaaacccgggctgcagcttggcaaagttgccaaattccatgtagtccagtagaaaaagtatagtcagccgtgtcttacggtacagctgcaactcattccattcgtttgcgatcagataagtacgccttaaagttgagggagaggaggggcgtaggacgacggacaaagcgcaacaaaaatggcaaatttaaagtatttaatgtcatttaacctaatttaaagcttaattttaattaccaaatgaccaccgacgagtgttggctgtcctttgctttttgttctccttttgcctcgtcaattggccttttctgttcagtgtttttaagagcgcgtggcctttaccaatcgatgaaaaatgtttggacaagagtcaaacagctgaaaaattaattggaataaaaaaaagaaaatttaaaaaaatcaaaaatttaattcgaccaacaccaaagtgtgggccaaagacagcgccttaagtgccacggcagagaccaaataggcgacgaaagagccttcttgggaatcggccaacggcacgtaaaactgagaattgaaaacaacaaaatattgaaaataattaatggttagaattaaatgccatgggaagagagaaagtggcaaaattgagaaaaattcataaaatggcggaatggaaagaattattaattagnggaagatgttaaaacaaatttcaacaaaatgtgcacaacaaataccaagtgactttgcattttgtaggcgaaagtcagccaaacggagatgatggccatgacgagcagaaaaacgttgccaatgccatcggcagcgtacagcaccaacttgagaatggtggacgcgtcaatgatcaatttgcccgaacgacggccccaactgaaaaattgactaattttttacagaaaaaacagttgtaaatttgctgatcaaatctgatcagtgagtgagtggttcggtgcgattcagccgaggtggaagggaactaatacatcttataattatgatttgctttgaccaaaccattaatctgtggtcgaatgggtttagcttttaaatttcgaaaattaaaatggggattcataaatttcaaaaaaaaaataaaggtaaataaatgtttaaagaaatctgacaatggaactctctcatctgtcattgacacaaaatattgtccaataatttaattgccattggttttatcctattttctgagctgaaatcaaacatttacaattagttctattttcctattttaggtcctttttatgggggggggagtagatttatggtcctaaattctatattttggcagttggggaacccagcaaaaacacacaaaatgacctgtaggcgcgcactgccgcc

SEQ ID NO: 34764 - DNA, 1259 bp, Heterodera glycines
acacttgaaaaaatcgatttttttgttttcggggcagtcctcccgaaccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctggactttaattctgcgttggatttttgctccccataattggttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatt

SEQ ID NO: 34765 - DNA, 762 bp, Heterodera glycines
ttgatcttttcatgagtcaattactaattactttaatacataacgcgctttggaatgcttaagtaaatcgatttatactccggagcattttttgactaaaaataaagatttaaatattttcattcccacttcttttgttgtgggaccagcaggaggaagggagaaagaatcattccttctccgaaactaactttttcgaaatttggcccaaaaatcctcaaaatcagtcaagatatatatggtcttcgggtcctttcctctagcctctccgatttttttttcaagttatgggggtcttgtttttgaatgttatcaaaaaccaccaaaaacattttaatttaaactaatacatttttgcttggcttattgtttttcatttctccaaatatttttgtccccaattggtgcggtgcacatgttttttgtttttatcagttgcatatgtatgcacacagcattcatacatatgtgagtgtgtgtgtgttgtatgttttcgctcttatcattccaaaaatgggggcggagggcgtacatttgaccccgccccattccccgtcccctcggggcacttttggagaagcgaaaacatttcccatattttcattacctccctaaaacactttctcggttcaaagcagaaataacagctccacagtttggactccctcccccttccgccccaaaaaaatattttgtccaaaacaaattttttctatttctatcacatcaaagccccctcctacccccccccccccgccccgt

SEQ ID NO: 34766 - DNA, 80 bp, Heterodera glycines
ccagatgcagtggcgcgaagcgttacgcctgatgcaacccctccccgatttcaccccgcaatacgttgtgcatgacgcac

SEQ ID NO: 34767 - DNA, 878 bp, Heterodera glycines
ggggatcctcttagaagtccattttacttaagacaaacaagggaattcttaaacccatccaatcgaccattagtagaaaaaagtgattattacgagcaacaaaaaaggattatagcattcaaaccctggcattgtaccgttttgcaaaatgccatctgggtcattttgcactcttgcacttttggcatcaatttttaataacactgaacacttgcaaatttatttgtatatgaaaaatttcaaactaaaaccaaagtgcagaagagtgcctcattggtgtgccatttgccaattgtataaagccttcgcttgtgccctctcccactcagtggcgaatacgtcagcctttgttggctttccgtggtgccatttttggcaaaaaaaaccttgtatttgtgattgccatgttccgagtttacgaaacagtcgtagcagagcacacaagtcgagtcggtcgcgcactgtttgcaagtgtaatttggttctccgttcttgaagattttgccacagatttggccagcccgtgtctttgactcgtcaatgtccactgactcgcgcagccgacgcagcgtcgtgtccggatggccgtcgtccgtggtggccaacgacggactgtcggcacaaaacatggcggccaaagggtagagcacattgctctctgaaacaattaatgtggacgatgagaatggacaaattggagtgaataaaaacaatgaataaacaaaccaatttttgcttcgtccaccaccgcttcccatggcttgggcaaatgtgtcgggaaaacactgtgtgaggctgaaatccaatgtttgtagagcaactcggaggcatcactccaacacgcctcacgcgttaatctctgcagttcatcaatcatt

SEQ ID NO: 34768 - DNA, 1002 bp, Heterodera glycines
tataaaagggaaatgacagaagcctcgaatgttagttatattgcgtgtcacacaatctcttcctgagaaaatttctaaaaaagtgtgccgaaaaaaagagatagtcgtttttacatacgaatattgaaaagaaggcgtaaatggctctgaagcgtccataggccgcagaccacaaagtaaaatgggacaacattcataaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctcttcctgaaaaaattttcaaaaaagtgttccgaaaaaaagagatagtcatttttacatacgaatattgaaaagaaggcgtaaatggctctgaagcgtccataggccgcagaccacaaagtaaaatgggacaacattcataaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctcttccggaaaaaattttcaaaaaagtgttccgaaaaaaagagatagtcgtttttacatacgaatattgaaaagaaggcgtaaatggctctgaagcgtccataggccgcagaccacaacgtaaaatgggacaacattcataaaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctcttccggaaaaaattttaagaaaagtgttccgaaaaaaagagatagtcgttttctcgggtggggtattgaaaagaaggcgtaaatggatctgaa

SEQ ID NO: 34769 - DNA, 858 bp, Heterodera glycines
ttatttaaataataattttaaaaaggaataatgaattcagatcttttttaattctcaaaactctcgaatgctctatggatagaaaggaattttagatgggctaaaaactttagcttaaccaaaaaaattattcaaaaaaaaaactctatttttaagggagctccccttttctgtgcatagaagataaaaattcggaagaaaaaacggatcgagtccaaaaaatactaattcttgattcagaatttaaaatttttttttttgaaaattccaatccatccgatttcaatgctccgcacaaatgtgaaagagcgtgtggaggagagagagcctttgttttccaaaattgcttctccgttgactgtgtaaaagctgccactgtgtgtgtgtatacatatttgcttaggcaaaaattttctcaattttgggctaagccaaccgttccggaaaattttgccggaaattcgtcctaactcagtagtgactggcgatgggccaatatttggggagaatttggtggaccagaatcccgcgagaattagcataaaattgacgcaaaagaatggaaggaatgcgtgtgaaacggcggttggaatttaatatttttttcatttttcttaattactaatttaagagaatttttaatttatggccggtcgattgactgaacacacagaacagaatatttttaattggatcaataagaatgatcaatttgaagaagaatggagaaacaaataaagtgcatcaggacagtgaatcaactaattgaattaaatatacaaaaaattttttgtaaaaatattaatattttggatagaaatttattaaatgtttagaatttattcaataatttatttt

SEQ ID NO: 34770 - DNA, 1339 bp, Heterodera glycines
  misc_feature (49)..(49): n is a, c, g, or t
  misc_feature (53)..(53): n is a, c, g, or t
  misc_feature (77)..(77): n is a, c, g, or t
agcgcgttccactggcatgtgtgtactctacttaactgcatcccatttntacngaatggctgcgaattaatatattntagcaattatgattaaggtttttgatcaaacaagaaattcgttgtagaattatttttttataataaattaaataattgaattatttttttaattataaatataaatgttttttaaactcttcgctatgttccgctccttgtgtattttgggattttatacatatatatgataaattattgcaggaattcaataaattaaatagataattttaaaaattcttatcgtaaattttatatgatttattttattttttacgtttatttatttaataagataatattttgaagattcattaatttccatatttctcatgcggtgtcttgaattataacaaattcttgactttaaattattaaattttataaaaagtgacgaaagtccgaattaacaacgcaaataaatcatccatatttaaaaaataagtaaatgtagttttttaatgtcaattcattcaaaaaattagtttttatttgttttctgtatagatgtaaaagtttgtgaatgtgatatattttttactaatatgtcaacctttactgtataattaattttaattagtttgttttctaatcgtttctttttattattttcctggcatgtataagattaagctgtttatgcaccttatgcttataaattattgattgcttacccacgcattcaacagcttatcagttttattttgaattgaaatattttttgtaatattttttattgttgctttatggaggtttataaggccgagcacataagctactttgagttgcatttaaaatttttattatttaaaataatatcgtataaaagaatcattgtttaggtacaatatatttatgatttttgaaatagggtgattatattgttttttttttattaatttaaataattttatgagcggtattggtttttcattagccgttaccggtaatcaccggtactggaaaaaccggtaccggtaacaaacaacattttcagtcggtaccggtaaatggtcattttttatcttaaattttttgaacatttctaattctataatttatttataattgtctatatttttagtaaaattgcatattttaaagatctgttttcaagtaatattaaatacgttaggtacctgtttaccgctctactctattatcggaaccattcatcgtcatcttttgtgtctataatataatccatatatttttattcataaaattaattatcctttatataactaaatgaaattgattttttcaaaatggtttgtttttaa

SEQ ID NO: 34771 - DNA, 722 bp, Heterodera glycines
  misc_feature (682)..(682): n is a, c, g, or t
ttgttttaaggggagggggcgagctgctcacagatttacttctttagaattttcaatttaaaatggtaaacataaatggacatcactcactgaccaatggcaaatcatcatcattttggctacccaatggccaacaatgtcgtagccagtctccatcagttccaacgattggccacaaatcggtcggtcgggccacccggcaatcacaatgggaatcagcgaggaactgacaataaacgtggagatgaacaagttaaataatgctgccgtccacaaataaatgatttttaattttataaattacaaatcaaaaattcacctgaaccacgtgtcgagcacgtccgggtcctgtagaagcggagagtccgcttcatcagaggccaattgagcgcgcgcatcggcctcggattcggccacaatccatcttaagagaaaggtgaatggatatttgaccgtttaaatgagcaaaacatcaattagttagttacacattatttgtacataaataatcattattattgccatttttgtttaccttttagacttctctacgaaatatgccggaattcggtgtccccaaacgatctgacggctcaaattccatggttctttgaattttgtgaactcctcggtgatccctttgttcatcggaggtttgaaattgaacttaaatgattttganggtacttatatggttcgtacgccataaatttaaatatatt

SEQ ID NO: 34772 - DNA, 722 bp, Heterodera glycines
  misc_feature (51)..(51): n is a, c, g, or t
attctcatttttaaattttttatagatttttaaatatttcggatttttttntggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagccacgaggccgcgaagcggccgagtgagtaccttgggcgcaggaaaattattaaggaggagggttcattatttatttatttttgcaaaattaattcataaatttttttcagaaactgctctgaaacgcaccaaaatttatttacaagttgaataaggcactctgactcttatattatcaaaaagggagatgaataaatattttaaaaatttctaattcctttttaaacaggccgaaaaagtttaggcttaactttttcagcgggtttaaaaaatctagaaaaattagtaagcatttgtagtgctccgatacgtatctctgcaaaatttggtgagcccctgatcaattacaaattatttatggacgatcaaattttttgaaatttttttaagtgcaaaagtgggtgggtgtctgcaaaaaattttcaccgggttta

SEQ ID NO: 34773 - DNA, 297 bp, Heterodera glycines
ccaacaagcaaatttttgacagaagcggcaccaatttggagttgtctatttcatcaaatgaacagccaatttgggatgtttttaccagtgaaatttggcccgtttttgcaacaaacattcgccatttgacctttgacgagcgcgatcatttggacaatttgcgtcgccgcacttcaccgacaattctcgctgatcttgatcaattgaatgcaatcgatattgttaatttgttgcccgatgcaattgatcagcttgatgggccaaatgcaatttctgctggtcacgcgctgtccaaat

SEQ ID NO: 34774 - DNA, 1377 bp, Heterodera glycines
tttcgctttcgccctttcgttttttgggctggaagaaggaaaaaaaagtacccccctaaaagatacagtttatttttttgcaagtcaatttctcgaaaaaaaatttttttgccacaataatattttaatataataaaatttttaatttataacggaaaaaataaacaataattttcaaaaaatgcaatatcgttttataaatatttatatacaaaaatctacgattaaaaattgattatcgtcaaaaattaatccaaaatttgaaatttgttggtgagtatctttaaaataatgtaaaacgtatgtaaaaaatttccaacggccctaaaaatccttattctcttaaaactgtcattttggcaaaatcataacaaaaagtttcaagaaatttatgacaaaatatgttcaagaaaacttgcttttttgagtttctcaagtcataatttttttaaacttagtgaattttttgtaattttgcaggataatagaaaacaaaagatcaaagataatttgggcgaatgaataattttggattaaaaaacttcaagttgtcgacttgaagaagaactaaacaaacggaattcctttcataaaataaacatcaaactaatgggataaaaaataaaattcatattaataattcacctatctaaatcttcatctccataaacgaccctagtccctccgcggcagggtctgtatcgtttcggcgccgccgtttcggcgccagcccttgtttttggactataactttttttgttgtcgatcaaatctaacaatcttggtatcattcgaaagctgaacatgtttagaagctatttctaagcaattgcttagcgattagtcgcttactaaaaaagttctaactgaaaattgcaaaaaagtcaaaatttttgtgattttttcttaataacttctttacaggtcaaattttttttttggttttttggggggaaatgccgaactcctatattagtttccacccgataaatcgctgctatgaaacttgaggtgatacccataatttctgtgagatggtccgaaaaataacttctaaaagtttagtcaaaaagcctccatgctaaaatcctagagcaggattcgtgatggattactcgaagggttaatgctgcttgtacattctcctgctgttttagttgctggattcacataataattgcggtgttgtttggaacccgatgactgcgctttgttcaacttaccggaaaaagggactggggcccgggataagaacggagagctaatgagttgcgttgcacggcaggatctgctggagacaaaaccgggacagatgtgcatggatgggcacattgtgccgtacccatcgatctgatccgactgatctgaaattgcgtc

SEQ ID NO: 34775 - DNA, 855 bp, Heterodera glycines
gagagcgagagagaaggcgagagatagagcgacagtgatagtggagagagagggagagcgagagggtggagagagagagagagcatgccttcacttctcgcctttgacttagaactttgaaaatcgtccgtcatcagccgttggtcaaacacgggcggaagtgtgacgtcaccagtggggcgtgaaaagggaataaagatcatcgccaaaaaacgtctcaccaattaattaaccaattaattgatcattgaggcgcctgccgacagatggagcgatgagcaaagcacacaaaaagtgccgttggcgaccatggggaaaggggcgggggcgttgtcgtcgaccaaagatttgaaaatgtgcaaaaattgcaaaatcatggatcgtccaaaggccaatttcaatcattaaacagaataatgcaacaaaaaattgttgttttattggcgttttctgtgctatgttcagcaaatggggagggggcataggttaagcaaaaatcattgataataaatttaaaattgcaaaaaaaaaaaaggaattctttggcgttctgacgccaacccccaggggaatcggccaaagataaaaatacgttttaaaaataataaattaaatcgacaaaatttattagccattcaaaatgtttggaataattgtaataaattaaaaattgcaaaaaaaaagagtaattctttggcgttctgaccccacgaatcggccaaagataaaaagcattttaaaaatatgaatttaaaaacgagaaatttattacccattcaaaatcattggaatatgtaattgtaacaaatttaaaaaaagggaaaaaaactttggcgttctgtcccttcccccctc

SEQ ID NO: 34776 - DNA, 1068 bp, Heterodera glycines
  misc_feature (18)..(18): n is a, c, g, or t
  misc_feature (38)..(38): n is a, c, g, or t
  misc_feature (115)..(115): n is a, c, g, or t
aaatttttatttcctatntagtgtattcttacatattncagcatttttatacatatttattacatatttcgcaaattttcttacataaaattagcagccctattaattaatcatntaaaaaaataagtaaatgttaatttatccaaaagttaaattcttccttaatccttcttactcttttagaaatattttcttaatttttctatggattttcgagatcagttagctcggttctgtaaattccaaagtgtcaagagtgaacaaatccataagaactttaaaatatgaattttatattgatgtagaaacttttcgggtttatggatctaaattttgggcgcctgtaactggggataggatcttggcatttttaccagtttaatgaccagcaaactcattttatgttgttcaatcactacagactcaacacttcactgtttggtctttctttgtttcggggaatcgtccaactcgccgctttttgttttacgactttcttgccgccatatttttcgatgcaataactagtcatcactccattaatttgacaattattcaataatattttattccgaaaaaattataaaataacttaatcacgtgtcaataagtgactggaatttagagcaggccgcgatttgaggagcaaaatgccgaaaaagacgtgccaatgacatatgtttgaagcaattggagtccccaacggcgcggaaaagcatcgctgggaaaaataaatatgaattaaaattataattcgaaaataaaatatatttaaataaagatgaaaatttatgaatacagacaaaagtttcttcaattgtttaggagtgccaattgtttacatatgtattattgtctaagattttgtatttattttgagggaccaaccataacaaatttaaatggtttttatttcacaattcagaattttgagatgctaaatttttgtgaaaattcggcaaaaaaaaaacgattaaatttgtaaaaaattcaatcatcattaataaattttgagttttattaaatgaaatataataataataaatttgcaaaaagatatgcataaca

SEQ ID NO: 34777 - DNA, 964 bp, Heterodera glycines
  misc_feature (907)..(907): n is a, c, g, or t
  misc_feature (915)..(915): n is a, c, g, or t
gtcaaaaaatcattagaaaagagaaaattcaatgtaaaaaatcgataccgttcttttccactttattgggtcatcgttttgccgttaattgttttatgccccccacccctcattaataataataattattaatgactctcagagacagcagaaagttcattcatttctccttcatttttttcttccttactgcgtcccatggcactttaattttccaagggcattttacgcgtcccattattttacgcgtctatcccatggcattttccgcgtcccatccaatactgacgacacaaatatttttttaacattgtttaattcgatagccctatgtaacaaattttaccatttttgtctttatattctgatttcgataatttttcgatgacatgcctaattcatgctcgcgtattttaatgtcaaatacaaatttgtaattaaaaaaattcgatttataaataatccaatccctaattcaaacccaatccaatccaatatctgcgccttccattataaacagggggctgcacagatgtgctcatttagcatcattttgctaatttcaaggggtcaatgataatttttcttttgaaatgatgctttgctgatttatgaagattttttgaaaaaaaaatcctccaaaatgaccgatttaaatttggattatattgcagtcaacgagagccggacttttgcaaatttcggattaggataagagtattcaggactctcttggtccgtttcacaaaaattttgacccgaacattttttgagttctaaaattattttcgatttttttgaaattcaaaagcttgtttatatgccaccatggaaaatccaaaagaaaagccatgtgaaaattatgattcaatggcaaatgagtgattttggtggcttttcgtacganaatcattnttttttgtgccagcatttttcataaataaaaacgtaataaatcattaaa

SEQ ID NO: 34778 - DNA, 1041 bp, Heterodera glycines
  misc_feature (1036)..(1037): n is a, c, g, or t
tttgaagaatttttgagaaattatacccttaatcttgaaaaatgtatgtccatgtttttgccattttatgtcaatattttgaggtttttgcaattttatgtccatattttgcgatttgttttccatattttatggccatctttcgtgattttatatccatataatttgacgccctagtcataattagaacaattaattgtcgcatggacaaatttttttacttcaaaatgttaaagcacagctattccactgaaatggacggaccttaaataatttctctgcttcaaaacttcgtgaattttttttttagacgattttaaaacaaaaataaaaaattttgttttgttgcgtagcaactgcactagtaccgaaactaatgctataacttgatcaatattaaaccaaataaagcaattttagtctcattttgaagggaaaattctaatgaatatattttagtttcgtttttttacgttcaatacaattttacccttaaaatgacggtaatttagtagaatgtttgccctggtaaaaatcaatcaaatgaaataaattttacacgcaaaagaaattttgactaaactttacaaaaaaaaacttcaccggtaatagtgaagctgatgttccctttaattttaaaatttttcaaaaaattctcaaaaagtatgattcttagagttttcgggatcactgatcactaatatttaaatccatttcggccaattgcgaacctcgaaattcgacttttaaaaagagtcgaaaattcagaattcaaagataaataaagcttaaaatatgcattttcacttcatttcacatttaagcaaacaaaatcattaaggagcattttaagcatcgaaatattcaaaatgtcatcaaagtacattttataaaagaaggagaagagagttttttagtgttcgattatttttcaaaaaaaattgcaaataggctccacaggattttgaaaattttttaaaaaatttgtgaaagtctctccaaaaaaaattattgcaatttttgaagaaatgactcnntaga

SEQ ID NO: 34779 - DNA, 990 bp, Heterodera glycines
  misc_feature (971)..(971): n is a, c, g, or t
aaaatgaataaaaaaaacagcaaaaaaaaactccgattccccccccccccacaattttatgaaaatgcgagaaaaagaaaaaagataaaggctaattcgccaaatcttcgtttcaaacgattattctgataagaaacaacccgaaaagcgtatcaattagtcaatttaatagggtaaatcttggaaaattaaaaaaaaaatcccgaaaattctccaaatttttcggtacccacttctcgacatgcccactctgaaaactccccctgctctccaacattgaattattcgcttttgtctgcgaatggcggacaaaaaatgttcgtccaattttaagtatattattttttcccttggccatgaaaagttcagaaattaaaaaccatctgatcatttaatcttagtgaacgatctaacattaattgaatgtttgatgatcctttgaacaaacgcaattcacacttttatgaaagagaaatggaaaaagaaaggagaattctttttttaatttattaaaattatgaattacattttcttgaatataattttgtcaaataaaactatgagtatgctcaagaaatggactgtcctcgggaaaatgcgccctgttaacgcctttttgggattaaattcatgaaaatttccggcggaatttcgttggttattacttttggtctgctaaaaaacagtttcctgttttcaaatgggtttgagtgagaacgatcgtcccaaaatggcctcttctcgtcccggactgactaatgctttcttccgctgccttttttatatggcggcgagcgcagcgcaaagagtcgcgggactttggcaaccgacgggtgggccgcgtctgccgtcatgtgcacttatcagtcgtattaccacgattcttatctcgcggcggagttcgagaaacggagagccatagcatatttatggaccatggggacgaaacgcgggaccattgggcaaatggngcgggggaggagcagcgaa

SEQ ID NO: 34780 - DNA, 1440 bp, Heterodera glycines
  misc_feature (27)..(27): n is a, c, g, or t
tctagaagtctaaataaatttaatctnttggataatataaagttttacataaaatggataatgaacaatgagaatgataaatcgtaataccaaaggataaaaatcactcgtaaaatcaaaaggtatttattaaaactcaaatatcatattaaaaaaaattatcgtattttataaatttaaaaattttaattattataacaaataagtatgtatataaaatttgggaaataattcacgcaatagcatccaatgatataaagaaaaacaattaagaaaggaattaatataataaaatagtagatggaagcttaaaatatataattaaaaaaatcaaaaattttaattcattaattaaatccaagtttaaaaaagaaacacaattgcagtagtatggatattattaaatttatgttggaaaaaatataaatgattataaacatatttttgctaaattatatctaattcaattatataaactcattcatggggattttttgataattggtaaagttttgaacctttgggtattttggaaaagaacaaaatttgtccaaatttgcagaaattttcgacatgatttcttttctctttcattcttccaatgtttattaccaattttcctaaatttgcttattgcctttgtttacccattattcaatggctacaaacttttttttatacatgcattttaaaatttcatttctctgatttttgtttattcttcacttttttacttcttaaattattgtgcgacaaaaacaaaattggtgtgaccacttttctaattttttgaaaaattttaaaagtcaaaaattgtttcaatggggattttctggcactttgaacacgagtctgacatctaatcgatcaatttttaacacaaaaaattcttataaaatcgaaagttcaaatttcgttttttttcgtctaaaaaagcttaaatacacggaggaatactgaaagccgtcactctatttaatcatgtttttgacttttaaaaattaaaaaaattaagaaaattgtattatatcatctgaactagtacgcatttttcaattttcacttattggaaaattaccccttttattgatttttaagattaaataaataaaatttttcaaaacgacttaagaaaaaatttcaacattgattttggaaattttttcagaaaccaattaaaggcattttaattccgtgctgaagcatttattaaaaactgccatccttgaaaattaaaaaatattttaaaaatttcgagattactttcaagaaatttgagaaaattaaattttcaaaaaactttatgaaaaattcttagagaaaattagaattttctaaagaaatatttctaaaataaaaaatctaacacataaaaaattcataactttgctcaacttcaaccactttaatatttcatggtatcattcaatatttaagtgt

SEQ ID NO: 34781 - DNA, 1051 bp, Heterodera glycines
tagtcattttttctgagatataagataaatttaaaaaattctctgtgaaattaaaatggcgattgcgcaccgccccttcctatcatgctcgagagcatttgtaacgtataaaattctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaattaaatggcgattgcgcaccgcacttcctatcatgctcgagagctttttgtacgtaataaattcttcaaaataagagataagcattttttttgcaaattaaaataatttaaaaattct

SEQ ID NO: 34782 - DNA, 1169 bp, Heterodera glycines
  misc_feature (237)..(237): n is a, c, g, or t
aggtatgggtcttcaaaattattcacatagaatgacacttaatcaattagtcgctcaagtgattgactgaacatattattatctcagtatcacttccgaaatcaaaagagaagtaaattcttttttgtaggatgtcctgtagattggttttcttgctcctgtcattatatgtgttatgtagcacctgcaattcaacttttcacaacaaagtttaaaggtcgggtgggttgcttgctncgcgtgggcattttgtgccctgtccgctgatcggagtacgtcatcaccggctggtgatcgctggctgatcagctgccgcggaacgtgtgatcagtacaaatgaaaggcgaacacatttaaatccggattttttttgctcgtcgcatgaaaggggtggaaataatcaaaagtgatcaaacggtcacgggattaatcctccggtcttgcgccatgcattattaccaatgatggttcatcctaattttgaaaacgatgatgatgaatttatgttccctgtttttgcgatttgttggcgcagaggtaatttgcattcatttgcgcgacagttgatcagtcactattcggcgaatacaccaaccaaaacagcaaccccgaacaatcgctgcctctgatcagtggtaactttttaattttataaattcaatttttagtcttttgttccatccgtctaccgcctcaaagtgattgattgatctgaacatgaacagtgcagtgccattttataaggggagagcctaggccgttgattctaaagatcacaattgtttttaatttttcggtatatcctagggataaattctctgtcatgacaaaatgccgtctttcaccccagctaagggccatagatagataagggacagaatcatttgtgcctggacacatttagagaaagcaaaaaaatgtatatttgtaattggtaatgatgctcaagatgacgaatttccggagactcgagaccgacatcgcgactcgatcccgagaccaagactctcaagcataaattactaattgtcgcttgataaaccactaaagcacaggaagctaggtgtgggatttaaaacaaatttttaaataattgcatcattatttaataaaaaaaacacaattatattaagtaaaaaattgatttgaataatcctactggtgagaaa

SEQ ID NO: 34783 - DNA, 841 bp, Heterodera glycines
  misc_feature (661)..(661): n is a, c, g, or t
  misc_feature (759)..(759): n is a, c, g, or t
  misc_feature (824)..(824): n is a, c, g, or t
ggggactgccccgaaaacaaaaaaaatcgattttttcaagtgtccgtttaggggtactcaaacaattataggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcgggngggactgccccgaaaacaaaaataaatcgattttttcaagtgtccgtttggggtactcaaacaattatgggggagcaaaaatcccagcgcagaattanagtacaggctatagtggagctattcccgaaagggatcgtctccccataaatctgggcgcatcggntcgggggggactgcccc

SEQ ID NO: 34784 - DNA, 167 bp, Heterodera glycines
aaaatttgccttataaattagctgaacgtattaacattgagttaaaatatgccaccattgctccttttgtcattgcttttcttttgctttcctccacttcgttcattggttcgttttttggctttttctgtcacttgtgtttcaagtttttttctcttaggttgacg

SEQ ID NO: 34785 - DNA, 928 bp, Heterodera glycines
cgatatttattctcatgggttcttgggaaagtactcaggacgtttttggatttttgtaaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaaagccattaaggcaccgttgtagcaatgatgcacgtggtccttggaaattcctcaggaattaatccctgaatttcttctattttcttatcactcacaaatcactgtgggaaaattaagatgattctgatgattagcgttcttgttcgattttggcgctagtgcgatatttattctcatagttcttggaaagtactcaggaagtatttcgatttttgtaaataaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaatgccattaaggcaccgttgtagcaatgatgcacgtggtccttggaaattcctcaggaattaatccctgaatttcttttattttcttatcactcacaaatcactgggggaaaattaagatgattctgatgattagcgttcttgttcgattttggcgctagtgcgatatttattctcatggttcttggaaagtaatcaggaagtatttcgatttttgtaaataaaccatcagctgatataaagaaaagcattgttgtctgtccttttccaattaatattgccatttcggcatcgggctaacaaagctgcgcatggcttt

SEQ ID NO: 34786 - DNA, 647 bp, Heterodera glycines
agtcccagtgattgaaagcctgagaattgagtcccagagattggagtgccggagatttgagtcccagtgattggaaagcataagaattgagtcccagagattggagtgccggagatttgagtcccagtgattggaaagcataagaattgagtcccagtgattggaaagcataagaattgagtcccagtgattggaatgccggagaattgagtcccagtgattggaaagcataagaattgagtcccagagattggaaagccggagatttgagtcccagagattggaaagcagaagggttgagtcccagtgattggaaagtcataagaagggttgagtcccagtgattggaaagcataagaattgagtcccagagattggagtgccggagatttgagtcccagtgattggaaagcataagaattgagtcccagtgattggaaagcataagaattgagtcccagtgattggaatgccggagatttgagtcccagtgattggaaagcctgagaattgagtcccagagattggagtgccggagatttgagtcccagtgattggaaagcataagaattgagtcccagtgattggaaagcataagaattgagtcccagtgattggaaagcctgagaattgagtcccagagattg

SEQ ID NO: 34787 - DNA, 1504 bp, Heterodera glycines
  misc_feature (1470)..(1470): n is a, c, g, or t
ataaaattgctgcttcattttattttgtttcttttaggtataaaaaaaggtattaattaaaaataggaaattttttggaaaatggagcctatgagactgaaaggagttaaagcctctgtttttggtctgtgaaatttctggcattcatttgaggtcttggccttgaatttcgtacaaattatgaaattaagtaaaattgcattcaaaacaaaaatccttttcaaggtggtaattcgaaaattatttggacaatataaagcaaaaaatttaaaaaaacatcgaaaattcttttttctttaatttttttttacttaataagaaaaaggtatgacacaataaattcgtttagagagaatttaactcataaaaatgtaagaaaaatttttgagaattattaggctaaagcgaaaacaattcatcaaatgcacatttatggaaaaaaattttctgcccggagaaattcatttacaaaattaaaaacgctttttgctgtaaaaatagtgaattcagtcagtcatcagtgtcattggcagcagtcatcagttgtcacacataaacataaataaccaaaagtgatgatgatgatgatgggtgaaaaatgaatgttcatatgtacatacaaaaaaccaaaattgtatagtttggtcagggatgggatccgtccttgaatggcaaggacgtccttgaaattgggccctctttcttgaaaataaaaaatgtaaattttaaatgtccttgaatttcatgaattttccccactatgtccttgcaaatcggcatacccgtccttggaaaccgacttcggacgataccatccctgagtttggttaatggatttgagagaataaattggatgaacgaaatgagtaaaaatggacgaaacgaacgaaagaatggtggggcacatttggagggggggggggggatggcattggccacttgacaccaaccccaccaaaaattggtggcacaaaaagagaaggcgtgggtggaacaatagcatagaaaaattatatgaatttgtaatgattagagtgtggattttagttattaaatttttttttctgcaacattattttgatgagatatgcacgaaaagcatatttttagtccgaaaatgttttattttaaattcgtcactaggatattatgtacgtcactattttggcgtttcgtcactattttgaattttttgagaatttcttttcaaagaaaaaacattcccgaaggattaaactttcattaatttattttttaatccaaaaaacacctacacctaaattcttcaaacacagaataaaatttcttattaattaattttaaatttttaaaatccaaaatttaaatataaaaatccaaaaatgatttgccttttttaaataactttccgacttttttagccaacaggaaaagttctttttttttttaatgtaaaggtggcattcttggaatttttgggaaaatccccanaattaacatacctatacaaaatatgcaaaatata

SEQ ID NO: 34788 - DNA, 1336 bp, Heterodera glycines
ttgccccaaaagcgatcagaacagtgaacagaaggaaagggcgctgaatggcactgtttttggcggtgaaagttgaattgtccgacgagtttggagaagtcgcattcggagaggaggcgacggaagcgattggcacagaagcggaagaattcgaaacggaagaagcaaatgaaaaaaagacgtgaaacaaagtcgaaaaggcaaggggggaggaaagaatcagatgaaaaagtggaagcattagaggaggacgaacggggggggggagtgaagcaattgcaaaaaagtgccaacatccgatgccctctcatcttgggcactttgtacacgggctcctcctcgacctcttcccggcgacacctacatttcctgttgcgcatctccagcaatttcactaaacaattaaagaatttatgcaagaaagaaaatataatggtaattaggtaatagaattgtacgggagcgggacacttttctgttttcccagccaaaaagtcccggtttttcaacccaaaaagtcccggtcccggttttgcccaaatttccggtcccgactttagaaaaagcacggcggaaaaagtgttttttagaagcaaaaaagaaaggtcgtcgcccggaaggtacccccacccgcaatccgaaattctaggaccgttcctgccccccccccattccgcaaaacatgaaaaaagacatttcagtttttctgaaatttagcgttttgcattaatggagggcgtccttttggatgcatttccattccttctcactttttcatttggcgcttaattgtccggactgtgcttgccggcattcgaatttttcgtgcgatatccgacactgccattccatcaaggagatgcgcttgaacttgggcccttcgggttggagtaattgaacgtggcctgccgactcttccttaacaaacaaatttaagcgatacaagcaaatggtcgccttttgaattccattgaaaaccaaagggaggaccttttggttgccatttgtaatatgccaggtgggtgaaaaaaatagggatacgatttttaaactctaaaaactgccaatataggtaatctttaggctctaaaaaccccaaaaataggcactaaaaaacatcaattaggtgagtaaaatgaaaaattctcttcaaacaaaataaaatatgtcaattctatattgagataaataatttttgaaaaatattgatcatatggcccagagccgaaaatggccaaaaaaaaattgtaaaatttaaaaccaccaaaacacgatttcatgaatttcaggccactgaggactcaggaaaaatagacaaaaaaaaaactaaaatagg

SEQ ID NO: 34789 - DNA, 916 bp, Heterodera glycines
  misc_feature (18)..(18): n is a, c, g, or t
agtaaaaatatttaagcnaaagattcaagaaaaacaaaaaaaaagtttgctgggctgttggaccggaaagataactctaatctcgtttttttttaaaagtttttcacattaattttcaaggatttatgcaataaaatgtgtctctaatttattagttatttttacctgaattattgttgcacattacttttccatggaaaaacataaaaaccataaaaattgaaataatcatttttaatgaaaatttaatgtaaataactaaataaaaattttataaaactgcattttatttatgtgtaagggatgttattttgttgtttatccaactctttccggcttacgtggaaattaaatcagagaaataaataaataaatatggaaaaaacaaaataggaatcaattttattaatttacgtcagttttttttaattaaaacaaaaaatattttgttgtttaatataagcagaagttgcgcttaatttgccaatgtttgtttcaaagttgggttttggtgatcctgattttgtaagtaaaaacgtcgaaagtgagcacatgccaaaaaaaatggcaattatttatcagggaagggtaaaatagatagaaattttaaaaatttctacaaaacccttaacattatatgttaaaaaacatttgtattcagtgtatcgaaatagtaaagtgcattataataaataaattttgagtagtctcgggatagttctcggggccaagatttttgggaaaacatgggaacgggaatgacacaaaatttgggacacaggcccatgattttcaaccgggaccatgattaatcaattttttccaaggaaaatcgaactttattttcattatttttcattttaaaagaaactttgcttcagattgttgcattattccctccgcctatgcttaaaat

SEQ ID NO: 34790 - DNA, 1283 bp, Heterodera glycines
  misc_feature (198)..(198): n is a, c, g, or t
  misc_feature (1227)..(1227): n is a, c, g, or t
gggcctttttattatgattacaacaaatcagcatgccgtctcgctgatatggtatgtttcagttaagtttacccgatctacaaatttcggcactgtctatttgtaaaagcgaatcaaattcctttggattccaaagtggaattacagaattgcgacggcaaatcctaaatagacaacgacgctttcattataaagctntaagggaggaaaagtaatacgaatatttcaatttcttacttatccgaatagacaaagataggttacacacgaacatttttatagaaattccggctgaaactaaaatccctcttttggtcttaacctatgatttttggcccattatggatgaattaagtatagaaggcgtcgcagaaatacattcatattttctaaattcgggtttcagaaaattaagatttaaaaagaggctgaattgcagatgcttttcaaattttgggtgtatccgaatagaaagaagttggaaatcagtacttttcacgcctataaaattcgggccgaaaaatattggtgtttgtgactagaaaaatagcagatgcatatcaaatgactacagaaaataacagcctccaagaaaataattgctttgcacaagcaatattttgtagagcccatcaaacacattgtgcttataggaaaggcagaattatacaataggggcctttttattatgattacaacaaatcagcatggcgtctcgctgatatgtatggtatgtttcagttaaggtttagccgatctacaaatttcggcactgtctattttgtaaaagcgaatcaaattcctttggattccaaagtggaattacagaattgcgacggcaaatcctaaatagacaacgacgctttcattataaagctttaagggaggaaaagtaatacgaatatttcaatttcttacttatccgaatagacaaagataggttacacacgaacatttttatagaaattccggctgaaactaaaatccctcttttggtcttaacctatgatttttggcccattatggatgaattaagtatagaaggcgtcgcagaaatacattcatattttctaaattcgggtttcagaaaattaagatttaaaaagaggctgaattgcagatgcttttcaaattttgggtgtatccgaatagaaagaagttggaaatcagtacttttcacgcctataaaattcgggccgaaaaatattggtgttttgtgactagaanaatagcagatgcatatcaaatgactacagaaaataacagccctccagaaaataatt

SEQ ID NO: 34791 - DNA, 1096 bp, Heterodera glycines
  misc_feature (1086)..(1086): n is a, c, g, or t
ccccccccccccttcagagcacgacaaatatttcaacaaaaatttttaaaaattgactagagcaatcgaacgctaacggacgacctaatggaaaaaaatccccgaaggagagaatttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcatatttaaaaagcaattaaaaatttttagattttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaagacaacaagcgttggcattttttcanggttaagtta

SEQ ID NO: 34792 - DNA, 1088 bp, Heterodera glycines
aagaaaatattaaagtctggtaaaaaaaattttactaaaagttgattttttataaaattgaatttgaaactgatttttggtttaaaaaataatccgctaccaataatgtaccggaaaaattggtaattttctgaattgtaaaatttaagtgaacttttttaatttgacaattttcgttacattttgtggcgtattttcttaatttaatttttgggaaattatgggtggagaggtcaggcagtgccgatgagcgctgccggtttaaaaattaaaatgttcagtgaaacttgttaacagattctgtccaaaaatgaaaaatactttggccaattttgggttttagctgctaaaaaagaagaaaacaattagagaaaagattaataataaattattttacaaaattaaatttggagaattataaagaataattgttctataatgagtaagtcttggaaaatataaaataaaaatgcactaaaattaaaaacaaataaaatagtaataaaaactatcaagtaaggctttaatgtaaagtaaaaataactcttaataaaaaatacaaataaatagatttttagcagaacaataaattcttgtaattttaagaaaaaccgttaaaatatgatatcacaaataatattatttcgatttgtttagcttttatacaaatttacgcaagaaaaattttaataatcatttaaatgattttttattatcttattatgtacaacaggaaaagaaaataaagaataatgtcaagcgtttgcagttcgcataacccaaagtaaaacaaattatgatttaaaaaatatactcactctataaatgattggagaatttaaaaagaaggatttgtgcattgtgtaaataaaaaagtttataataaacaaaaattgctttttattttaatttttttctcaattaacattataaagcaataaaataaaaaatatataaatgaagatttgaaacaataagtgatataaatgcacagatattaaatttcgaaaatacagcattaattaatccttttttataaatgaatgctaaatcctaattttctttatataattctaaatatttttttt

SEQ ID NO: 34793 - DNA, 1418 bp, Heterodera glycines
  misc_feature (1322)..(1322): n is a, c, g, or t
atattaggtaattgtcaagtgtacaaatcttaaacaaatcaacccatttcgctgtttgtcaggttatcactcagctgaaactcgagaatcagactctcagggcgttgttccacggattttccctcccctcgacgaaacaacctcaaatttcgacttccaaaatgcaccagaattgtctcaacaattgtgatccttcctcaaatggagacaatttgaaagctgtcaaaaaagcgacagaaatacattagcaaaatcgaagaatgttttgtttttttgtaaattgattttggctgtaataatttatttgaccattgcattttgacttttgaaagtcacttgatgaaaatgaccgatttgcgctgtaaattctcctcttctctgattaaagctagacttttgaaacatacaagatttattaggttaattaattgccgttaaatgccctgccaattccatgtaattgttatagataattatcattttgctcgattgttcattggttgtctttcgttccgtctcattttcttattggtcgtgttttcggatgtattccagcaattcctccacgtcttccttcgagcccaaaaagatgggcgctctttggtggatggacttcggctgtatgtccaaaatcgggcatttccccgagtgggccttccccccggcgttttccatgacaaatgccatcggattgcattcgtaaaggaggcgaagtttcccatttggcgcatctgtccaatcgtttgcttcaaatgggcttctcattcgtcgcttttcccacctgtggtcgcgggatacatgaaaatgccgccgtacaacaaagtgcggtgaacatcggctacctcaaaaaacgcacatttcgccagaatattacgccaattctgaattaccatcgacccgacatagcgctgtccgtacgccgatttgccctcttcggggaatttgcgcgatcggatgtattcggtgatcccttgaggttattcattccctttccccagtaaattgtccgaccaaatcaccgacctttggaccatttcttggcatatccctcatttatactgtaaattttgcccttcttcggcactcgcatcgccggatttgtgagaataaattcgccaatgctctgaatggagcaaaaaaaaagggattcgtaatttaattaggatttgtaattagtgattgataggggtgggccaattggacgacactgaccgggtccaaagtgaacccatcgacacggcccggggtcgacagcaccaccatagtggccgacccgtacaatggctttggtgcggttgtgaacaatgaatgaaagtgcgttnggatggttttcttaccgtaccccgcagctaccattttccgtccttaagattttttgatcagttgagaaagtgatttggcattctgcccctttgcct

SEQ ID NO: 34794 - DNA, 1061 bp, Heterodera glycines
  misc_feature (40)..(40): n is a, c, g, or t
gggcaattgtgaagatcattggtcccgaaattttttaatntaatttttttatcttaaaattttttaacacttttctaggggtgttttgaggcgctgagcatgaatccggcctccatttcgaccaattccgaatccctaacccgaacaaaaaatccaaaattcaaaaacaccgaaaacactaagaaccgggatcgagccatttccctaccgccacttccctaccgccatgtccctactaaggcatttgggccatttccctaccaaagtatgaatattaataaacagtacgattaaaacaagcaagaaaattaaataacattttatctgtttcaaatcacggtctcatttcataatttcgagaaattccgatcaaaaaggtaatgataaatagatgattaaagcgctgctcaagtggaaaaacattggggtctccattgttaagtggtaaataattttgaaccatcgtgagaattcggcggtctgattcgcgatatttctttgccttttgcggtggttcttgtccagttgaacacttcgcgaagtcatcatcggataacttttgatcctttagaaggtcaatgaaatgccaaatcgatggatgtgaacaggcaaatgcgcattgcaggcgtctgttcgcggcttctgaatggttattcgtccggtcatcgccttgcaatgttcgagtgtaaacactccaaatgtttgggtcaaatcgcgggcgtgttcggatccatcatgcttaagacgacccgtgtagttcatgatgaacctaatatataattaaagaacaataaatagtaaacaatttgtgagattgtcaatttaccagtcaaggacgggagtaagttcgtcgggaagagccatgtccagagcaatgattccagcctgtttcagcccaaattcagaaattttttgtgaaaattttggacgaggtggaacagacatccgtgcacttcagtgaatgggaagactacattaagcagcagtaattgccgctgtctcgaagtccatcgacacgctgaacgggttgaagtctgccacacagcaacgagcatacgaaa

SEQ ID NO: 34795 - DNA, 865 bp, Heterodera glycines
  misc_feature (837)..(837): n is a, c, g, or t
  misc_feature (843)..(843): n is a, c, g, or t
attttatgctaattctggctcttttctaagaactcgtgcgttaaatataaaagcaaggaagtattatgctcgcctttgcagcctctgtacggcactggggccaacactttatgtgtcgttaattttatgctaattctggctcttttctaagaacccgtgcggaaaataaaagcaaggaagtattatgctcgcctttgcagcctctgtacggcactggggccaacactttatgtgtcgttaattttatgctaattctggctcttttctaagaacccgtgcggaaatataaaagcaaggaagtattatgctcgcctttgcagcctctgtacggcactggggccaacactttatgtgtcgttaattttatgctaattctggctcttttctaagaacccgtgcggaaatatacgtgcaaggaagtcttctgctcgccattgaagcctctgtacggcactggggccaacactttatgtgtcgctaattttatgctaattctggctcttttctaagaacccgtgcggaaatatacgtgcaaggaagtcttctgctcgcctttgcagcctctgtacggcactggggccaacactttatgtgtcgttaattttatgctaattctggctcttttctaagaacccgtgcggaaatataaaagcaaggaagtattatgctcgcctttgcagcctctgtacggcactggggccaacactttatgtgtcgttaattttatgctaattctggctcttttctaagaacccgtgcggaaatataaaagcaaggaagtcttctgctcgccattgaagcctctgtacggcactggggccaaccctttatgtgtcngtattntatgctaattctggctcttttc

SEQ ID NO: 34796 - DNA, 223 bp, Heterodera glycines
cttttcgcattgttttggcaatgaatgccaattcagcaccaatgaatcggcatgaacgaggcttttcgagcaaatttcacatcggacaaaattcacgggaattggccaattcaatggatcaggctcatggtggtaatgccaatggaaatgccgaagacgacgaccatttggactatgaatggattttcaacccggtcattccgtcgttggattttatatttga

SEQ ID NO: 34797 - DNA, 756 bp, Heterodera glycines
agctaaaaactgccccgataactctctttgtcgacgagaaaattggtcatgatccaattgaccccccccccccccttctgccggtgcaaaagtaatgcctcaaaatgtttaatcgaccaaaattcaattttatgttgagataaaattctgaaaaaattcctgctaagcttacttttgatctgatcaaaaaagtcttttggaccaacttgatcagatcactccttcatggtgatctgaaaagtcaaaaatggcttgaaattgggaaaatttttgaaaaaaattcctagggggttgggaaaatttttctggaaaatctgagtaggcctatcagaaagaggacaaaattctctaccgaattgcctttggcatgactggttttttttgaggcaatacttttgcacctgactatagttagcaatgaaattccatttaaaataattttatcaaagcagaaaccaatgtgaaatcattcatattattttatcattaaaaagcccaatacatattataaatgtttacagactctcaaattgtacaacacaaaataccaaaaaaatgctaaaatatttaactggtgtaaatgaatcaaatagaataatttactgcggtgattttaacgccccaaatattgattggaacacaaataaattattggcaaaaaatgatccaattgcaaatgccttcattgactttatagaccaaaatcaattattacagcaagtaaaggagccaactcgagaaaatttcattttggat

SEQ ID NO: 34798 - DNA, 928 bp, Heterodera glycines
aaaagtttattgttttgaatttttcacaacttatttaaaaaagccaaaaaatccggatccaattttaaaaacgaaaatagtgcacaaaaagaagccgcctcacggcggggcttaaaagcattgtacatcataattaaaagcgaaaataattttcgtatattttttcacaatttatttcaaaagacaacaaaaaattgataaaatgttgaaacgaaatagtgcacaaaaagggagggatggttagacgaaaagaggaatttttagaaaagaacgcaccccatctgatattcccatttttctgtttcacaactggccaacggcgactgtgctcattgacacgtagttgtccaattaaggtacttggactttccacagtaaaatgtggtgcaaattttggaactgtcccgcctcacggcggggcttaaaagcatttgtagcgcaataaaagttttttgttttgaatttttcacaatttatttaaaaaagccaaaaaatccggatccaattttaaaaacgaaaatagtgcacaaaaaggagccgcctcacggcggggcttaaaagcattgtacatcataattaaaagcgaaaataattttcgtatattttttcacaatttatttcaaaagacaacaaaaaattgataaaatgttgaaacgaaatagtgcacaaaaagggagggatgcttagacgaaaagaggaatttttagaaaagaacgcaccccatctgatattcccatttttctgtttcacaactggccaacggcgactgtgctcattgaccacgtagttgtccaattaaggtacttggactttccacagtaaaatgtggtgcaaattttggaactgtcccgcctcacggcggggcttaaaagcatttgtagcgcaataaaagagtttattgttgtgaatttttcactatatatataaa

SEQ ID NO: 34799 - DNA, 1467 bp, Heterodera glycines
  misc_feature (1319)..(1319): n is a, c, g, or t
tatttgaaagctgtgaaaaagaggcgaaaatatatctcctcaccatgaaaaaatgagaatttgtgtaatgctcaaaaggcatgatagtaacaggaattatgggtgaaaatggatgaaaaaatgtgaaatctgtatcattgtataatgagataattaaacgatattatgtttaccaattgtgataataaggtaatgaaattaagtgaaaatgctgtcaaaacaggtgaaaaagtcaacatgtcaatgtgaaaaaacataagaactcaaaaaaaaactcaaaacaggttaaaaaaagggcagaacaggtgaaaaatattgtcatagcaggtgaaaaaaagggtcagaacaggtgaaaaatattgtcatagcaggtgaaaaaaagggctgaacaggtgaaaaaatgtcatagcaagtgaaaaaaagggcagaacagttgaaaaatattgtcatagcaggtgaaaaaagggcagaacaagtgaaaatagtgataagaagcctaaataaaatcatatcagatgaaaaaaaggcctgaacaggtgaaaaaaatcagaagaggtaaaaaatattcatatggggtgaaaaagaccagaacaggtgaaaatagtcatagcaggtgaaaatgtcagaacaggtgaaaattattgtaataacaggtgaaaaaagctcagaaacaggtgaaaaacaggtgaaaatggtgataagtgtataggatgtaattcttacgagagtgacgggtattgttgtgtaatgatatgtcagttttttttcaatcacatttcaaaagcggcgttttcgcccgtgccagccaaaaaaaatagtgacagccaaaaaaatccgccattacgaaattcttttcaaacctatcaatcaaaaattttggtcgctcccaaactttcaaattgtttctctctcagtgcggtgacattcaccttctcacctgtcaatcaaatttgagtcttttgggctccatgcgtctggttttcccttttaatttgtcagccatgcaccaaaaaaaagaaaatacgtcccctctctgcgtgcgtgtcctcagctgcaatcacattttcgtcaccaaccaaaactcaaatttttgttctctcgcgttgacatttcccttctctgttatcaatcaaattcgtctttgccagccttcatcttcccttttatgtaccaccccttcttccaacattcaaaaatcgatccgcgcctcgtcccctaattgccccgcccttcacatctgtgccagaaattggcgtcctttcattcactcttcttctctctctcaaaaatcaacttttcaacaaattttcttttacttncacttattcgcctttttattgcttcaattttgtccttttgtcatttttgttttctctctatcctttttttttgtcgtgacctttcgtctccctttgaatttatttcatttcttctcaaaaatgtctcgtttctgccctctcgttgaaa

SEQ ID NO: 34800 - DNA, 1099 bp, Heterodera glycines
gcatgtattatgacggaaatcctcagaaattgatgagtcgcttcatgtccaagcatcctaaatatatctttcataaaaatatcatagcaaaagaatcaaaaccgacttcctttgccatttgattgataattttattgcaatatatacaaattaattttctccttttcgtactaattcgaattttaaaattttgttgccgtaataacagactaccacgacgcgtcaccaatttattttagaatctgatgataaaatcaatgcgatacaaatgattgggttttaattctaagccgttcgattaaatgcctacttcgaatatttgactgttataggcaaaggatttctaagaaaagaatattgtacggttcccaaagagcatgtatttatgacggaaaatcctcagaaaattaatgagtcgcttcaatgtccaaacatcctaaatatatcttttcataaaaatattcattagcaaagaattcaaaaccgacttccttttgccatttgattgataattttattgcaatatttacaaattaattttctccttttcgtactaattcgaattttaaaattttgttgccgtaataaccgactaccacgacgcgtcaccaatttattttagaatctgatgataaaatcaatgcgatacaaatgattgggttttaattctaagccgttcgattaaatgcctacttcgaatatttgactgttataggcaaaggatttctaagaaaagaatattgtacggttcccaacgagcatgtatttatgacggaaaatcctcagaaaattaatgagtcgcttcaatgtccaaacatcctaaatatatcttttcataaaaatattcattagcaaagaattcaaaaccgacttccttttgccatttgattgataattttattgcaatatttacaaattaattttctccttttcgtactaattcgaattttaaaattttgttgccgtaataaccgactaccacgacgcgtcaccactttattttagaatctgatgataaaatcaatgcgatacgaatgattgggttgtaactctaagccgttcgattaatgcctactgcgatatttgatgttataggcaa

SEQ ID NO: 34801 - DNA, 1308 bp, Heterodera glycines
  misc_feature (14)..(14): n is a, c, g, or t
cgaaaattttcaanggaatgaaaggtgatcaattaaaaaaagaaataaataatttttaacttttctcctacccaataaaatatgtattatcaaaagacaataacaaaaacaaataaatttccaagtcgtgaatcgaaaaccgagactctcacacatcctagtaattatttcccttattttattcaaaagaatggataagacaacaaataataattaatattccagaataaaaaatttccaccttacttagtaaagaaatcgcaatttatcacaaattttttaactaattaatgaacccaacaagacaataaattctttttacttcagaaaagggaacacagatataactaaattattaaaaaagaaaagaaatattaacttaaaaataaatgataatttatttcttaatagccattctttaaatattccaaattttgacacttctaaaattagtttaatttgtcatataaataattttgaattattaaaaaatctatgaacgaataatttaacaaacttctacattaaaaaatgacagaataaaacagtaaatttgataaacatccaaaaacaattacttattatttgtctttatttttttaaatataaatatatatattaccgatttaaaaatttatttttaataatacactgataaaaaaagagaaaattcgtgaataaatattcaaaatacataaatatacaatgaattattattttaattattttttattcaaacttttttatcaaattaattaattttttacaattaaaatctaaaaaaataaataaaaaatatttctaaaaggataaaacaataataaataaattattttctgtgatccaattacataataaggttcaaaattaaccctaaaaacagcgcgggaacaccgcaccttcaccgcctgctcacaatcagtctttttcttctgcaacaatcggagtcgatttgctgccagccgaagatttgttttcagttggaagtagagtgccacgggaccgggaattttgggcttaaccgggaccgggaccttttcgggttgaaaaaccgggaatttttggctgggaaaaccgggaaaaaaccgggactagtcccggtcccggtaaaaaccgggaccttgatactcagttgtactcagttgtccgttaccaggtcccggtcccgtggcactctagtttggagtattgagtgccccacgagtaatatattttcgaaaaataatcgcgacataattaaaatttatattaatcctattcgtggtgaaccgaaatttatattttggcaataaaagcgggtctcaatcg

SEQ ID NO: 34802 - DNA, 1234 bp, Heterodera glycines
ttcgctatgcctttttccgcttccttttgctcattaaatgccaatgccatcatttcgctgtttgtttttgcgcttttttgtcttcacatttcgttctcatcccccgcaaaaaacagcaaacgtcaacgcatcatcaggtgttttttgggttttgttttgtccccccccctcttttctaaattttcaaattattcgctttttttttgtcagaattccaattgtccgtcccaaaatgccatcatttaaacattttacaaatcgcagcgtcgtaatggacgcgcaaagtttcctgaagcgaaagtttggcggtctgacaaaacaccggcggaatttgaatgggccaataagtggcaattcgatgggccaatggtcgcccccttccgatcaaaatgagccaaattcgctgcaactgatcgattatggcaatgtccgttcccattcatatcttttcattgtgtggcctcatcctgttcattttcagacccaatatttcggcaccattctgatcggtttccccccgcagcaattccaagtgctcttcgacacaggctcctccaacctggtgaggatggcattgccctgttggcattatgctgctaacggtcactcccttttcagtgggtcccctgcaaagggtgcaatgactcggcatgctcaacacatcgccaattcagctgccacaattcagtcggctgtcaaatggccggccaaaactttgacattgtctacggcaccggctcggcttcgggtgttctgctgcaggacatcgtttgtgtaagaataaaagttagcgattattttggcaccgtaaaagaataattttatgtgagtttggcaatttgagtgtcaatttgtgcacaaatacaactcaaaagtttggctgttcaatgagtgaacctggagacgttttttcggtaaaactaaaagttatttcatgtccaaaccaccctttgagcaaagaatgccgccttcgatggcattttggggatggcgtggaattcaatttcgactgacgcggcggtgcaaccgttggcccaaatatttgaaaatgaagattgcgatgagaaagtgttcgccttttggttggttgcgaaggaatcgaatcgccaaaagcctgaataccaatgaccccatcaaaggctgaacaaagatgactttggggacgacccgcgaggggcgaaaggcggacaaatgacatgtgtgcacagacaaaagccgatataaggtacgaaca

SEQ ID NO: 34803 - DNA, 713 bp, Heterodera glycines
atccatcggcggccaattccgaaccccgggcccgaattcatcaaaaagtcgaaagtccaaattttcgaatttagcaattttggttcaaaaacagcataaaagatctcttttaatttccatgcacttaaaccgattttgaaccaaaacactattgtactttcgaaaatttggactttcgactttttgttcgaattcgggtccggggttcggaataaattttttgggaaattttcttaaaaatccatcccccaaattttttttcttgacaaattttttgttttaaaaatgttcggtatttggtaagaaaatattagaaaggaaatgtgcctcatttacaactgcaatcattgaataaaaattatttttgctcaatttttggctgaaaattatgtcactattttggcattttttcctcactattttagttaactatttcgagatttttcgtcactaaaagtcacgaccctaacgatgacttttataatgcctatttcggggtttttgttcttaatacctaaatgcctatttttgtgactatttcgccatttttagcgactattttcaaggttttcggaaaaatccttaacaaaaatgcaataaaaacgaaaaatacatccctaagaatcaacccaaaaaaaattcagaaaatacacccctaagaattgaaaatttccccaaaaattgattccctaaaatataacttttagtttaaa

SEQ ID NO: 34804 - DNA, 849 bp, Heterodera glycines
  misc_feature (720)..(720): n is a, c, g, or t
  misc_feature (824)..(824): n is a, c, g, or t
ctcccattcgtccggctgagcgtgcgacggcgaaaaccaaagcgaatttggctgaccgtcggttggccgtttgttcaccggatacattaaagtgccttttaaggaagtgacaaaagagaaaataggaagacgaacagattaagccggaggcggacatggagtggtggtggacgagctcaccaagggatttgaatttggcactttcagtgataaacagctgaacgaggtgggaggggaaatgccattggcagggtaaacgaagtgatgggaaatgatcaaacccgaaaattggcatcgaaactgatacggtaatggtagacacgacctaataaaggaaggtactgtaggggaaggcgaaagaaacggtcgaatttttatttgtttttaattttaatgcctttgccttctctttatgcactttcatttgaaccttcgtgtcgcagagagatggaaaattggccggggttcgtctccgattccctcaccaaaaatgagccgttaatgcccgagccgagtaactgctcggcctccgcccgggtgactttgccgtggtaccagctgagattggaaaagtcaacccgtggcgtggccatccatgaccaaaaacctgtgtttgtccaaagaatttgccggggcaatgtaaaggcttggcacccatccgatctgtccgtattggctggaggaggaggccaacgaggaggaggaggagccgagcgtggncgagcaagtggccaagttggactggacacttggactggccaacttggcagaggcacaacgacggaccaactgcacttcgcaccactcccctgcttttgttgtangacaaaacgcggacctaaagcgatg

SEQ ID NO: 34805 - DNA, 877 bp, Heterodera glycines
attgaattatcagccaaatgaccatataaagtcccgaccctagacttttaatatggaaaatgctacaaagcttatgtttatgaatgataagcaaagtccccctgctaacattgatgaaatcaatgggtaacaggttggattcgctaactgttcaatgcaaaaatagcattcgatgagctcacactcatcaactgctggacataaaatgtcctttttgaacatgtgtttcgaatccatccaaaaatgaccttggcattggtagtcatttatgaggatttcctttggtagctcataagtgagcttctttacattctcatgaatgtaacagttctctgcacagcagagctcaactttattaatttcctttggaatctttgctttaacgcctttgttaaagcaaagaagtttgcactcattgcattgattggttggataagcatttgtttctgttccccccttaacgggaagagggaacaaacatgctaaaattacagtaaacgccattatttgcaaaatatggcgcgctgtacaaaattgagggattgcccctctttgccttccttcttgaaagcaaggcgtgctctgatcctcaaaacaaagtaataatactttgagttggatcattagccaagcaatggttttacgcccaatagaaaggcttttaaaattgagtgaaccatcacgcttatgctgatgtaaaaacaaagcgtcaatgctatgattgattgctctgttcgatgaggaagaatttcttcccatttattatcaattctattaatacaaatggaaaaaactgaatggctcacaacaccattcatttttatgcaacatccacaaattttcttatctgcgggagttagtttcggtatcttctgct

SEQ ID NO: 34806 - DNA, 348 bp, Heterodera glycines
cgattttatttgctgcattaaaaaatttaaaagttggatagaaatttaaaattctttcctttttattaataaaaaagtatttgtaaaattttataaagtttttttcatgtaaaagtagtgttggcatttaaaaattgtacgttttaaggcttaagtcagcttaaattttgttaactttaaaaaaaaatttttttaagcaaatttaattttcaatggcatcgccctcccccccggaaaaaaagagaaaactttcctccgccgaccaatgcttaatttcttctcctacaattggtgaaaatcagcagcaatcgtcgggtttattagtgacagcttttggaaaacagaaga

SEQ ID NO: 34807 - DNA, 896 bp, Heterodera glycines
ttcccttgtggggtcttttggtgtgtctcctctgcttttggtcagaaattaaattccattttttagcgtttcgtccgcttttccaatagtagctaatcaatcaaacattgtcccctccgctcatcaatcaatcaaaaaaccaatttagccaaaaagtatttcaattgacgcgtttatcctccggcgataatccctccctccgtcgtattattctctgatcatcgatttatttgtgttttgggagtaaaaacagtgcatcattcggccgggggggggggaaatttggcggtgattcggagggaatttcctccgtttgcccctcctcagccagcccaccgcttcagcggcgacagtgagggcaaatggggcggggacaacaaacgatcgaaggggggggggaggcaaagggagggatggggtgagagggcaaccgacgcccccctccccccaccacccggcgggggttgtaccgctaagagatgaaagagcctcctcgttcaccttttttgctcctcgcttcggcacaattggacttttcttgcggcttaatctgaagttgcatcgtcttgagataggaattttgctttttgatggctattattgctaacatgaggagaattttttgaccgcatttttaatgctcaaccgcttcatctcctttctgatgccgatgaattatgatgaggtggaagactttccatgttcgataattaatgtccataaaaccgaatagtcagcaaatagtacaaaagccaatcaattacaaatttcaaaagaagggtgtcaacaacattaatccaataacaacacacactgcatcccggcttttggactaatccccccgtccccctccgtttttcccaaaattttccagtccctaacctaccccagtatta

SEQ ID NO: 34808 - DNA, 668 bp, Heterodera glycines
  misc_feature (574)..(574): n is a, c, g, or t
cagtatgcaatgaggattttgtattcatataattttcagtgtttttcctttatttacctattcatacctatcagggatgacacagatttccgacttccgaaaaattttagatgtaggaatttcgattttttgaccaatttcaaaacccggacccgaattcgaacaaaaagtcgaaaattcaaaattttcaaaattcacttttatgttcgtacctgtataaggaaatttttggaaatttcttttgaagttttgccaattaaaatgttttattttaaattgtaaatttatttttctatttactttctacttaatttttacttccaaataaaatttgaaatcataaaatttggtcattttgaacaaaatcttaaatttatcgctttttctttttgctaatcctaatattgtaattacttaaggtgcaaatgaccatttccatttttccgcgtatttgtccctcttttcctccttttctccggcattttccttcttcgtccgctaattcgctcgcttttcgtcgccacttttctctgaccggcccccgtcacagctttttcttcgattatttcactanagttcgattttgaagttataaaaaaggaaaagtcgctaaacgagtgaatccaaaggatttagcaccccaagggacatgcccctctccgcgacta

SEQ ID NO: 34809 - DNA, 895 bp, Heterodera glycines
tctgtcgacaatcccgtggaggtgcccgacgttgaaccaacggcgtttaaagtgatgctcagtttcatttacgcggacgatttgagcgaattggacggagacaacgcaatggcagtgctttacgcgggtcaaatattttaatttatatggaaattttaggactatttttagtaaaaataccgtttccgtcccttttattttgataataattgtttttaagctagaaagtacggcatcgatgcattgatcagtcattgtgtgcaaattccaattcaaaatctgcccaatgttttcttggccattgcccatgctcgtcttttcagcacgggggtgggaacaatgattattttctgtctggatatgggcttggttattctattaaattttttttaatactttgatatgtatactccccccccctttttttgcaaaaattattttacaaaaatgaaaatatactcctttcggttttgtgaggaaaattagtcgaccgcaagaggaagggcagaaaaattccaaaatttttcacttgcatcgcctataacaatcatacatttgtcttaacagagttggcttgaaatcgcaaaacatcgacattaacacaacaatgttatgctatttaggactttgctcaccaatgtttgcgttacatatgtcaaaatgcggaaacattgttggaatctgaggaattcttgcaaatcgatcagaattcactgagtgaaatttttaacgcagcgatcagttggtgatcaggcagtgaattagaaatttggaaacctgtaatttgcatttttattttattttattgtaagtgatttggtagctttctaagtaagacataccgttggggggatgaaaagttccgtcaaaatgccatcgaatgttcctctgagaa

SEQ ID NO: 34810 - DNA, 1007 bp, Heterodera glycines
taatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaaataaatcaagacttcaaattaataaacaaaaattctcttaaaattttttttgaacccattcaaaaaaaggaaaaaatttgcagtcaaaaa

SEQ ID NO: 34811 - DNA, 836 bp, Heterodera glycines
attacattcagacgaagaaccaaagttagccatcactttgctttctatgagctgaaaaggtttaatcagagagaacaatggctaacaaaaagccgaaaaaagagtgaaagggcggaaacgaattttatctgattcccaacgccccattaattaattaattaccattgaatgttttcattatcattgtgaaaagactcaaacgcaaagaatgcaccgccaaaagggtaaatttacccgggaaaatccccaacaaatgagaaaatgatggatggctggggaataaacaatcgaatgacaattaatgaaaaaccaccaccttttgatttgggattgcaattttattaatttattttaaagaccaattattgggctaaaattcattcttttacccctccacttaagcgctgccggcaaatttgttaattgattagcaaaaatggcatttatggagatgttaataacaaaaatggcatttatggagatgttaagggagtgtccaagaagttgattagattttaatgatttatattagctgactccaaaatcagcagcacattcccccccttaaaaactcacattccccggggacagtgaaaccattcttttgggctgagcaactcgtgtagttttgctgattgtgagatcaaataaagcactccttaaatgcattttttgatttccctttaatggaacaaaaattataaataataatattatattatatagtccaaaatgacaaatgaaaatatcgaaagaaagtgaaaaatgaacggaaagaaaacaaatcaatgtttatgaatgataatgggggagggaattggagggggggggggggg

SEQ ID NO: 34812 - DNA, 824 bp, Heterodera glycines
cctcctcgtccctctttttcttcctcctctctccattctcctcctccctgtttttcttcctcttcatcctccttcatgtttttcttcctcctcctccctccctttccatttatccatccatccctttgctcatccccaccatctgtcattgctccatgtttcccctcaccttccccccccccctctcccgtcattttgcgtgtcgctttctacgccggtggccaagacaaggagaagcttattgggggaagggaatgaatgggaggagcctgggcttgacttggccctgcctccatcaaatttgcgttcgtccaatttggccaaccttcgcatacagcggatgaaaaacatccacccgaattgggccaaatcgattaagccataattatctctccaaatcgaagaatttttaagcaatcgtcgatcgattctattattggtgttgtggacaatttgtctttatacagaagaacaaaattcgtctagtaaatcccaaataaaattgagggtaaacttttattccaatgccctcagaaagcgttagggaattggccaatcccaaaacgactgctcttccgttcccgaggacaacgcaccatcccgagaacgactgactcagtcccgatctcgtctccgtctcccatttttggcactgccgactcagtccgtcttcttctgatggactgtcggcgggttctctctgtgttttgtcccttcctttccatctcttcgtcatttgcattgctcaattccgatgctgctgctgctggcattggcacttccaatctctcctctgctcaaccgatcccttcgcttccctcccc

SEQ ID NO: 34813 - DNA, 929 bp, Heterodera glycines
caaaaaataaataaattagtgaacctttaaaaattcatacgaaatttaaattcataggtactactgctaaatcaacgcagagacgcctttccttgacctttttaggctcctgcaaaacctggtgcacttctgatcactactcgaaaaatgagtaaattaattttcactaaaaagttaagcctaaactttttggcctgtttaaagaggaattaaaaattttttaaaatttattcatctccctttttgatagaaaaagcatcagagtgcctaaaatagcttgtaaataaaatttggtgcgtttcagagcactttctgaaaaaataattatgaattaattttgcaaaaaataataaataattaaataaaaacgaaagactctgattttcgaaaaaatttttaaacccagctagctcggcgctcatttcagtgtaagttagtcctttaccggggagtttccctgcaaagtttggtgcgcttctgatcagtttctgaaaaaaaaagttaagcctaaactttttggcctgtttaaaaaggaattaaaaatttttaaaaatttattcatctccctttttgatagaaaaagcatcagagtgcctaaaatagcttgtaaataaaatttggtgcgtttcagagcactttctgaaaaaataattatgaattaattttgcaaaaataataaataattaaaataaaaacgaaagacttttgattttttgaaaaaatttttaaaccccagctagctccgcgctccatttcagtgtaaagttaagtccttttacccggggagtttccctcgcaaagtttggggggcctttctgatcatttttctgaaaaaaaaaagttaaacccaaaactttttgggcctgtttaaaaagggaatttaaaaatttttaaaaatattttttcttcccctttttttaaaaaaaaaa

SEQ ID NO: 34814 - DNA, 903 bp, Heterodera glycines
  misc_feature (807)..(807): n is a, c, g, or t
acaaatgcttataaattttcttagaattttttgcctggacgtcacagttcttcacacttaccacaccagcattatttttttttaattatttttttcattttatcacccaacgttctagactgatcagaagctcaccaaattttgcagggaaactgctgagaacccttcaaatgcttataaattttcttagaattttttgcctggaggaacacagttcttcacacttaccacaccagcattatttttttttaattatttttttcattttatcacccaacgttctagactgatcagaagctcaccaaattttgcagggaaactgctgagaaccctacaaatgcttataaattttcttagaattttttgcctggaggaacacagttcttcacacttaccacaccagcattattttttttaaattatttttttcattttatcacccaacgttctagactgatcagaagctcaccaaattttgcagggaaactgctgagaaccctacaaatgcttataaatttttcttagaattttttgcctggaggaacacagttcttcacacttaccacaccagcattattttttttaaattattttttgcatttgatcacccaacgttctagactgatcagaagctcaccaaattttgcagggaaactgctgagaacccttcaaatgcttataaattttcttagaattttttgcctggaggaacacagttcttcacacttaccacaccagcattatttttttttaattattttttgcatttgatcacccaacgttctagactgatcagaagctcaccanattttgcagggaaactgctgagaacccttcaaatgcttataaattttcttagaattttttgcctggaggaacacagttcttcacacttaccacaca

SEQ ID NO: 34815 - DNA, 1107 bp, Heterodera glycines
tgaattttttttcagtgggaggtggctgagaatgccgggcacccggtagcatctgtgtattactactatacgatgaaaaatatacggtaatgttttttcgacctgacgatccgctgacatccatttttttcaggtttcgtgcctccatcacagtgatagtgatagttcctgatgcgggtcggtatcgaattgaaaaacacaggtcgccaagacgcgattcctacaaaaaaaagggaaaattaaaaaaaaaaatttagtcgcccaaaaaaacattaaattcaggaaaaattacgagcctcccaccccccccccccccccgtttttggcatagtaaaaaaatttatcgaaaaaatctgaaaataaagtgacaatttttttcctggaaaatcagtaaaaataaataagatgcaaaatttaaaaaattttaatgcaaaaaaaaaaaactcaaaatttacaacaaaaaatattcatactttcccagtaaatttgtttttggttgggaaaaaaggctcaaacaatatatttttttaaatttctcaccaaaaaaatttttgccttttcaaaaccgaaaaaggaaaaatattttataacctcaatctggctaaatatgtatatattttgtaatttttgtctggacaaaaaaagatcaatagcatgagatgccataaagtgagtaaatagcttcaaatatttgatgtaggttttatagaaattatttttctttccttatagaaagaaaatagagtcattaatggaaatatactatttgggtcgtgtcattccgtctcaagaaagatcgattcgaatttctaaatatattagtagggtggcgtcatagcgtcacaaaaaatatcgattcgagatatcgggaaaatgatcaaaatggcaataaaagcttggtgtaaataaatttaagaaaattatgcaataataaaatttgagatttttcatcacttttttctttttatttatttacttttatctttttcgaaattaaaataattaaatagattctatttaccatttaaaattgtaagcgacaaacaaaatttaattcaaattgtacattttttaattaatagattgttttgttcttttttattgaaa

SEQ ID NO: 34816 - DNA, 881 bp, Heterodera glycines
  misc_feature (36)..(36): n is a, c, g, or t
ctaatttaccccagaaaaatatttttcacacccttntttcgatcccaaaaaaatttttgaaaatttctagggggcctagctcgaaaatttttgaaaatttccctacatatagtataccattagatagagcttaaaaagctctacaattttgctctaaggcattttttgtctaaaaccgacgcctgacgagttatgggcccgggactcaaatgtcccgctcaggccaaaatttttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccgttttttaggcctaactcgaaaaattttgaaaattttcgaaattttaaaatttcaaaaaatcgagctttgaaagctctacaataagttcgctgaccaccccccgctcagatcaaaccctggcgcggtattcacctggtactgaagtgtactttttgagcacgcttcagttgccattttttgcaggccaggggtttgctcaaaaaaaattttaaaaaataccaccttgtagaggacccttaggcggagtgccctttcagcgggcactttttgattcgagttttacaaaaaaagttaggggccttcaaatgcaaacaaaagtgacaaatcagtccccggtactcagttggcgctcggatcaaaaaacctatagttttcccgaattctcctcaaaaagttgtaagacccttccaccactttcagggcgctcccggccttcggccgggagattttgttttttgaaacgaaactccttgtcaatataacatatatagtaataaatagccgacg

SEQ ID NO: 34817 - DNA, 902 bp, Heterodera glycines
ctggttcacatcattggtcccattaaaaaaaaaggcaaaacattttgttttttcgattctaagaactactcgggggatatccaggacgctgatcgcatatcagacatcagtattgtcatataattcatataatctatactttttgtatcgcagattaaacgaccgaaataagttttatttgctctatctgctattgacaggactttcatttcaaaaattctcatcaaacaatatcagacctaaaaaccaatttcaactctgcaaaattaggataaaatacaaaacgttgtcccaactagggctccaatttatagttttttctctattttttcctgagctccccgtggcctgaaatgcacgaaaaacatgttttttttcggctgttattaaactacttttcgtgttattagcaactattttctagttttttatttttagcaactaaaaaacaataaaatttttgaaaaaaactattttcaactattttggcgttttgcccagaatttgttaacaaaaatgcaataaaaacgaaaaatacacccctaagagtcgacttaaattttttcaaaaaatacacccctaagaatcgacccttaaaattttcaaaaacacacctctgagaaatgaaaaatttatcaaaaattcatctccaaaatttatttatttatttattacaagaatttgtgattttaaaaattattattctcaatactgatttggcctaattttttcctttttttgaacacatttggcattttaccccccccaaattcggaactttttttgcaactattacccatttttaccaactattttggaggttttttaaaaattaaaaacaattattttggcagtttttagcaactataaaacgaacccccaatccccaccgttttaaaacc

SEQ ID NO: 34818 - DNA, 1390 bp, Heterodera glycines
tgctgcgttaccgagtacaccataatgtactgtttgcatatggtaacaaagcaaatattaaatacgcactcaagtacccttttaaagggccaggacattgttatgtcgagtgcaaacaagagtccggcaataaaatcggaattgatgagccggctcaatatgccaagatgaacttccgtggtgcaacggaagcatatgccattgttcattcactgccatttgccaaactttcacatcaggttgtcaaacttagcatccatatgcctaatcaacaaccgattgtgtacagggcttttcagctggtgagcaaagctcaacaaatccagcaaggcgaactgccagagacgcaatgttctgcctattggaaacaatggcaaaatgaatggaagcatgatccgaagctcaaggacatgctttttgaaaaagtccctgagcattttatatgggcaaaggacaaatggaacaaaaggaaatataacctaacaaagagaccaccaatcggtcgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtaacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagattatgtctatcctaacttccaacaactccttggcaatgacaaagagctgctcaatcgtttgattctcgctccgcacattgacacgtgtgatgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggacttaaggggccttcttatcaatagaagtgataaggaaggactga

SEQ ID NO: 34819 - DNA, 873 bp, Heterodera glycines
  misc_feature (796)..(796): n is a, c, g, or t
  misc_feature (804)..(804): n is a, c, g, or t
  misc_feature (836)..(836): n is a, c, g, or t
  misc_feature (840)..(840): n is a, c, g, or t
  misc_feature (844)..(844): n is a, c, g, or t
ttttcgggaataactcgctgggtgttgcgctcagcgtgttggcgccgctgaactttttgtacagcttgccgagctctatcttgtcaattttttaaatttctgaaattttcagaaattttcgagctaggccccctcatcacttttgaggtttttgaattttagtattttttgcagatttttctcggcaaaaacaagaccactttcaagcaaccgtttttcacgctctatcgattggtggcattttcagaaaaatttttcaaaatttttttggaaatagaaaattttccggaaatgagggcttatttcagtttggggtctataagttgtcaggagttgattttagcaaaaaatcttctttgacaatttttgtagggaattttaagccctatataatgtgctttatatcatctcattatcacgagtttaaaaaaagttataaaattaattgtgatttttaaattcaaaaccataggggggaccccatggttttgcatttcatgaaaaatttttttgctcctaaattagccaaaatgcatttttatggcctaatttaaggtgctgaacttgattatatactttattttgggtttcagacagttttggtaggtgtttaaaattttttgaaaaatcggcaaaatttgagccccggaaaatcccagtgaaattttgaaaattcataactctcttcgtttttggtcaaatttagtggaataaagtttgaaaaataacaaaaaattaggagaattttatgagatttatttggaatttttatcttccaaaataaaaaagttatttnagaatttntggaaaaatttgattttttagaaaaaaatttntaanttgnttttgaaaaagtattttataaaaataata

SEQ ID NO: 34820 - DNA, 250 bp, Heterodera glycines
tcccatttactcatttgctgctctctctctgcttgccctttccattgccccccacccatatctcttcatccgccctttcccatccccggaggggtcggtgcctgtccgcgccggcctccgcattgccccacgggcggtggcggcggaggccttcccccgctgcaccaccacctcattctttgcatcccccaactacacacacacacacacacacactgaatgagggaggggagggagtgggcgtcggcgg

SEQ ID NO: 34821 - DNA, 845 bp, Heterodera glycines
  misc_feature (754)..(754): n is a, c, g, or t
taaaaattgttttttaaaagttttttatcggtaataaagataaataaattttattcaaaaaattaaatccaaaatatgaaaaataaatttgatcaaattcttataagtttgctatctatttttaaaattgtataatatttaaaaataaataaaggtgattaagcctttgacaaataatttaaaatcaaatttatttaaaccaattttattctgaaatatacatattttattttttattttaaaaatatttacgaatgatttaataacatttattttaaaatacacaagaaaaaattgtttcatttaattcaaaatttttaatatttcattaaaatatattaatcttattgagattttattgtaaaattaaaaattattttcaaattaattttttattgaatttaccaaatttattttaaatcaaatttcaaaaaattcgtattgaaagttccagtcgacgcttccgtcgcgaggacgcgccgtcgccgtcgctgaatttggtgacagccgccgccaacggcatggcactccaacagcagctgtcaacaaatgcaacgacgacgccaaggcgttcatctgcgtcgttgacaaacggcacaagcgccgccggcctggtgggcaccacaaattgttgcggtggagctgttggcggaagcggtcgactaataatgaatggtcagttttggatggatttgtgccattggcatgaatcaaacaaatgccaaattttttattggcatttataaatttttanaattttgacaaaatctacgggtgtagattgtgaatgatgctcgagagttcaatcccttggatacacgagtatacaatttgtcagctttttt

SEQ ID NO: 34822 - DNA, 707 bp, Heterodera glycines
ttgtaccatacaaatgttttcagcatgggcagaggggcgcggagagcaatgtccattatattctacagggatttttatatttattctctatgccagaaaaatggctatctcttttttacgagaaattttgtaccatacaaatgttcccagcatgggcagaggggcgcggagagcaatggccattctattctacagggaatttttaaatttattctctatgccagaaaaatggctatctcttttttgcgagaaatttttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctctcttttttgcgagaaattttgtaccatacaaatgttcccagcatgggcagaggggcgcggagagcaatgtccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttat

SEQ ID NO: 34823 - DNA, 1391 bp, Heterodera glycines
ttcccaaaaaattttttttgaaaaaagcgggccctcaaaaaaaggtttttattgattttttaaatttggaaataaaatttaaaaaaagattttttgttttataattttaattattaaaaaatttgtagaaaaaattttgccattttgcaatttttttaccttttcgcatttcgctttttttcaatctcgcatttttcaattttcgcaaatttcgctttttatttttcaaatttggcccatccctgctaaaaagtaattccgtttttgcacaaaacttcccccctcccattcactattgatataaaataatgattttgaggtctgctcgcaaaacaatccaaagcctggaactgttggatgaaataagctagggaaaatgcatggcaaaaacaacacaatgtatgcagcagttgaccagttttatttagttttttatcaatttttacattttcaggaaccacagtatgagctggagtgtttgaatagctcgaacaatgtcaaggatcggggtcggggaccgggggagctcggggacggggagcaaccctaatattaataatcaataaaataaaacttcaaattaagaaattttgaatttggaagtttttgtggtccaactttcctctttttttgatcctaatttggtgtcaacttgcccttggggatcagattacggttgtacatcgattctcccttggggcccaaatggcaaaagcaattaaaatgctctttcacttcatccgaatatactttcatcatctcttttttgcaataatcacggttatttacgtcagtttcgttaaagcaaacgaatgcgtagaacactttcgcatctttttcagccttttcttaatatgggcatttgtgcagtttcgttttgaggaaaaaagaggggaaaaatgctaattgatttaaatgtgaaacggtcagcgattttttgtgagtaaaatccgagatgggcattttatttgggttttataggttaaattgcaaggttttcatttatattcattaaattttcagcttaacggcacattgaacccacaaaaatttgaacgaatattttttattttgacagtgtcagaatttgatggttgccacactctctggccgtaaaccgcttttttttcgcggcacgctttttccaaaaaacttccgtgccatccctacaagtgacaaaccagcaaaaaattcatttttttattgaaaatttcaaaaggagtcacttaaaaatagtgtgttttttactaaaattaatgatggatttttatatgaggtcattgaaacggaaaagtgccccagaatttgcacaattgtttattaaaagaccatttttttcatttacttttgtaataaaataaaataataataattttacttgtatcacataa

SEQ ID NO: 34824 - DNA, 946 bp, Heterodera glycines
  misc_feature (61)..(61): n is a, c, g, or t
  misc_feature (83)..(83): n is a, c, g, or t
aaaaaaatccaaacatttaaaatctataaaaaattaaaaatgagaattcatgcgagatttnctggaataagcttaatagggcntagtaagctgtaaaaaaaattggggcgatttgaaagagaatagaaagaaccaggttcgatgaagttttgtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctattaaaaaaataaaatagtgaagttttaaaaattaataaaaatttttaaattaagagttactggcgttagcatcatagcggtgcttttccttgtctttttgatgcccttgcaaaatctggtgcgcttctgatcagtttatataaaaaaagttaagcctaaactttttggcatgtttaaaaagagccaggttcgatgaagttttggtaagccaaaaaaaatccaaacatttaaaaatctataaaaaatttaaaaatgagaattcatg

SEQ ID NO: 34825 - DNA, 1356 bp, Heterodera glycines
  misc_feature (12)..(12): n is a, c, g, or t
aggctaattttncggcaaaatcgaaaaagcactgttagagatgaaaaattttataaattgaaaaaacaaatcaattatatacatacacccgaaaagagatgcattccatgtacagtgaagacaaatatcagaaaatcgttggcataaataaaagaaaatatcgtaaaagtaaatatcgcattagcgataaatatattttatatttacaataataggctagaaaagatgtgaaaatagattattagaaaaaattcttttcaaagggcatgcttttttaaagaactgcaaattttgagcatttaataattgagataaacaggttggagcttcttccatgttagatgtctattttttgtacctatttaaggttttttatttttggaaattttcagaaaattctgtacaaaaaatacctttacaataaaacgagaacatctcctatgaatcgactaaaaaaacaaacgaaatataaatttaaaaagaaattaaattttgcttttggtattctttgcttcacttctttgtcatttctaaatatataatatttgatacaacagtacaaaaatcacaggcccacccaaaaaatggcttaacttaggggggggggggttagaacccgtcggtgttcgatcgattactgcctcctggcaaaaagcatgtcccgctcaaagtgttcgccagtcaattggcccggcaaccgttcacagttggggttgaacacggaataggcggacagttcgccctcacgtcggacgcccaggttgagcagcagcaaaagcagcgcggacagcacaaagtagacgaacccgaactgcacatgggcagcgagcagttgacctgcaaaaaacagagcgtggaaaatgggcgaaaagggaaaaaaggttttgtccaaaaaaatgccaaatttcgcttttttgagttaattatttaaaaatttataagcttggaagccggtccggcggtgccgagaggcgccccccccccggatttgcgatggaaaaagagtttaactttaactgagtttattaaaatttattcaaaaatatttggcttctgtcctttattttcgcctatgccaaaaatcgggttcaaaattaagttttctatcttaaaggtcgtaaaccgtattaaatttaagaaaacttgttcatttaagtttattaggaacaataattatgttgtttgaaagataattatttttcaaaaatttgctgacgatcaaataatcgcatacaatcactttcaatcgcttatttaaagctgtttaatttatcaagaattgaaaaaacttaagtatgcacccgattttggacataggcgcaaataattgggcgcaaatgtccgaggcgcaaatgt

SEQ ID NO: 34826 - DNA, 664 bp, Heterodera glycines
aaagagttaaaaatattatttaaataatattattctctttttataccaaactttttaaaatttggtttcatttacccaaggttcgggaacgaaacataaggtaattaataataattattatttcttcctttagaaattgcttttggcctccgaaagtggcgacttccgttggagtgaaagtgattgtgccgacgaaagtgtccaaaacaaattggtcattgcgctgctcaaaaagccgaattcgttgaaccattttcattttgtcgcattaaattcgctgttgaaaagcctcaaagaacttcggcactttttttgtcatggcaatgacaaaattgacatctttttgctgaaggagcgcttcttgttcagatttggggataaactgctggacgagttggagctgagccatcccttaattatgcacttcggtaggcaatccccgccaaattgacacaaaacataggacaattaaatgacaagacgcccttccattgttactatcattgatttaactggctgataatgtgataagaaatgatcaaataaattatcacggcgattaatccgaaagaattaattttctctaattgtacagatttgcccatttttttccaccgtttgctgctccaactgctgcactataaaacgggcacagaacaagcgg

SEQ ID NO: 34827 - DNA, 991 bp, Heterodera glycines
  misc_feature (931)..(931): n is a, c, g, or t
ctctctctcttcctctctctttctctctctctctcttcctctctctttctctctctctctcttcctctctctctctctctctctccctctctctctctttccctatatctcttcccctttcccctgttcagcttcttctccacgcccgcttcttcttcctcctctccctcttcctccatttgcccctctcttacgccctttgttcgctgttcggtgcccttggctttgtattcgctaatttggcggtgtattcactgcgcgtgcttttcaattggtactttcttcgtccaactttgtgcgcgcaatttgacgaaaataatgataacgacggtcaaaaaatgccacggcaatcgcaaaaagaaatgcaaatgtaccgacagttgctgcccggtaaaaaattgtgagtttttggaatttgccttatttattcgaaattaaaattcggattggacggcaacattctataatataccaattttacttttttgttaattccctggtaaactgacaaaatgattcattggatgattatcgttgtccttttggttggcatgcgtttatttttctgtcgtttgtttggtgtcctcctccaatttgttcctccgattgcttttcatttcctctgaaatcccttttcagttcgtcgctgcttctcttcactttgctcgtcctttccatttcgcgttttgtcctcggccaaactttaaccattccttgccaatttggtcatttaatcctcggcgccttattattctgtctaaacgcattcgctttcttcgtttgggaatacaaaccgtcgatgttggattttggagagaaaaaatccaaatgataatttatattttggataattaagctttcattttatactctgctttcattgttaattcctgttttttgtacattgataaagttttcataaacatgttanaaggtgtgaaaccaagtgcatttagcgttttgtacactttggtcagtgccaagggcgtac

SEQ ID NO: 34828 - DNA, 1626 bp, Heterodera glycines
tttcaaatttgttttgattttttcgcatttgttttttcaatttataggcccaatctccaattcttaaaatgggccggtgaataagagtttacgataatctggtccaatttcaagcctatatttttgggtatttctatggatggttggcatcttcagctaattcttggcacatcccggatccctttctttttagacatttttccattccttttttaatattttttatattcttttcttcattttttattttatcaaattgtgagtgtatttttcttactccatttaatagtttttcatgccaaaatatgatttctggttttcccgagttcctatcctttatattttgagcttcaaccattgtattgtgtgctgagaatgaaaaatctttggcctcattagtcaacctaattatatccttaattacttcttcaacagcccttcgggagatatccatttgctgtttttcttcttttgtgagacaacaacaaccctccccccttaccaccaaaaagaataaaattaacacagttaaaaaatacatttttattttaattatcatcaaagatttttatttatagtttatcaaatcatctttttcttccttcttttcttaaatgttcatcttctgaataaaaatataatttttttcatggagtatttgcctaccgcaatggtaatgaaaaggttgtcattttcatcgaaattctttcttccaaaaggttgacatcccggtatgattgttgtcggcgcataaactcattgaaaacaacatccgccgtaatctgtcccggtgggcgtccaggtattatcactggatctgacaaggtgccgcaatacaaatccacggtcattttctcaattttccaccccaggctcatccgctttctttgcctcatttatgagttttgctaatatttttttgaaatttttttcagagttttcatttggcgggtttttgaagtaaaatgttgaaacattttgtttgatgcccatttttttgttttcttttacatgagtttcaacttcttcataatacttgcccaaatctgggctcttccggaaataattccgagtatttttagaacgacgcagttcttttgggacttgttggaaatttttcgccatcttgaaaaaataaataacaaactattattgtgaacaaatattctaaatatgaataaacattaaaatcattaacaagaattaaaaatcaatttaataatatccaaaaggcaacacattatagtcatcatcaattatccccttcttctgcactggcgaatattctttcttcacgtcccgcgagagcattctgctatcccttgtcggcccaatcttctcaggatagcgaaacacttttttaactccttccgtgtagctcaagaccattgacttgaactcctcataatccactctattgtccttattcagtgtaaacccccggattttcgtcttgtaccagatcaccccatcctttttcctcttaagcttcaaggcgtattgttttggacccgccgacacatactccagaatgtaactgtctgaatattcccgagtcatctccctgaacaaatgttcatagaaaatttttttaaaaaatatgatgttaccccaaaaatttccctt

SEQ ID NO: 34829 - DNA, 1064 bp, Heterodera glycines
ttttagacgcaaattttccaatatttttggcagatgcttggctcgagtgggcccaatgtgtgtgaaaaaagcgtgatctgatcaaagcacacgcgtgcttcaaagtaataaatatgtccagtttttcttagtgccattgaagatgggatggaaatggtcccaaggcctatttttgaaaatattttatttttgtacgaaaatccttcaacaaccacttaaattgaccccaaaaatgaacacgaaattggtcattttaagcctacccatataattttgaaaactagtccggaaaaaatagcaagggcccgactccagaggtgggaaaaaatctccgtaacccggtctttgtgaaaatgtccataatctggactatgacccccatatatccggactaatagaacccaaaaacctccggaacgaaaaaatccggaatttggactatgacccaaaaaactcttaatccgaaaccggaattcggtcataattaaaaccgagacaccaaagtttccatcactaccggaattcttatgaaacatcttaattttcctaaaaatgtcatttttctatttattttttttttaatatcaaaaaaccaacaaaaaagctttaaaaattaacggagaaaaaaatgttttcttcttcttccttagcctgagtataatgtgttggaccgaaattttcttgaaaaactctcgtcgagtttttcctggttccgggcctggacaacccctgcaaaataccgaaaaattttcgttgaaactaatgcatcaaaatttttggctgaaactgattaagagtttgtcttcccgtcgtattgttccgctgaaaaaatttttttttctaattaaatctgaaaatccatccctattttttcccaaaattttgtgggtaaaaaccaaaaaaaaatgttttaggaggctgttgagcgtgagccatgccttcccgcaccgaaagcgttatgtttgctgtccgccgcgttgcgcgccctgtccgatcgttgcgcggacaatggccaacgcgtgcaaatgctcaatgaggcggtgcgactttgccacgaggcgttg

SEQ ID NO: 34830 - DNA, 1095 bp, Heterodera glycines
  misc_feature (17)..(17): n is a, c, g, or t
gaggcggagaaactctnttgttaaaatggaaaaagcatcatgccaatgccaactttagggtttaacaatggcacgcaaaaggcaaaagaaaagcgaggaggcaattagcaaaaagaatgaactaattgacctaaaaaagatgaaaaacagaaattgattcatctcaaaacaaaaaaacattttatcagattgaagtgagttctctttttcaattttttttttttgcattttttgggtgccattttgggtatacgtgccctttgtcacattgcatgaataaatgatttttatccgttaaccattatatataaatgccagtttcaaaaatgccattttcacaagtccgatgggtcgtccgattggatttcgccgcccgcccctccggcagaatcggccgatgattcgtttgacttcgtcaattgcctttgttgattctcatcggccatcatcggctgctgctttttcaccagttcgactttgtgcctgttgcataaacccttgtggcaaatttcgcacttcggcgtgcccttctccgccgcgcaaaacgggtccaagtcgctgtgcgtgcaattgcctccgtccggcgcgcacgaattgaccacgaagatttggtcgccactccctgctgggcaatgaaattaattttaaatattttcaaattatgtatttaaaattaaatttcaaattgaaagtgccaccatcgatgcatgaatacgtctgacagccggcaaacgacccgcgacagtcgtgctcattcatccggtcgcccttcttcatgttgaacgtgttccacttggtcattttcgcgacaaggccacccgaagggatgttgcgatggcgcatgccgtaaaagcaattatcggctgaagaagagggaaataatgccaaaacgacgaagcgaatgttggcacccagagaatatttaaaaataatacaggaggtaattaattcatttgatttacttggactaaaataaaatttaatttatttttgttttaaaatgtaaaccaaaaaaaatggggaaactagaggctaaaaaaccggaaattcctttccacccaagcaattaattaatgcgctaattaagttcaaaca

SEQ ID NO: 34831 - DNA, 1197 bp, Heterodera glycines
ggggagtcggagaaaattttgctaaggtggtcggccgcccggatgaccttttttttgcgatttaaagccattttacgagcgagggtggggagaagtccgacccccttcccccccccccctaaaaaatgtatggtaattagttcagaaattcattaaaagttccggtattttctccggtgttgccaatttgcatcgccgcctaataaatattcataatttttttacaattgacactggtttgatcattatttaaggaaaacccacaaacaaattggacttagttttatcaaaacccaaaattcccggtctcgtacaactttatttttagacatgcaaaaattgccgtcagctgttaccgctctactcagaaacgggttcatctccacatcaatgaaacagtcgacggtggacagtttgatttggtcgatgaccaaagcgaagcgacagaggctacaagtgaccaaataattgaaattgcataaccaagtgtatggcatttgctcaattaaattttacaatcgcaggtcaaaaatggattcctttcccatttctacgacatttcccaagtgatcaccggctctttgaccatgggactgctcggcggaagcgacaaagagttccaagaactctgtgcctattttaaggttccacaattcaatctctgcgtttaatgaataatggacaattaatttcaggagcaagtttgtgcctttgttgtcgatattttcaacccggacaaagtccggtttacaacggtcgaacatttaacggaagacgtgaagaaactgttaatgtatcgaattggcttaataaaggtgggcgtttcattagttttgtctgtctacgatttacacaaccatacataaaaaaggggggggggaggtcggccaaaatgtttgcgaggggggtcgaccgcctatatattttgacgaccttttttttttgtttgctttccaaaaccactttcttgcggcacgcttttccaaaaaattttcggaactgggaggggcggagccggtaggcgccaccgggaaaaatttttgaacacaatggattttgaaatttagctatttttacagcttttgctccgcccctggccgccagcaaaatgtttctttgtaatttggcgttggaatttaaaattaatatgttgctttcgttatgataatttggcgttaatttaaatttggcattgct

SEQ ID NO: 34832 - DNA, 853 bp, Heterodera glycines
  misc_feature (838)..(838): n is a, c, g, or t
catattacgtgattagtttgaataatttttctaaaaaaatacttacatttttctttactatttaaaatatgaattatctttgaaatgtttttttaattattattttttagttaatattcatgatgaatgaattaatattttctttttttgctgatttattctcatgacaaattctctccacacgcatagaattgttttgactctctgatatgtgttaattttatttatctttaatataattgaatttaagaaaaaaaaaacaattaatcttttaaataatttcttctgctttttgttaagggttattttactcattggagaaaatataaaaaagtgaaatataaatttgatatattttgtttattcgagtatttatataggaatatattttaaattcgcattaaattaaaatattggtatttatagtagaaatgccaatttattttttcaagattatttaaacctaataatatgtttttcaacttaaattttatgattaattaattcaagagatataaaaataattgtatttaaattaaaataaaattgtattaaatattgtgtttaaattactgtattattttttattttgattatataatcgtatatttaattttcccttgaatattttcaatgttattagctcttctacttcatagatatcttggcagcattagactaatattattaaataaatcaaagtttttaagttttatttattaatcattttgtaaatattaaatttgaatattgattctttgtaaaaatatttaaaataataaattaaaaccgttaaataatattacgaaaaatttttatatattaattgtttaatcanaaaatctttaaattt

SEQ ID NO: 34833 - DNA, 880 bp, Heterodera glycines
ggggacctctagagcttggcccctttttctttgattctttggcattctttccctttcaaataatttttgggcgcatttaatccgtttgaatgattcattcccttttcgtccaaatttgttcccatcggtcactcattcattcatttattctgtcacggtttgtccatgcctttgccaatgccatcggattaaagcatttgaatggctttggctttggcattggctttcttcctttggcacttcgtttccgttttgcctattctgccatctcacttcttttttctcatttccgtccctttcatctgtcacttcgttttgcatttctgctcattttctcattatttttcataatttctttcttttcaggggagaaaacagttacaaattgaaggagaaagtcgcgctgcaatttttgtggctttctgccaacaattgcacccattcctttctgatcggttggccccccacgcgcaattacattgcccattttaggtgacccctccggcgtttcttccttttttaattgaatttttattgttttttagctccgagcgcgagaaaagcgattggttcgacaaactgagcacacttctcaagcagagtttgagctcgaaaagcacaacagtgggcgtatttgtgcagatcgaagggcgccatcaggtgaaatggggaaacgaaacgccaaaggaattgaattggaattagaaacactcgttaattattcccatcagcaccaatcgtaatgaccattcatcacccacccactcccctcgaccattcgaatcgaactccttttggcagtcccaattatacacaatggggggaagctctaaaagagggagacaaatttttggcaaaaaaatacaattttgacaatttt

SEQ ID NO: 34834 - DNA, 808 bp, Heterodera glycines
aaaaaattgaaaattttgaaaatcatgtttcccgctcccttctcccaggggtattattttgtaaagtctttttttccccaataaacttttcaaaccccatttttcgcaccggtgaaatgttttttttatcgaattctgaaccgttttgagtagattagactagaaaaaattgaaaattttgaaatcatttttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactaaaaaaat

SEQ ID NO: 34835 - DNA, 1052 bp, Heterodera glycines
ttttaggtacttgtgggttatttgtgctcagattttcaaaaaaaaattttttgagaataaacttgttttagggtttccggggtcggaaaaaccgattctggcatctatattggcccaattcgaaccccaaacccggattcgaacaaaaaagtcaaaatccatttttcaaaaaaaaatcacattttatacacaaaattgagtcatggcctttttttggttatacacggcgagtcaattttgggctccaagtgcaaataagtttattacatttcaataattttaaatataaaatattttaatacattttgatcgaataaacgtaaaaacgattagaagaaatttaggtaatactaccgatggtccccccccctttttggaaaaatgttttttctgttctagaaagtcgtgaaaacacgtttatggggtttttagggtcgttggtcacgaatctaacattcattttgatcaaattctaatcctggagccgaattcgaacaaaaagtcgaaacctcgatattttcaatacaggtttttatagctatacctgtgcacaatgtaccattttttgatggttcactggtgtttgtctatatctcatgtatcaaaacctgaactgaccgatgatgtaattagtgcgtggagtactgggagaacatggagctggcaactcgaatgatcagtcgcaggatgggattgtggacgacaaacaacgcatcttggggtgggtgtgccctgttgaggtcgactaacttctcatctgctacttgtaggatgtgaagggaaattgagtgaccgtttatgagaattcatgaacgcagtcatacgaccacggcttaatagtttttacaacgcgcgctacatgcactcactcgacggacgtgagctttacaaactgccgttgcggatcgagccggtggccggcgtctttgcggaaaaggcatagaggataatattcctgtgcttcgagatgttcctcgtcccgattcatcctttttccatggcgatttctcaaaatgaccgtcccgcgagtcagcctctccaactgactgaga

SEQ ID NO: 34836 - DNA, 1406 bp, Heterodera glycines
taattaaatcagaacttcaattttttaaatccacccaaaatgccgattgaaacttttttaattcaaattttcattttgaaaaatactgaaaattttgtctgattaacaatagtttgccaagataaaatccgtgtatatcctgaggctgacactgtgtattcctgaaatctgacctctaatttttatatcccattgtataaatgccaaaaaagtcatggcaaatacaaggaacaaaatggcaccactgatcagtgcgcctctccgcccctggtgatcgtctccatttttgtgaatccgctccaatttggcgcaaacgaggactatgagcgctatccgcgcactttggaagcggacttggccaaattggagggcgtcgtggattgtgcatttgtgccaaatgccgtggaaatgttcggggaggaaaagcaaccgctgaatcacaaggatgaggaggatggcatcggcatcaaagtcagtttttggaacatatgtagcaacatccgatcatctctctattcttatcagatccaacatttaagggatgggaggagatcaagattcttttcactcagttaacctaataataattaatgagttttattaacccaataataataatgatttttaaaataaattttgcggaaagtggaataaaattgagaaaaaatccattttaaaatatgaccgatctgttaggcccacaaaaaaagataatggcatggtttaggaccaaatgaaatattaaaattaatataattatatttttatatatctattttattttcatccttttaagtcacggacacttttttaaattttaaaattttaagtccggacgcattggccgtattttggagggtgtcacacgaccgcagtaccatgacggaatgttgctgcatacggtcaaactttacaacattgtgcaaccaaatttggcatttttcgggaaaaaggatgctcaacaggtggattttcacgacgggcatttttcggcattatttttaatttttaaattaaattaaatcattttaatacagaaggtcctaattttttcgaatgctttttacatcaccgttttgaagctgttcgccatccaacaaatgaccgtggtcatgaatttcccggtccgtgttgtgccggtggaaactgaacgagacccgcacggtttggcactgtccagccgaaatcagtacttaagtgccgaagaacggcgacgggcattgtgtctgtacaatatgttggtagcggcacgcaatgccgcaacgaatggtgccggtttggcctcagttgcggcacaagcgcaacaaatgttaacccaagcggaaaagcatgacggcataaagcaagttttcatctgagcttatttaagaatgtcatgaccttgattcagggacggattattttgc

SEQ ID NO: 34837 - DNA, 1146 bp, Heterodera glycines
  misc_feature (9)..(9): n is a, c, g, or t
  misc_feature (49)..(49): n is a, c, g, or t
  misc_feature (71)..(71): n is a, c, g, or t
  misc_feature (1133)..(1133): n is a, c, g, or t
taaaaaacnagagttttcaaattaaaatttgcgtattttttgttttcgnatgagaattagaaaaaaattgnctacatatttggactaccattcacatttacacaattctttgtgaatatttgttaattccatcgttaatagacaattaatttgacaattaactttatcaccatcgccagcattatcatttatcattgtcattatcacttatcacctctaatcagtgctttagtgctgactttcttcttcttcctctatgcttcttccgtcacttcctcctgctgttgttgctgctgttttggggcctgcggttggagccacgcgtacggatcttcgggctgacaatgaaaagaaattaaacagagggagagattggattagaataaaatattttagaattaacaaaacttttggaaatgtttcagccattttatcaccgataaaatgctttgttaaagatttgccattttattaatcatatttattattattattatattttggcatttctccgcacctttggggccctattcactttgtgtgccgtgaccatttggtaatgtgcgccgtcgtcctttggccccgatgggatggagtcgaggtcacgggcaaccgcactaattaattaattaataattcattttttaaattaaaacaaatgtttcaaattttacatgttcaatgctcctggcacaaattcgggtgtgtaagtgtaagtgaacgttttgcgagcacgcaacggctggtagccatggtaaattccgtccttcaattcttggtagcggctgtcaccttcgcctttgtccaccatttcaagaaatattcccttaacattaaaataaaatgaatgcattgatggcataatattcaatgaaaattcaaatcgtcgaaaaatgactcctcactttttggctaaacgcaaatcggcaaattttcttcttcggattggattttaagcgcccatcttggcacctttccttctctgttttataacatgtgtttgtttgactgtgtgaaatgcttcaaagtgaaaaaatggcgccatttgcccccttcggtttcattcgtttcagcgccataaggcatttgggggagaatggaaatggatgaacgaacaacacatgttgaggggnggggggggggaat

SEQ ID NO: 34838 - DNA, 781 bp, Heterodera glycines
cctttatgcccgcctccttctccagcaaatgtttttggcaatgtgcagcaatgggacgagcacaacgtaaacccaaacgaaagggccgacggtggacaagtaaaggacagccaaattagtctgaaaaggaagcagggaaatgtcggcgggaatcagtctcgagcagagaatggccaaggggtgccattctggcgaaaagtggcccacctgactgcgcgggtagggcattcggcgcatggaaacgtccatttcgggcaatttcttgtggcccaaaagctataattggaattggcacaaaaaattgtgatattttccccactttttccgcaaaaatttggtggagagcgaattgcacggagagaattccgctgggccaatacggcggattgtccggcacgtcgctgctgttgtccgtctgtcccgcgaatgggtcgcgatccgaatcgtagacgccgacgccgtcgcgccaaaaggcgtccaaatgccactcaatcggctcgtagaccaaactgaactcgggacgtggcaacagcaaacggtaggagaggcgccggggggacagcgaaatgccagtgaagaggagaccgcctgaggggatgccaaagtcagagggaaattaaaaatgagaaagtgaacataaatgatgcaaccacccgactcggttggtactgtataatgcccaacgccgttacagcataaggactcgaccaatggcaccctttcgcttacggtcggtcccgcttcaccccccccccccccccaatcacccaaatatttctga

SEQ ID NO: 34839 - DNA, 1076 bp, Heterodera glycines
gtcccatagggccctccacaaaacacggatgattttccgtggatcagctgacttttcaaatgcaacaacccggtatttaccggggtaaatctcatcctgaaaaacggtcatttctgtgttaataatttttaaactcacccaataattctgaacattcggcaagtgttccactccatagctatattcgttaatatcaattccacaattacgtaatagttcaacagccgcctctcgttgtctcataatattattcataaaacgattaaaaatattccgatgcacttccaaataaagctttgacgccaccaacgcataaaacaaacaaattttatccacattcgaaatccttaataaataattataatttttctttttttttctattctcgttttttctttttttttctcaaaaactcaccttatccgttggtgttccttgaatccgaagtcaaatttgtgtacatttctcggcccttctccactgggcacggtgacgcaagtaattttcatcataataggctccgacaacaaaagcgttttcttattttcatctccgtccccgctctgccctaacttattaatctcctgcataataacatccgcattgttctgcgggtacgccctgtacggtaaccaaaccggggaagcaagcccggcacccgttattgccacaccaaacatccgcactttccgcttcatcctttcttccgtagtcttaaaagccgccttaatcattgtgtcgattgcgtccctcatcgcttcgtcagggcgtctcacatccgaattgatccgaaattccgtaatgttcttcgtgaatccaaatttttcgcaaatcgtcgaccgttcgtcaattaatttataattttccatttcctcagtaaaattgttcctgaaaaattattgattacacttttctcttaaatatattattaaaaattgcttaccctatagctcgaaaatcccattttttggtcgacggaccgcctttttgcaaagtcccgttgcgttttgaagtcattttaattaaatttaatattaaggaataagagcgcacaatttttattttagcaaaatcca

SEQ ID NO: 34840 - DNA, 945 bp, Heterodera glycines
ctctcttctcaaccggacaacagacagtcggcagccatttgagcacttcgacgcgcattcgcacgcgacgaaagtcttttgagaagccgccaccggtgggaccattggacaatgtgtcggcaatttcactggacgaattttggcagaaagacgaggcataaatggaaaagaaaaagccaatgggaagaaaagggaaacgttagggaaaagcatccctccccgataggaggaaaagccgcgccgactgcgcctattccctccccgtttaggctaatgcttaaatagatagagaaaagcataaattaggcatttttaaattggaattgtccctctgccatttttaattttaaaaggaagtcactaagtaagcaattaattgagaggcacagcaaatattttaaattagcaataataataaaaaataaaaaccctttgtttaagtccaacatttgcacaaattgccattcaaatggcatttttttgagatcggaatttcagtttctttgcatttgccaagtgttggtcattcattcattcgtttccctgtgaattttccgtccgtttttcgttctttcattcccccattcatttggttttttcgtgggagattaatttgcaacttttccttcatattcttcgcttttcgattgtttattttgaatatttgaaaaagcgatgactcatccaatgcttttccatgcgcaaatttatttttagcaaatgcccaaccaaaaatcataaaaaacctgccgatcagttttagcttctgatcgggaagcatcgcaaatggaagacgacagaagagaagagcggcgggtaaccactatctttttcactcaatcgctgatcagtagttggttttgcgataacgccccccgggaaaagcgatgaaagggaaaaaagaggggaaggaagggggggggggggggccatcaatcccaattt

SEQ ID NO: 34841 - DNA, 559 bp, Heterodera glycines
  misc_feature (487)..(487): n is a, c, g, or t
agtcgccttgttgtcatctgattatttatttgtttttttaccgtttgttgtgtactcattgggccccatttccaacaaaaaaataaatgtttggcatttctcttttttaaattggttttatttaactccatcgtttttgtcaatttcctaaactaagaaaaaaagggtttttctttattagtttttaggaatttttagtgtttctactcatctataataatgactgatgcgaaatattttacgacaacaaaaaagggtgggctaaatttgccggattttatgggaatttgatgaattttatttccctatcaggtgaaatattcgaattgaaaaatgaactgaactcagacaaaaaggagaagaagcgggaggcggtgaagaaagtgatcgcgagtatgacagttgggaaagacgtgaggtgagaggacggagggattccaatgggggggttgagtcatatgggaaccatacattttttagggggggnggggggcggggtgcggacccgcccccccccccccctcaccctacgctcgcaaagagggccagcgagggggga

SEQ ID NO: 34842 - DNA, 922 bp, Heterodera glycines
  misc_feature (836)..(836): n is a, c, g, or t
  misc_feature (892)..(892): n is a, c, g, or t
atttatgtaaggcaaaacgcagaaaataattgcacgcctcgccaagaatagagaaagacttctttaatgacatttattggacgtttcagcaaagttacgcgtgtgagttatgatggtcatatttaaacgaattttttttccaaaaaaaatctgttaaaaacatgtaaaacgtatgcacatttaaaagggctccagaaatgcgtcagtgatacagtaacttccgcaataaattgcagttctgtagcgcattataaaaaatattgtataagaacggcgttatgaattgggcagttcagtttttataaaggctcaaaagtttgaaaaaatttgaaaaattaccaaaatccgagtaaaaataaaacatactgtaatttgattaatgtatgcttgtgtccatatcaatcacagactagaggacaaaacatcgtaggacggagatttttcgaccacaattttttcattttcaaccaaattaaacattcttggtatgattagaaagtgcttgacaaattcattaacttcattattttccaaatttaattattttttcgatcatatacaaaaaactagggctaaaaatataaaaaaagaagttttttgagtccttttagccacaatttttggaatcttaatgtttttttttgatattttgaaaatatttgtaaaaacatagaatttgaataccaagaatggctaataacaaacatattgcccaaaaaacatacgtcgatttcggccggcgagttttggcgcactgtatcaatacacgctttcaaatcatcatactcgaccgtattggaaaaaatgaaacaagatatatgtagtaagaaatatgnaggatttaattttaagcgtaaatgccccaaacttacagtaactcaattacagtatngtatgttttatgggtttttttttttaattt

SEQ ID NO: 34843 - DNA, 1068 bp, Heterodera glycines
aaatttttatgttctaaaattaccggtttttaccggtaccggtaccggttgaaaaagttggtaccggtaccggtaccggtttttgcagtaccggtcagtaccggtaccggtttttttgcaattaccgattaccgctcaactctagttcaaaccattggcgaactgcctcagcaacagtggccggcactgtgcgcgtgtcacgcaccagcgcatacaatgggaacggaaactgggccatgtaggagcggaaggtgcacgattgaccgtccgcagaaaagtcagcgatgcgcatgcccatgatcagggttgccagatctgaggatttatcctcattttgtggctttttgataggtcaatgaggattttttttggaaaatgaggatttaaggatttttgtggctttttgagaaattttgaggatttttgaggcttttggggaaaatcctcagaatcttttaaattttgataaattggcataatgtttggcaattatttaatttgaattttggtttttaatagagtatcaaacggaaatctcacccaaatttagccagataattacaatttttttcgaaaatccacaaaattatgaattttttaaaatgaaaatctgctaaaaatatggtcaaaattctcaattttccccctccggcggccgatttgctatttttgacatttcgcattaattgtgttttgtttctctcagttggatgaccaaatgccggaaaatgccccgctcgacttggagtacagttttgaacaggcccgtcgcattcttcaaggcgttccggaggaggaattattgcaaaaaatgtgcaaaaagaggaagaagcactctcccaaatgaagccgaaaaaaaacccgctgacgacggcgaacgctttgaaaaaacaaccaccgggaacaccaaaagggacgccgcgaaagccaacagaaacagccgaagattggggccacggaaacccaattcaagaagggcgacccggccattggggacactccgatgggattggggccggaaagggttggaaatttaaaggaaattccaaatggttttaaattgcgttc

SEQ ID NO: 34844 - DNA, 1120 bp, Heterodera glycines
gaaaagaggggggaaggagaggagagagaaaaagaggagagggagaaagatagagaggtgagagagagaaagaaagaaaagaggaggggagagaagaggagagagatagaaaagaggagggagagatagaaagagaggagagaagggagagaaaagaggagggagtgaagaggagagagatagaaagaggagagagagagaaaagaggatctagaggaagaggagagagatagaaaagaggaggaagagagagagagagaaaaagaggagagggagaaagaaagagaggtgagagagagagaagataatagtttttttcaaagctcggctagcgcgaggtgcgcgagcgaagcgagcgcgcctgcgctagtaatagagtagagagaaaaaatctcaacatctctcatttatcgtgctatttttttaaatctctgttaatagagaaaatcggctcccggtaaattggacaccagaaaattggacaccgaaaattggacaccaatggaaaaatggacaccagaaaattggacactgttgtaaataaaaatgaaaataaacaaaataaattactaaacaaaaattttggcttggcctaaaagatctttatcttaatctgccatatgttgtttataagcgtaaataatatggaaatgaatttgttattatttttgtaacttcaggagaagaaaaacatcatatcattcataaagaaataagttttattactcatttctggtgcattttttggcccattgatcaatcgtcacccatttttggtgcattttttggcccattgatcaatcgtcacccatttctggtgcattttttggcccattgatcaatcatccctcatttctggtgcattttttggcccattgatcaatcgtcacgttagagggaaaggaatgaaacgcaaacagctttatattgagcaagatgaaaatcttcgggaaatatttgcaacgcgtgccgatcgtcatcccctccaatatttgaggggaattgcctatcgaatgcctgatccactctaagtgccttaatgcattaacccatttattctactcaaatttattttcacctaattcttgattttttttaaaaaggaaatcttagtgtccaa

SEQ ID NO: 34845 - DNA, 752 bp, Heterodera glycines
agcggaacatttcagttcgactgcgcatcagcggagaaacgagtgcggtcgaggtggttcagttggtcgtcgtcagttggccatggttcgtccgcgtgtcccccccccccccgcccccacctcttctaatcactgttgcacctcttctaatcactgttgcacctcttctaatcactgttgcacctcttctaatcactgttgcacctcttctaatcactgttgcacctcttctaatcactgttgcacctcttctaatcactgttgcacctcttctaatcactgttgcacctcttctaatcactgttgcacctcttctaatcactgttgcacctcttctaatcactgttgcacctcttctaatcactgttgcacctcttctaatcactgttgcacctcttctaatcactgttgcacctcttcgcatcacttttgtacctcaaaatttaaataacgggcgctaagcgcccgtccaaggccgcgaagcggcctaacaagctaaaaaacgggcgcgaagcgcccgtatgagttcaacgaatttaaaaaatgggcgcgaagcgcccgttcaaggtcaacaaaaattgaagaacgggcgcgaagcgcccgtccaaggccaacaaaaattgaaaaaccggcgaagcgcccgactgatgccgcgaagcggcctaacaagctaaaaaacaggcgcgaagcgcccgtatgagttcaacggatttaaaaaatgggcgcgaagcgcccgttcaaggtcaccaaaa

SEQ ID NO: 34846 - DNA, 915 bp, Heterodera glycines
actttaattctgcgtgggatttttgctccccataaatgtttgagtaccccaaacggacactgaaaaaaatcgatttttttgtttcataaatatttttttcagaaagtgctctaaagcgcaccaaatttttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcacaaaatgctctgaaacgcaccaaattttatttacatgctagtttaggcactctgatgctttttctatcaaaa

SEQ ID NO: 34847 - DNA, 1079 bp, Heterodera glycines
  misc_feature (50)..(50): n is a, c, g, or t
ccgaaaaatcctgtgaccgtctctgaatcctgcataaataaatccctaanaaccccaacatactccggcgtgttgcccttgctggactggatgagttcgatgagtgggtttttgtccgtcgatttattcaacaggtcgcccccgtggttgaacagcgttttcatgcacaacggattgaccgcccgcagcgcgaccattgacggcgtttcgcccgcattgttccgcgaattgatcaacgccttgcccgcctcttgttcaagcagtgtctccaacatttgggtggacaccagggcagcataatgaagctgaaaatgggaaaacaccctggaaattatgcgattttttatttaaaaaaaagagtgtgagggtactcgaaaaagtaagaaaaaattgggcactatattaaaagtcccgcattttgaattttatcaaaaacaaaaggggtgacccttttgttttgcaaaacttttttttgtgataaaaaaccatgaaaatttgttatccggggttttagaggtcgctgatcacgaatctgacatctaatatgaggtcatggaccccaataaccccagggaataaactttcatgaatatacattaaaaatttttgcaaaccaaagggtccccctgttgttttaacttttggtaaaattcaaaatgcgggacttttaatatagtgcaaaaattgtatataaaaaatttattaaatgttttgattcttcaaatcctaaatttcctcgatcaaacctccatttttttaaagtgacacaaaatttattttcttacaattaaattaaagttctttttaaagagaattcttatgtttgcaaataattttgcaaaaaatgcaagtctaaaaaacgtcattttgaaaattttactagaaaaatctcaaagaaattttaaaaaacaaataaataatcagttttgaaccgctcagaatactttaattaaaatcacttcggaatattttcaaaatcgctgaaaattaacaaaatgtttttttgttgaaaatttaattttttttttgggggggggggggttgtttagccacccacacgaacagcctaaaaatcttta

SEQ ID NO: 34848 - DNA, 1115 bp, Heterodera glycines
  misc_feature (72)..(73): n is a, c, g, or t
  misc_feature (82)..(82): n is a, c, g, or t
  misc_feature (1031)..(1031): n is a, c, g, or t
  misc_feature (1067)..(1067): n is a, c, g, or t
  misc_feature (1086)..(1086): n is a, c, g, or t
gcaaatttttatgccaactgatgatgcttcattgcaaataaaggacggcagatcatcaaaacattaaaagtnngtaatcaanaacttccgaaaaatttagactgaacgtgcataaacagaattaaaattggttatttttgaaaaaaagttactaatgaattaaatgtttcatatttttattgtcataaaaaatgtaagatagcttaaatgtatgaaaattgttcaaagttaattaattcaactcttgatatgattagatagccaaatatttctctattattttattaaattttaaaaaaagtcagtgtcaaaattgttcaatctaaatttttcggagtttttatcaccactttttgtaaatttttgttcgatttttaaaaaatatcaatgccaataggagccgcagggggaaatattgaaaattagagtgcaaatattaacaaattttgcccaaaaaatcatttttatggatttttggattgaaactttaaatatttatctacgattttgtaaccaaataaaataatttttttttggtttttggctatattttaaaaagaaaaaaaaatgaattcctttatttttgatggttggaaaattgttgtaattaaatttataaataaataattttactaatatgtaattgctagcatttctttttctgttgactttttacacgccataaacgcttgcaatcatagaatatttccattttagcattttttattcacattttcaattaatttttcatcttatgaagaagaatgaattaacaattacttacccattctgacattttaataaaattctttaatgccatttttcattttttgttatttatccctatgaatcaaaccgctcaaagcatctttcccattaaaaatattcaattaacaaacattcctttgttcgatataaaagcacagtggtaattgttgtattgtttcattaattagtttagctttttttagtcttacaaaaagatctctcactttttgtttccccattttgaagaaaaataattcttttanatcaccaaaatatttattttaattaatttaaattanataaataattaattaattntaagcacagatgtgtttttattgattaat

SEQ ID NO: 34849 - DNA, 934 bp, Heterodera glycines
ttcaatataaatacccacccaatttcgtagccgtgcataatgcccatccaacgaggccgcgggttggcggaagaacgcttcacaaaacagtacatgaacacggagctgaaaatgttttcagaactattaaatgaaaatcaattagaagcaattaagcaaattaatgccaataaaacttacacaatgtcagcaaattcaatgagggcacaagtgaagaagctgaaacgaattgcattaacaaattgtaccgaaaagggcagtgatcaggatcagaccccgaattcaaacaaaaagtcgaaaattcaaaactttcaaatttagcacttttgctcgaaaattgatttaaaaaaggtaaaattaatcagaattcatagaaacagcaaaaatgatcattaggtacagattttaatataaaagcaaattttgaaaatttcgaatcatcgacttttagttcgaatttgggtcggggttcgaaatgggacgaatttttatttatgcaaccatcaaataatcaaaaaaggcattttgctcaaattattaggacctctccttttggctcttatgcagtttgacccccataaattttttggaaaaaattgttttgttgtgaaaacaaatttcgatattttgtcggtgttttgtccactctttcccgcgtcgctttcacctttcgagatggtcaacgtcggcgcccaattgcggcgaagcaagatgtccataaaaaggacaccttgcttggtgacgttcaggtggaaaacgggcgtttcgaatttgacaattggcggagtgaatgggtagtcgcgactgaaaacgatgtccatgttgaaggtgcctccttcgtacggcgacccgggcggtccttggatggtggccgtccaatggtacaagtctctgccgccatcaattggcgctgcggtgcagcccatgatcggtt

SEQ ID NO: 34850 - DNA, 297 bp, Heterodera glycines
attagagactggacaggatttccccagggcctgttactgtaatttttttttgaaaaatacccggagtcctgttaaaacaggacatttagtccagggaactgtccaaatccatcttggaaatccgggtcactatggtgcgggtttttttcaaaaatttcgtctctaaataaaaaaaaataatccaatccaacccacgtccaaatactttgttcattataaacaaagtggcattagaagaagtgctggaagaaaagaaagttgacggatagtaccggggagggggggggggggggagaa

SEQ ID NO: 34851 - DNA, 866 bp, Heterodera glycines
atctgggcgcatcggttcggggggactgccccgaaaacaaaaaaatcgattttttcaagtgtccgtttaggggtactcaaacatttatggggagcaaaaatccaacgcagaattaaagtacaggctatagggaagctactgccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggtatcggggggactgccccgaaaacaaaaaaat

SEQ ID NO: 34852 - DNA, 901 bp, Heterodera glycines
cttcttcttgttcgtcatcatcgatgtgctgctgcaatgcgttggccaaaatgcatgaaagttttgtggccaaatttcgtgtcatccgaccgcaggccaatctgatcactttggacggggacaacaacaacgacatcattctccatgaagaagcagacgaagatgaagcaatagctcgtcagtggaattttgcaaaaaattgcattttttactgggccgtaaaatgctgtcacattgttagcacttttcgcggttttttaaatttttctaggccaactttaggagccgttgaatacgaatttgacattttttagaaaaaaaaaacaggaccacatagattcgtttttattatctactaaaattaccttaaaattaaaaaaatcaaatcaaatggaatgtaattgccccaattttgacgaaatcataatttttctgcagccaaattaattaattttcaaattttgcatgctaattgaaaatatggccattcgctaaatttttatggttatgatttgaactggaatagtgccacttttttttttttgcaaaaattcgctgtctcaacatggaatttccttttttgagagccctgtacttcttccgccggacaacagccgaggccgattggtggtggtactgctgacgaactgcaacaggaggcggaggacaacgaaagtgttttgctgaacggcgccgaatcgccgacccccggcgccggcactttgggctacgaaattttggcggaggactccaaaacgcctgccccattctatgaaatgatgagcgaaagtgagctgaatgtacgcgacggacaatcctcgttttgttttaatataaattttgcgacattttttggtttagattttttccatttttttttgaaaccacagggggggaaggg

SEQ ID NO: 34853 - DNA, 1049 bp, Heterodera glycines
tcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccaaaggaatggatttaattaaattctctccttcggggatttttttccattaggtcgtccgttagcgttcaattgctctagtcaatttttaaaaatttttgttgaaatatttgtcgtgctctgaaggcggggggggggggggcgtttccctatagcctgtactttaattctgcgttggatttttgctccccataaatgtttgagtaccccaaacggacacttgaaaaaatatttttttttgttttcggggcagtccccccgaaccgatgcgcccagatttatggggagaccgaatccttcgggaatagcttccctatagcctgtactttaattctgcgtggggtttttgctccccataattgtttgagtaccccccacggacacttgaaaaaatcgattttttttttttcggggcagtccccccgaaccgatgcgcccagatttatggggagaccgaatccttctggagtaaattccctatatcctgtactttaattctgcgttggatttttgctccccataattgtttgagtgccccaaacggacactcgaaaaaaaagatttttttttgtttttggggcagtccccctgaaccgatgcgcccagatttatggggagaccgaatccttccggaatagcttccctatagcctgtactttaattttgcgttggatttttgctccccataattgtttgagtaccccaaacggacacttgaaaaaatcgatttatttttgttt

SEQ ID NO: 34854 - DNA, 660 bp, Heterodera glycines
aaataaaccgagtccaaaaatttttcggaaatcggattgaccccaaaatagtcgaaagtcggaatcagtgctatcccttgtattaactgtatttaccataaaatttttagttaaaataacgcaacgatcaccttgaccacgacaatcagcttcttctggtccaggccgagtttggcggccacggcgagtgcctccttggacgtcttttcggaaacaatgatttccaacagttgcattttgtccaccggtagaaaactttaatggaaaaaaacaaaattaaaaatttatttaaaaaaaaattaaaaaagggaatgaattgcaacggacttcagagttaaaaagctcgtatttttgatcatcaaaatgatcagaaacatttgtgggttcatccttagtccgtgcacaataaaggaataaccgctggaggatttgaaccaatgggaaatgtgaggaagaaacaaagggacgaaccaatgcaccaataagtttttttgaatagattaattgaagttaaggaaatattggcaaaaattccaaggaaaataaaatttataagctatttgactcaaggacacttatttttaaacatacttcgtcctgaaaaatgcacaaataagcgttttttttaactcccaaaatgtactgacgaatttttaaaac

SEQ ID NO: 34855 - DNA, 1699 bp, Heterodera glycines
taaaaattctaattcttttttttaggcttgtataaaatgtcatagaggtgttaaaaataatggtaaatgtagtcgttcctgtgggtatgtaagttgcttcaaaaatttcatcacatttaaaaattttagaaatattaattatactaaaaactccttgttcattaaaatggatcttgaagacaaatccggagtgatttatggaataaattgctatgaacccaccgttaataaaattataggatataatggagaagaaatcaatgtatttgaacaggaacaaaatgtatgaaaaaataaacaaaaaaaaagtgaaaatttttttagtggttggcaatcaccgatgcatttgacaaagttttatatgaagccgcccatttttttcgtctttttttaaaaactgtaagaaatttttttcaatttaatgtattgtttttttcaggatggcgcaataaatgccactgattttgaaagaacaataactaattctttcgattatttgagtgtttgaacagtgaactgaataaattttgtgttaacttaaaaaattttttgatatcattttttgttaaaaacaaattataattttaaaataaaatttttattatttttaaaggtttaaggtaaaggtaaaaaaagacaaaaattaaaggtaacgaatagctttttttcatataaaaaactagtatctattttttagcaagtatgaccgagttccttgtttttacattcggagttttggcgactgttgtttttttcattttgataaatacattgatgatagcctatggtatttatcagacattcaacacttatgtgtatgaatatggtatatttattttgagttctaaaaatttgtttaattttagaatatgacgatgaagaagaaattaatgaaactattaattcatcgccccaatattttcgttaaatgatcttatttattttgaaacaatgttgttctttgaaataatttttgttaagtgataaatattttttttttagttactcaaaataattttgtttgaattcaattaaatactttaaattgaaaatttttgtaaatatatttttagaatggaaatgttatctatattattaaactattttaaaaacaattttaaaaaggtaagtaaaaaaagactttgaatactaaaaaaattttttaaggagtcctttatatggtatgataataaacaagagctgaaaaatcgtttaaaatgccaggattctaattacaatttggctattcatttggacactagctatccctacgaagaatttttggatgtcgggggcaaagattttttatttacatttctgttttatgaaaaaaatgttcgatgttgttgtggcaatgtgatcggtacttagaacttatttcataatgggattgtacggttggagaatgagaccgaaattatcgtttatttttatcgggaaggagcacagcgatttgacagaaacaatttatatttgagccgtctctacagaatacgtatccctcttagcgcaatattgacatggcttcatagaactgagtgtctaatttcgcctgtttttataattctgaaggctttttttgtaatttatgacaggtttttttctttttttttaataataaaaatatttttttcttagggaattgttgcatcaatggaaattatttaccgatagtgcgccgacgcttaaagaaatatgt

SEQ ID NO: 34856 - DNA, 896 bp, Heterodera glycines
  misc_feature (883)..(883): n is a, c, g, or t
tgaaaataggaatttgaccatttttaatagattttcactgtagaatctggcactcttttaggtcaaattttcaaaattttaagggatttttgaatctcggtggtgccgataggcaccgacgttaattttttggattttcaattaatttgggaatttggttaaggatattttgcgttttcaagtaataaaatagagacacttattaataattacttaatgagcgatataagaaaaaatttctaaggaataaaaagtcccccacataaaaacatagatattgccataaatttgcaattggttgtttttagtagttaattttacataaaaatgaccattttaggattttttcctaaaaaagcataaatcagcaaattttctcaaaaaaccagctttgacgccttgaaaagcagaaaatattgataaatcagcagagttgggagctcattcttaaattattttttcgctaattgatcaagttttttatcttacacaattagcttatagactaaattttggcccaaagaattcacaagaattgacaagtcttacaaaaaaaaagcacaccactattatttcaagagttattactcaagcttaggttgcttaattggcaaaacccatttttttgaataagtaaattcagatgaaattttagcgtggaaatgaattgtttttgatagagatgttttttaacgttttcactattttcttttcccagtgagtaaaaaaaaaatttttcgcctttcgatagcgcctatgttgttgaataactatttttttatggatttaatttccattgggaagttaatgttaatgtcttcctaactttttgttgaccaagttcaaattaacaatttctgatcattgctgaatttttgagcanatctgaatttttg

SEQ ID NO: 34857 - DNA, 1241 bp, Heterodera glycines
gtccaacatgggaaggcggaaattgcgaggatgggtgaaaaaaaatttttaaataataaactaaattagaaaatttgaaaaatttaaatttttttaaataaattaacaaataaatattatgaattggaatccaattgtagaaataatgtaaaataaaaagaacaaaaactaattctgaattaatagcattctcatctgttaccgggccctgcttcaacgaggtaaccatttggacaccagcagcagaaattcaaaagtcaaaagaaaattcatcgttgatgctaatatggtggtaaattttggggtacataattaaaaattaattaattacatgtttaactccccagggaaattcgattgaaaaggaatgtttggaaaagatgccaaaggatggcaacaaaaatggcacaatcatttggcgcgccattaaaatgcgcacagtgccaatgcaaacgaataacaatgacaaagaaagatcaatcattttggagtcatcaattgcctttaagaaattgttagtacatattttatttattaaaatattaagcaaaaatgcgtaagtgaactcttttttgtaattttaaaatttttaatcaaaaaaaaaaattatagtaaaaagattataaattattaagctatacattgggagcaggaaaacggctttctctgcttttcgactggaataaactgtttaagccattctctcgcttttctttggaggaaaatggtgataatttaattatttatgttttaatatttcaaatttggcattctccacaattctcaaaatgccattctcagatttcgctgggcgtgccatgcaaaatgatttcctccgttcaaatggtccgtcttttttgtcggattatgccgacctttggcttcttgcgttagacatgctgccgatggcacaccaaacagcagaagagcaaagagaacagctgaagatggagctgttcatcagccgcagctccaattgctccatggaagcatgggtagaaagaaaggcaaatccgtccgatcagtgaaatccaattttttaggtatttaactattttcctttatctgggttatgtggatatataacatttagtaacaattttcccagcctaactatttgatcaaatttaattcccttaagtttgtccaaccgtcggattccgttggagcatccgatccgaaaatgccattcgacgattcggtgtgcaaactgaatccgattggaagaaaaacatgaacgg

SEQ ID NO: 34858 - DNA, 1100 bp, Heterodera glycines
ctgtgtattatcactttatttccatctgtgttccgaaataaattgaattgatggtcattaagcgtgtgtcaatttattaactgaaatttggtcctctccctccctccctctctctgtttgacgtagacatttggatggcataaagttttttggcgtttaaacattcgtcccctattagcgggtcatcacagaaaccgttggacatacggtacttatcctttttgtcatccccctgaattgttttaccttgttccccccattttcgaaaaaaatgaaaattttaaaaagtcgttaaacccagggctcggatcgacaatttttcaaaatcagaacagattttgttttgcgaaactgcctccaaattagttatttttaaaattattcgatcaataatgtattatttttttcgcctccgattgtcgaatttaacgatttttggggaggaaataagcaaatcgtaaatttcagtgcattcgggatcaaacaatgagatttttaacaattttttgcgggtgcagtttttccataaaacttctggtgaacgggcgaggggagggggtccggcggaaaactgatttgttaacagaccaaaaaaggccaatttttccaataaaaggcaagcaatgactttttcaaaggaaagatttgattgtccggcttgttatttgtgattttttgaacgagttctgtccttatttgtgaatttcgtcatttttgtaccagtgttacctatctcaggaattgaaacagaaggaagggcacactctgaatttcagtttatctccaaatttgggcggctaacattcgaattccaaacgaaatgtgtgactggtagacttataggaaggaccacttttgtctaaaactcattttgacctgaatttacaaggagtgagcagaccgagttctacgcgagctaagcctccgaccaaacagacgccaaattttaccaccccgccccccttcgtacaaaggcattgaattgaagcacatatgagcatttattaagcacaacaacaatacaattacataggcaacgattaaatatacatccatttgaagtgatgatcacagaaatttacatacagatacaacaattt

SEQ ID NO: 34859 - DNA, 963 bp, Heterodera glycines
  misc_feature (911)..(911): n is a, c, g, or t
  misc_feature (930)..(930): n is a, c, g, or t
atataatctctccaattttgcaggccttctccattgtaaagtactaacttaacctgaaaaaatgccaacgcttgttgtttttaaaatttttcgaaattctgactttttcattacttatttattttttgcaaaattaattcataagtattttttcagaaagtgctctgaaacacacaaaactttatttacaggttaattaaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgctttttaaatttgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaaggagatgaataaaaaatctaaaaatttttattngctttttaaacatgcgaanaattttaggcttaactttttttttataaactga

SEQ ID NO: 34860 - DNA, 824 bp, Heterodera glycines
gtttaaatttcaaggcggggtaaaagcatgacagcgttaattttctggaccggtaaagtcgtaattacgggaacaaaaaacaattctgaaattgaggaaatgtatcatcatattctcccctatttgaaaatggctcaaaagaagttagggagacgataaaaaatttttcatttattgggacggtcccccaatttatagttctgttgggtatttattttgttatcgattacttcgcgcggcgccggcatcgcggcgcaccggtggggcggagaggaaattcatggttttggcaaattttcaaaattcagaaaaatcatcataaaaaaaaaatctcaggatttgagaaaataaaaccggcccaaaaggtttgggatcaaaaagatttaaatttgcaaaagaaaaattgaatttccttcacctgtcacttttggtgacaggtggatgattgatgaccttcccgcggcgctgcgcggcgcggagagggggagtgaaaaaaaaaatcgccagtgcggatttgaggaaattaaatctacaaggcggcagacttcaaagaaacaacccctcacatagggttcggttggcacgcacccctcctataggcttgggattgtgcgggaaaatgtccccgggcggtaacatcaaagggctgcgcccctcccataggcacgggtttgtgcggtaaacacccgtgcgcaactgtgcgcttttgacgtcttatactactcacatatatcacacatactccaaacaaaaacaaataaaataaagggtcacaaaaactaaaacaaaacgccaaaataattcaaaataacaatgatatgaca

SEQ ID NO: 34861 - DNA, 985 bp, Heterodera glycines
tccgtcattgctcaccaactgttacgcgtacagcaacggcggcacttgcatccgatgcagctgttcacgggctctctaaacctatttttatttttttctatctcttctctgaatggagttataacaatttttcacaacagttttgcatttaacagacacattctaaaaattctaattagtatggtagtccaagcctattattattttttttgactagtctctgaatgggttatcccagttttagtatcctttttgaaaaacaactattttaataactgatacggtagcccaacatccattgccccaatgtacccttcggtttgtcaacgggagcaaacaattgatgagtttgtttggtttcttttttaagcaattttccgtcattgctcaccaactgttaggcgtacagcaacggcggcacttgcatccgatgcagctgttcacgggctctctaaacctatttttattttttttctatctcttctctgaatggagttataacaatttttcacaacagttttgcatttaacagacacattctaaaaattctaattagtatggtagtccaagcctattattattttttttgactagtctctgaatgggttatcccagttttagtatcctttttgaaaaacaacaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggtacttgcatccgattcagctgttcatgggctctctaaacctatttttttttttctatctcttctctgaatggagttataacaatttttcacaacagttttgcatttaacagacacattctaaaaattctaattagtatggtagtccaaacgtattattattttttttgacttatctctgaatggggttat

SEQ ID NO: 34862 - DNA, 763 bp, Heterodera glycines
aatgtaaaaaacctataaaagttttcccgccggcacataaaaattctttttctcttaaaaaattgagtcaaaatcgcaaaactttgtcattttttggtgtaaatatgttaacaagcacacacaaatttaaaaaaaattttccccggcggcgcctactggcactgccggaccccccccccccttgtaccccaaatttttttgaaaaaatttggaccgggcccggattagtggaattttatgcaaaaaacagagtgaagcaaaggaaggccttaactatcgtaaaatttcgggttttctttttagagctccaataggcttggaaaacacggcaacctcttcctcgttttccgtgttgttactttcttttccgaatagttttcttattttttgattgaaaatttgccattttttgtggccaaagtctctttgtccaattttttttttgttttatccgacaatgaatgaaagcgtaaatcatttgtgttccttttaaggatttgcaagtgattttttcgcgcttcggcgaaattctcagctgcgaagtgatttgcgaccgtcgcaccgccgcttcgcttcaatatgcattcatcgaatttgaaaagccggaacagtgcgaggccgcctatttgaagatggacaatgtgctcattgacggtgtgcaaagtgcaaagaaagcgaagcataattgcccttcttaattaaagcaattcatatcattaggaaacggacaatttgttggggaggggggggggggggcgatgcg

SEQ ID NO: 34863 - DNA, 910 bp, Heterodera glycines
taccccgaggggacggagacgaaacaaaatgccattttcagaggagtagcgggcaaatggaggcccgttatgtttgaagaagttgaaattggagaatttttactcaacacatccttttaagaacattctccggaggaattatttgtatgcacaaattgccccggaaaattttttaagtgcttagagaatttcagaattcccgagttccaatagaaaaaaaaattaagggtacggaatccccagacatttcgtttcgggactgttccgacagactcccgagtctgatcccgtttcatcagcagatatttttgggactttccagaactcccgacgagccaatactcgagagtgggtggactcaagtctgtaaatttcaatcccactgattttttatcacataccaaaacccagaaatggtccggtcctccatcagtgggtcttgaataattaacccctttggccctacttcatctcccgaaaactgacgttatcccgtatccccaaccctaacgattcccgggatccccaacaagggcgtagcaggggggggggggagggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaagagattctattaccagattgc

SEQ ID NO: 34864 - DNA, 887 bp, Heterodera glycines
attttgtgttgtttttgttgaaaagcaaacatttgctgtaaaatcatctgagattcgacatcagcaccctcccagaaaccccaagatttgtgtttttattgcgaggtatcgtttgtgattccatcaaataggcatacaacaatgacgtttggaatcagaatttggacaaaaccatgacttcgcgttacgcggtcgctcgcgtttcatccttgccctatcttctatggattagcttctataaattagcttacatatgataagtttggtctaatgaaacgagggtgaatgttatcgttcatcgaatttatttcttatttaaaaatcattgtattacgaatttatttagcttttcctcgtttaacttttcctcaaccttttgcctctctttcctcccaatttttcttttaccaatgtattctttccgttttttcctcttcgtctttttgttcatccattttcgtttcattggcacggcacaaattgtgaatggtcagcagctggacagcaattcggaggtgtgtttttcgtattgtatgtcaatctcccctcctttttaagcagcttcagtctaaccaaacgtacagtgtcaccaacgtcgaccgcatgtccaatgcgttccattcgccaacggacaatcagacgacttctcttctcggagacgaaaccctcaaacccagcgacaacgaagcgaactgtacgactacggaaaatggttgcgagttgaacgatggcaaatattgtacggactgtaaaacaattggtttgccattttttgcgccccctccctcttttgggaggtggtgaaaatatgggattttcccttcccctttatacatatcttggtacttatgcagtttaggccacacaaataaaattttttttgtttt

SEQ ID NO: 34865 - DNA, 1177 bp, Heterodera glycines
tcttcggaacaatccttggttacggtgaatcaatgggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccatctgatggtggtgcccaattagaggtaaacggcctgatatacgacaactcacatgtcgtgccgtataatccttatattctgctgcgttaccgagtacaccataatgtactgtttgcatatggtaacaaagcaaatattaaatacgcactcaagtaccctttcaaagggccaggacattgttatgtcgagtgcaaagaagagtccggcaataaaattggaattgatgagccggctcaatatgccaagatgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcctattggaaacaatggcaaaatgagtggaagaatgatccaaagtttaaggacattcttttcgaaaaagtcccagagcggttccgatgggcaaaggacaaatgggtcctgtacaaaaggcagcaaattaaaaggccacctatcggccgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatatgggacaaaactctggcggaggcagctctgtcgcgctggacagatcagatgagatggctttttgtgagcatcctggtct

SEQ ID NO: 34866 - DNA, 1019 bp, Heterodera glycines
tgaatttttctttttaaattttttattattgctgccggtctatttaatgggtaattaataaagactcatagcttaaaatttttctttattttaatgactttgttgccagaataataagttttaatttttagtaaaaaaaaaaatcacgattctttgcaataatttgttaaatatttcataagtctttgatttgatcagccatgactatactatcactgatcagaattgcaaaaaatttaaattaaaaattatatacattttttcaattatttttaaaatgaattattttaatactaattgacgattatttgtaatttattaataatcattaataatctgatagcttctaattatatagggaaagatttcacacaagtataaattaaaagatttgtttttaatacctaattatcttttcttctatgtaattaatctgatgaacatttcgccccataattctgtacatattatccttataatccttctgctgatcaatttttttttattgatcatgcgcgaaaaccccaaattgaaattcttctgtccaactaattagttaattaattaataatggttctaatctgctgatcagccagccagccagtcaacatgcattgatcggacaattaaatcgcgttcagtcacaaattttgccggaatttctcgccttcgcccccctgccgatccccagtctgccgatgatggattggattggcgttttgtttgacaaaatttgctcccccccaacccacacttctacccccaaaaactcgactctcccccaccccgccatcatcttttcatcataacccataaaccatcaccgtttctcaatcaaatgtcctttccaatagtcacccaattaaccagaattaattaatttagaattaatctagaaaactggaggttaaaactattttatatatatatatttatcgttttgaccatggcatttaacacacaaatttttcctaattttggcactttgttattttttattcaattctttacttcaaaac

SEQ ID NO: 34867 - DNA, 879 bp, Heterodera glycines
ttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgccccagattttatggggagaccgaatccttccggaatagcttccctatagcctgtactttaattctgcgttggattttgttccccataattgtttgagtaccccaacggaaacttgaaaaaatcaatttttttgtttcgggggagtccccc

SEQ ID NO: 34868 - DNA, 1112 bp, Heterodera glycines
  misc_feature (1083)..(1083): n is a, c, g, or t
cgctacagcaaatgggactgccaatagggttggtttctttgccaggagttgcgtcgctactacacggagagtgggtgccaagtggccacggacattgcgatgactgtccatttgctgcgaccgatgaatcaccggtcggaaatcgcacgttttaaggtgataaataaatgaatggacggacggacaatgcaggacgaacgaccgcattttagaacatttgcgaggcgaaactgatggtacgcgggcaaatgccgttggtcaaactgagggagaaaattttctgtccgtccgacttttggtcgaacctcgaggactatgaggtgctcaaggcctccgattgctttacggtcggtttttctccattttctattctcctttgactgggttttcaaaatccaggacaaacggtcgtaaaaattcagattttgacccccctaaactcagatatttttaagtccagcgaattttttaaatttcggacaaatttttaacagttttaggagaaacgatcacaaattttgagattttgtccaaccttcaaaattcgttgcatgacaatcgtacaaaggcaactcgtagcagttttaaaaaaacacaaccaatgaatttggattatatcttttgatcgaaaaacttgaaatatatttttctaaattttttaaattttttctaaataagaattttcaaattttttctaccaaaaaattgtttagaattttctttgaaaaaatttaataatttatttgaaagttccattcagaatcgcttcacctccgcctttttcttcattcacgacaccttttacatcgaccgtcgtcaccccaattcgtccgacatcactcagtcagtcctggctaaagttgccgaacaatttttgatttgcatgttcaatttcagaccaatccgcgactttttgagccgcaagaccaaacagttcggccctcacaaagtcgaggacatggccaatgttcggatggtcgacctgactgtgcgtcttggccagccttacctcttccaacaccaaggccgatgcgaacacatgtaaaaggggacggacggaaatttggtgaccctccgaaatgngaaaaaaataaattttagagagaaaatct

SEQ ID NO: 34869 - DNA, 843 bp, Heterodera glycines
ggcaataaatggtgccatggctattggatttgccagtgtatttaccggagcaaaatcgggaattattaattttcgattatttttttaccattctccggcaaaattttgctaaaagtggcaaattggcgcggaaaatttaccaatttttaccatggcaaaaaaggggacgaatttgactttaggagcgcataatggcatttttgtcaatcttcctggcaatgaatggtgccatggcaatgggatttgccattacgcggacttatcggagcaaaaagcggtaattaccaaattccaattgctgttatattttcccgcaaaaattcgataaaaatgtacaaattagggaggaaaatttaccgttttttacaatggcaaaaaaagaaaaacttttggcatgccaacttgccagactggagcataaatttaatttttgttctcacccacctgaagcatgaaggtgaccagcataatattccctaaaaattaaaaaataataaaaacaaaatcaaaatccttaaataaaaattataaatatttttttttaaatttaaaaaatccccccccccccccaaaaaaatgctcaccaatcgttttgacggcaacaatcacacattgcacaacatgcttaagccctttggcgcgattgatggcgcggagagggctaaaatgtttttaattgaattttaaaattattttttttggcaaaatgccaatgttttctttttgcctaccgtaacactctgagcacacgcaaaattttgaccaccgaaatggcgtccgatttgagcacaaaagagacaagcgaaacagcaacaaccaaaatgtcccagcaattgaacgcat

SEQ ID NO: 34870 - DNA, 941 bp, Heterodera glycines
tattcttcaggcaaagtaaaaccctaatttttcacgttttttcccatataaagcttcaacgggcttatgcttgttcatatccaactgtcttccgcttcatcaacacaatttgatatgagaaaagtcaattgatgcagacattgcacgatgcgtcgctggtgaagtccctcctcaaaaacgcgcaaatatcgtgccgtcgatgcgagaattctcgactcttacagggttacaataccatcaacaacatcaaccatgcttaccaaaatgatcaaaattaccatacaatgttaatcctgataatatcttcaattttctcgttgaatttctcaaaaattatgtaataaacccgtagtcattcttcaatgttttgtcattttttcgttgaaaacacactgataaatatgttatggtgttaattttaaacatttttcgaaaaaaaatctgagtagaatcaattttggacaaaaacagcttgccagactaaaacgaccctctgactaaaccggccagactaaaccgaccagactaaaccgacccccaccgtatctatgtataatgttcttgcatcaaataaatcattcattttatttttatgtccttttttcgaattttcttcccaaacaaaagaaattccagattctaataagaaatgagaaatgccaactcaatatgatgtcgtcctgattcagcgatagcaaggcgagtctccatattttcttttttaattaatttcacttcagttgctgtcagtgctcaaacaaaatcggcggtggagcttcgacggcacatttcgcagtgcgccaaagacatggatgcaggtgttcgtcatcggttgttatgtcaacaaccgaatggtggttgcagctcaagccttactgcctggtaaagcttctaagtattacacagaagtccttcagcagctgaaagcgtcaattgaaccc

SEQ ID NO: 34871 - DNA, 943 bp, Heterodera glycines
aaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgccccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaccaaaaaatcgattttttcagtgtccgtttggggactccaacattatggg

SEQ ID NO: 34872 - DNA, 1054 bp, Heterodera glycines
tgtgacggcatcagcgtttacagtgccgacggcgatttggcacaaccactgcagaaatagcggaaaatgggacgaaaaacgatgacattgacggccgtagtgctgatggtgaaatcagcaaatataacgcactcggagtttggctcgagaaccgagcaagcttttcatttatcgtttaatgtatcatttttgttgctaggacccgcaaaatcttacaaaatgattcccagccctagtaatgattggagttttattgtaaaaaaattttcgcttttcacccccaccacttaattcatgaaaatttttttttcattcaggttccgccgataattttttccaaattgctcgctgttccgacaagatcgtaatgtatcactttggttgttggaacccgcaaaatcttacaaattgagccatataatgtccaaaaatctacttacaaagtaccttttttgggaggggcgcgtttaccggctgaaacataccccctcccccccaaaaaaatttttttttttattttttgttttcttaggtatttggtaaaaaatttatgaattggatattttgatcgtcgttaatgtaaatttttatggaacatggtgacaaaaccgaaaagtacaaataacctaaattgcaaaaaaacgcttatttaaaattaatgtttaccaccccaatttcttaacagattccaccgaccaattttcaattttgtggcttgctgttccagcagcagaacatgctacagagaatcacccgaaccgccgcttccctatcagcggccaattttcaaaaattggcacggtttctgggaaggttcgttgttgcaaaaaatatataggtaatattaaaaaaaaaaaaaaattcaccccgaaaaaatatgaaaaaataagcatcgctcgggaaaaattcgcaaatttgtcattgcccacgcaaggcatttgtatggcatttttgataaatttcaaattttttgattctataactatacttcttaattttttttatataaaaaatttcttatttcgaacttcagcaaaaaaattgaaattttttt

SEQ ID NO: 34873 - DNA, 821 bp, Heterodera glycines
  misc_feature (545)..(545): n is a, c, g, or t
tcccttttttttagctgattttcctggaagattggcatcaaattagagatataattagcacaaaacggacgataaaatggaaagggaaaactaaaaggaatgtttgttttcatagaatcaaattgagttcaaaagagtgccgaatccctccccagccccagccccaattttaatatttcaaatttaaaagcctaaaatttaaccctgaatagttggggtgacttttgagtcggtggtgggttcttccgctcaatttcatgtgaatttttacgatattatttctgcttccccgtccaattgggaaataaaatggcacaattataataaagtagtcgatggcagaggagggcacctgctgataaatggccatggcacggaattggccaaatgaatgacaatgaattaatttacgtgcccattttctccgcgccctccgaggcggccacagtcccgcctcggagaagtcattttgaattggcaatgccaacaatctctgttttaaggagccgacagcaggtgattttcgaggaactcattggccgggngggggggaggccattggcacaaatgcaagggaaagaaaactgacccccccccgcttaattgcctgctagatgacatggcccctaacccaatgtcaatgtcaaactgcacacattggcgttgcacctgtgccgtcgtcgtcatcgtcgtactatttcaattgggcacggcattttagagttttcgggcccaatgaagcggcaatactgctgcacatgcgcaatctgctcgactttttgcggagaactgctcgaattttcaatgccttctcctccttc

SEQ ID NO: 34874 - DNA, 925 bp, Heterodera glycines
caacacttagcgaaaacaggttagcatatctcagcgcaaagggatggcattttttttttgaacggttcaaaagttcttaaatgagatcagatggctaacgcaaaaaaaattttcccgaaattcgaccgggaaagcaattccgcagaccaatttgcagagagccccccccccgtttttgtattattacactgaatattgtaggctatttgatctgtgtgtttttattgcgctgatcaagcatttcattccgtctccgatcactgcttggtttgaccaactaatcaccgcaattttattgaacattcgcgcggcaaagaatggacccattttatattttcttttttaaaattttttcttctcttcaattttggtcagcattttaatccagacccccattcataccagtgtattttcggacccggttggacccggacctaccaggtcgggtaccgggtattggattttcaaaaaatcgggtccggtccgggtcttgaaaaaaccgggtatccgggtctgagacccggtcgggtcccggacccgaccaaccctagaaaaaaactgaacagcatcgaaataaatcaacattaaaaaattgtgtcatttctaataaattttgaaataacaatacaaaaaatatagaaaataaacaaaagcaatccataaataataatcataatgtaaaattaaacaaaaaatgatttaacattttttaaattatttataatttttctaaaaatatatgaaaatttaaatttattgatctcaaaaataatcgatttgcgaataattgtctgtaagtagaaaaaaacaagcgttgcttaaattatctatttttcatttatattatttattaaaaattgtaccgctatgcttttaaatttggaagattaagattataacccaagttatgaagttcgaaatttaa

SEQ ID NO: 34875 - DNA, 831 bp, Heterodera glycines
agacccttcgagcaccacagaacggccgtgaatttgcaaaggcgcttctacgacttgccaggccaaagaattaagcacagagacaaactacataaattaaattgccaaggaaatatttactattttacaaaaaaagtattatggacagcacttcattggttctgctgacaacgggcgtctttttgttgttgttacttttaggtcgagtcaaaagagcggtgccatttatcacaatagccaaatcatccgcaaaaagcgatggaattgtcggttcagtttcagcagttgcgagctcaatcacttcaatgcccgcctgggctgagatttaattaaagaccaaataaaaatagcacctcagtgagagtctctgtcaagtcctggtgttgtctaagtgcaagcggaaaatcaattttggactttgcctttttgtcgtcgaattttaaagaagaaggcattcgaatagtgatcgcatgtgtgtatttcattgcttgtttaattttgtcagcacagcttaagagacagacttttcgattagaaaataaaaaccaatacaattttcattgattaatttgtttttgggacgagaggaggaagctaatgagcctttgaagtttttgtgcacattatgtatttccggtttctctccaaagactaattagttgtcattaggcaaaggcatttgtacatacgccaaaattcccctgctgctgttaatcaccgtctccgccttttctctttttattggtgattttgattttcagctgcaaatcaaaagcaagcagcaataaaatagacggtacttttccgccgtccggggatagctgtccgaat

SEQ ID NO: 34876 - DNA, 973 bp, Heterodera glycines
  misc_feature (763)..(763): n is a, c, g, or t
cccgacccccttaattcctttggtatttctatttcaaaagcccaaaaattttgaataatttttttttgaatttttagcaaagaaagtgccaaccatcaccagggctggggattttcggcacttttcggaagccatcgaaaaacagcggaaacagcagctgaaaacgacgactcggcacaacagcaacaccaaaaccaacaacaacagcaaatgccactttgctgcgcattgttctgatcaaatgatcagtgatcactgatcagagattaatgttttatctcttatttttgaattaatctttgccgcgatcgctttttttgattgattgattgatgattaactccgttttgaatttaaagtttatatgtattttatttttaatttaacaataaaaaattagagccattcctttccctccgacgtctcccctttttctctctctctctcttccttctttcctctaaagatcggaccggtctgtttttttcggtatttttcggtttcggtttttaaccgaaaaaccgaccgagaaatttttgagtttttcggtttttttcggtttttaaccaaaaccgttcgaccgaccctcttgtccggtctctactttcctcccttcttttctccttattatcaattctcctcattgtctctctcttttccttttttttctctctcatgccatcttcccctctacttttttcactcattatcatttctcctcattgtcctctatgttttctcttttttctcctcctcctcctcnctcctcctctacctcctcctcctcttcctctctctcctcttcctctctctctcttcctctctctctcttcctctctctcctcttcctctctctcctcttcctctctctctcttcctctctctcctcttcctctctctctccccctctctctctctctctccatttctcgcttttctctcctccctctactccgattcccatctctaaatt

SEQ ID NO: 34877 - DNA, 1405 bp, Heterodera glycines
taccggctatagtgaagctattcacggaaggattcgcgtctccccataaatctgggcgcatcggatcagggggactgccccgaaaacccaaaaaaaaatttttaaggataaaaattatttaaatgaactgactatataatatttaaaatagggtatttctcttcctttcagtatccctgcaaagttgggtgcgcttctgatcagattctgaaaaaaaaggtaaggctaaactttttggcctgtttaaaaaggaattaaaaatttttaaaaattttattcatctccctttttgatagaaaaagcatcaaagtgcctaaactaacatgtaaataaaatttggtgcgtgtcataaccctttctgaaaaaatatttaagaattaattttgcaaaaaataaataaaaacgaaagactcatattttcgaaaatttttttgagccagctagctcggcgctcatttcagtgtaagttactcctttaccggggagtatccctgctaagtttggtacgcttctgctcagattaccaaaaaatatgagtgatcgaattttcactacaacagctaaggctacattttttggcatatttaaaaagcaattaaaagatttttacaatttaataattttcctgcaccgaaggtactcactcggactcttcgcggcctcgtgcgcggagccgttccgcgcatagtaagggttgaacagctgcgagactttttgactgctacattgcggaatcatagtggtgcaaaaatgttgccactccctcgtgagttggaagagaatcgaaatcggacaaagcctctcaactcaccaccaccggcgaagagaaacaaaagagatgagtcaccaccagtttttgatgagaacgggaacgagcttggctctcccccatcttacaatggagataaagaggatgaggaggaggaagggataatttctgagtcaccgcctcattatgaaggaatcgagactgtaacatttgacttccctcatcatacaatgaagattatgaacgtgttattgcggattcaccgcctcgttatgtagaaactcaaaacgagactataacaccaaaagtaccatctcgtcagccgcctcctaccccaagcactgctaagccggcccccctcctccaccaccaccgtctacaatttcgactcctatttcaataaagacaccggctgtccaaccaccaaagcctacagtatccacccctccacccctccaccacaaacaacaataacaaagacaccaccgccgccgccgcctactaagtcggctcacaactacaaaaacaataccaacccctccggtagcaaaacctaccacaccaacccatccggtagcaaaacctacgacaccaaccccatcggtagcaaaacctacgacaccaacccctccggta

SEQ ID NO: 34878 - DNA, 814 bp, Heterodera glycines
acagatagatagaattgtgtgatatatctgatgatgaatgtggaaaatgaacacactgttttgttgagctaaccaaaataatctttgtgccaattggccgggcaaatggtaaattttaaggacgaataaggaaggtgttttcaagggcgcatgccctaaggacgtgaaatcaaggacattttaaggtttggacaattttttaaaataagattcgaaaattgttgttttcataaaaccggcaaataactactcacaaagataaattagttgttttcaaggtcataggatccaaaagaagttaaattgcgaaattcaagtactctttaaattcgtcaggttacatttctaaatcttggtttgagaaaaacaaatgaaaaattatcaaaattttcgattttatgaacaaagattaggattttaaagaaatacaagaccaacgaatcgagtttttctgcctgttttcttgaaatttattttttaaaagaattgtatactcaaaaattaagaaattttcttaatacgggaaagcttttgaaatacaattccctaataaatttgaggttgccaatatattttttaaaatttattttcaggttaaaaaattactaatttttatattttattaaacatttttccgattttgcatttttatgctttcctaatccaccacttttttttttgtttggcggtgaaggtaaagaaatttaattggacgaagaatggaatgggcgtcccggcggggattggccggtcgaattggccggcacggcacatcatccttttgtataaaggaaatccttttcgggagaatttg

SEQ ID NO: 34879 - DNA, 906 bp, Heterodera glycines
ggtctcggtcaaagactcgagagcgtttttagtttgatcagtcttggacagcaatcgaaatggttgagaaaaatgccgccgggtatcatccgcccgtgctaacaatttcgcgttggttttttgttcactaaaattgtctgagtatcccattttggattttttaaatcctgtcttaagcatattttacaaaataataccacctccccataattctttttaaatcatttataaattttctaaaaacaaatttgcacccataaattttgcttacttatttactttaatataattgttttcttcaattattttaattaatcatttaggactttagaatgatattaataaaaaatttggttattcttgagtaaagttaagaattatttttcatcaaaatttttccatttgctgtttttttaagaaacgcccattttgtcagcctggtgaaaaaaaatattcgcataaatttatgcgttgaacatatgactataacatttattttaagctaatatacatttttaattaattataaaaggaacatgttttaaattcaaaatatttcaaaaaaaaaaaattaaacaatgtaaattccaatagctgtatgcattttgttggcataaggagcgaaaaagagaaccaaagttgtgtggcattttattaatgaagaataatcgtgccattaccacgcttttatattaagccgagaatagctgtccatagattaatcctcggataaatttccatcttatgagttagtcacagattttacgccaattttttgaattttttttatccttaatcactttcataatgattattagggtgggaatacttttatttaaatattttttcagctttattttgatgagaaatgtacgaaaaaaatcttttttttttgcggaattattt

SEQ ID NO: 34880 - DNA, 935 bp, Heterodera glycines
tgtccgtttgggggtactcaaacaattatgggggagcacaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaagattcggtctacccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttgtggtactcacacatttatggagagcaaaaatccaacgcagaattacagtacagactatagggaagctattccctgaaggattcggtctccccataaatctg

SEQ ID NO: 34881 - DNA, 681 bp, Heterodera glycines
aagcgttaataaaaaattttatttgcctatttttgggttttttgtgcctattttgcgatttttttctgcctttttaggtgcctatttcatgattttttgtgcctaaaaatggagtccctattcattactatgggataaataataattaaaatatggtctcttgctgaactcgtgagttttaccagccctacaaattatgcgctaattcttttaatttcagtgcttttttctattctttttccaaattaactttcattttttaagaaaaatttaaagccaaaaacataaatttattttatattttataaaagacaaagcaaaaaatgaaatgggaaggaaagtgcaaagggaaaatgacattaattaaaggaaaacaaacaaaaacaaataaataaacaaagcacgaaaaacagatcaaagagcgacgccgtcgatgaacaattaaaattcgatgaaatagcaaaaaaaagggaggggaagagaaagagaagagaacggacacggtaacgacaagaggagaggaatgtgtacggtaggtagatgattgactgttgtgccatcgtattcccttccactaccctcgcccccccccccccccctcccctccatccgctcaatcgcttttctgtccaatcagaaatagaccgttggtggggtgggagggtccgaggaggacgactg

SEQ ID NO: 34882 - DNA, 891 bp, Heterodera glycines
  misc_feature (849)..(849): n is a, c, g, or t
gatatctgttcaaaatttctttgggttacaggcaccaccaccctaaataaaattgcgtttttaattttcaccaaaataaattacattttctatttccctccccaggcccctcgtcccaatttctcactccgatcggcgcatttgctgctcaatccacgcccattgctgcgccgccaattggcgatggtccgccgacggtccgttgggctcgcgtttctgcgcaaaaagccaactgaacagtgagtcgccctgcacgtcgacggtgttcccgcacagaacgacggtgtccaacattagcaaatcgacacggacggcggagggaggggagagaccgtcgaaggacaaacgcactttgtagaacagacgggggaacgtcctgagctacagatcattttcagtttcatggaaagccaaaggcccggcgaaagacaaagaatttttttaaaaatttgtccaatttaaagcctactcactacgccttacaattaacactcattttgggcaggcaatctgtaatccaaaaacaagcaaattgaggttttgttttgattcaatttcggcaaaaaaacaaaacaaaaattggacaaatgtttcataagttgtggtttgtttttaccatcggctgctgaaatcggtgcgtgccaattggcccgtcacattgcccaaatggtcgtggttacccgcgattgtgtaccacgggaccaaaagttcgggctggtcgtaaatctcttcaaaggaatcctgaaaattgcagaaaatcgcagcgatggcaaattttaaaatcgatttaaataataaacgaatgaaaaaaaaggaaataaaagtgaaaaacctcgaaacgcccatcanaggcattttggactccgttaaagtaaaaattgtcgccgacat

SEQ ID NO: 34883 - DNA, 962 bp, Heterodera glycines
ttcggcatctttcttagctttttcttctttttcttcggcatctttcttcgctttttcttccttatctatcttagctttttcttctgctttttgctcttctttagcattttcactttctagtaagagaattcgctgcttcaattctcgaatttccctgtcccgttggctttcggttgctttttcaggaaactgtaccactttttgttgttcagaagcacggcgttgctcaacagaattaagaatccgaacgttgctcctctcaaattcatgaagcttgggattataagggcgttgctgaatgccgtccacagtttgttgtttttccgactgttgttcgggttgttcttccgtgtcttcattttcggattcgtctgatgatatggacaccaatactggaggtggcgtaggagacaattggtttcgggctttacgaggatttttggggataaagggttcgtgacgagacatattttgtaaaaataatttttctggctgtaaatttttggagtttttaggcgaatgatattgggaaaatgatgtattatgaatagaaaattgtgaattgtagtattttaatgattcgcatttcttgaaattcctctgttactttccaaacaaatacaattaatttccacgctttcgtctccgtattccccaaagtcttggtgtgtcgcttccaaatttggtaagaccatttcttcccatgcaaattcgccttctctaaactcttcccaaaatattaccattctatcctctatcataactctgcccttttcccacagtaatcttctcatttcggtcccaatgtacggtctatcagcttcttccacaaatatttgtaaatttgtctcaaataaccagaccgaaatatatggtctttgcccttcagaaaatatttgccaatgtccctggactcgatttgtagggattatggaaagttcaaaatcgtccgaaaaatcgat

SEQ ID NO: 34884 - DNA, 1363 bp, Heterodera glycines
  misc_feature (1185)..(1185): n is a, c, g, or t
  misc_feature (1232)..(1232): n is a, c, g, or t
  misc_feature (1279)..(1279): n is a, c, g, or t
aagcaaaatatgttcgccaagataacacataaagagcaattgtcgaacagttcaacgaacgcgagccacttgcttatcttcgcgcaatttcatatcactttcacttttaaataataggactttgaaaatggaacagagaaaaattatattaaagaccgaattacatttttttaaattttgattattctattttttaaaaattctctatagtgtcgaaattactcaatgtcgaaatggtccagtgtcgaaaatgcaggaaaacagtgaaagttttagaaataattcagtgtcgaaattacttagtgacgaaaatgtagtgtcgaaattacttagtgtcgaaaatacttagtgtcgaatttactcagtgtcgaatttacccagtgtcgaaattaccagccgcgcttttttgtgccaaaagtttttgaatttctggttgtctacccaaactaaaaaaaataagattctcatagaaatgcctactgttcgcgaaatatttgggtgcctgcaaaacccccaaaaaaaaggcgtcgccattccaacaaaacgaagccagcgtattcaatgaaatggcagccgcagaaccgtgccgagaaattctgacagtgacagattttgacagtaagaagaatttttaaaaattatttaaaggcaaattttaatagataatagatatttaaatctaattctcgtaaaatttttaaaaatgcaagtgatatgagcaggcatgatgaaattctaattggtcacgatgtttttctttctcgaatttgtaaccccgagagtgtggtctagtgcctattttctaggtttttattttttttatagtctaaaaagcctaaagatttttaaaaagacctattttggcgttttgcccaaaattattaacaatttgcccaaaattattaacaaaaatgcaataaaaacgaaaaatacaccccctaaaaatcgaaattccaattttttaaaatttgttataatttgttggattcaaacaaatcgtagctctttgtttatcttcaaattataaattggcacgaactttgtgacaaaatcaaaaaattttcaaaaatcaggcgctgagcaaataaaacacggacaattaattgaaaaaattacaattgtgcaaactttcatttgaatacgggcaaaagtgtctgacggaaaccaaattttacgtgccattanattcgtataaaaaaggaattgaaattttaaattaatacattcattanaaatataaacgaaaaacatttttaaacattagtcttaaattcattgntgttttaataataaatagggactccattaggcacaaaatcctcaaataggcaaaaataggcaaataaaatttttattacgcttt

SEQ ID NO: 34885 - DNA, 1225 bp, Heterodera glycines
  misc_feature (35)..(35): n is a, c, g, or t
  misc_feature (66)..(66): n is a, c, g, or t
ttgcgtcccgatgcggatggatgtacagcttaatntccaattaactaaatttaaaacacaggaacnccaaaaatatacaaaatcggtgctggaaaatggcgaccagctccataatgacagcgcgttcccctccttgatcagggtcttctcttcgtttacccatcccaagagtccctcaatcctggccggcacgtcacgctattcgatcgggaccatgaagtccccgacctgcacattgacccgacgaaattgaccggcccagcgatggccagcacccaaggcaaggcggtgaagtcggaagatgtgctgaaagtattcgaataaaaattttccttattcacagttttagtaattttttcaaatatggacaaattttgtcaaaactaagatttgccctaaaagcaaggctttggaaaaaatagctgacacagaatttttatcgccaaaattagtaaaatcgccggtgatggggacgggacaaatgagcacgaattttagctttattttggcctatttcgaaccttctacccgaattcgagcaagaaagtcgaaaattcaaattttcgaattcgcactttaaccttaaattgattaaacatgcaaaaatcaattgcaatccattgcaaaatttaaaatgggtaattttatacaattttaaaacaatgtaaattttgatttggcttttggttcgaattcgtgtatggagggagttcgaaactggtcaaaataaagtcaaattggtgttaagtgaccgcaaaaaacccttaggttttcacatcacttttttgtgccgcgctttttaaaaaatttggaaacaagtaatctggcagtggggatatgtgccacagtgcaattttttgaaagtttgacctatttcctaacagttatatccaaaaatgaccaagtattggattttggttaatttttacgagttaataaggtggatgctagttatggcgggccgaaggcaccgttgggaaaattttcagaaactttgatgaattttaagaataaaaaatagtttgtattttattaatttatttaaataattggcattatgtctaaaatttaaaaatgcattgcggatcccgttgagcaatagaaactcaaaattttttctgatcctatcccacgggattaatcacgcaatctgcgaactggaatacccaaaaatcccgggccgggatgcaaaaacaaaaattttgcttataggtttactcaaaag

SEQ ID NO: 34886 - DNA, 780 bp, Heterodera glycines
  misc_feature (734)..(734): n is a, c, g, or t
  misc_feature (759)..(759): n is a, c, g, or t
  misc_feature (769)..(769): n is a, c, g, or t
  misc_feature (774)..(774): n is a, c, g, or t
aagatttgttgtaaattaataataaaagaatttatgtaaaaataacaattatctttgaataaagaatttcatatttttttaattgaatttataaaattaatttcattttaatttaaatattcaattattgtacatttcaaaattctctttttaattaataaaaggaataattaatttattttttaaaatttataataaattgcattcaatttttgtacctcttctaatcaatctcagttgtacctcttctaatcacttttgtacctcttttaacaattttgtacctcttctgatcacagttgtacctcttttaatcacagttgtacctcttctgatcactgttgcacctcttctaatcacttttgtacctcttttatcacttttgtacctcttatcaaatttgtacctcttctaatctctgttgtacctcttctgatcactgttcttcctcttttaatcactattgtacctcttttaatcacttttgtacctcttctcatcactgttgtgcctcttctaatcaaacacagttgtacctcttctaatcacagttgtacctcttctaatcactgttcttcctcttttaatcactgttgtgcctcttctaatcaatcacagttgtacctcttctaatcactgttgtacctcttctgatcacagttgtatctcttctaatcaccgttgtacctcttctaatcaccgttgtacctcttctgatcaatgttgtacctctntaaatcacttttgtatctgttctanaatttaaaanacggncgcgaa

SEQ ID NO: 34887 - DNA, 1041 bp, Heterodera glycines
tttacggcgatttgacctacgcggaaggggccaacttctcacattggccacgctgtccccgcgagtacctatcattatctgcgacggcattggcaagcgctatttggtgcccggctggcgactcggctggctcatcatgcacaatcgcttcggcgtgctttccgacgtcaaagccggcattgtgtcactgagtcagaagattgtcgggccatgtgcactgatccaaggggcgttgccacgaatactgcgcgacacgccgcagtcgttcttcgacaacaccaaagcattgctagcaaaaaattctgaaattgtctacgacattctgtgccaagtgccgggactgaaaccgctacgaccccaaggggcgatgtacatgatggtcggctttgacgaggaaatgtacggggacgagacgggcttcttgcagaggctaatcgcggaggaaaggtaagcatcgttggcactttgctcttcctgactttatctctgtttcgctttcagcgtgtactgcttgcccggttccgccttctctctgcccaattggttccgtttggtgttggctttccccgaagaaacgacgagggaagcgtgcgagcggatagccgccttctgcacacggcacatgcgcccgtgcaggaaacaattggcactatgggggagtcaactggacgaggaggacggccgagggtcggaaggggcggaacggaccgcagctgaagagagtacgagtggtgaggaggaggaagacggccagagacaaagcgagcgatcagccgaatgatcaatcgatcggccgatcaaagcgtgccgaaatgcggcacgggcacacattcccatccaaccgaaaagcaaatctcaaacagtcgctaccgtcgcgtcatttatcctttttgattgtttatttttttctcttattaatttatataatttctaaacaaattactttgcttttatgcattctttcctatttttatccatttgattttgattctctttataacccaatgatatttttgagcaaataaatcctctcatttttta

SEQ ID NO: 34888 - DNA, 865 bp, Heterodera glycines
cggcgtcgagattttgtcctccttcatttgttccttcctgacagattgccgagtcgcgcgcttccggcaaattcacgctgttcgccctggtggacggcgcgatgcgcaaagtgagcctgaacgtgccgcgcaccatttatgtggacgacattgagccaaggcaagcggcggttccatgtgccacaatttgagagacaaacccattgaaaatgccaaaactaattggttaattggtcccataaattctcctcaggcacacatcggtcggcagattggcgcacaaaattttgccacgccaacgcccatgcgcttacctgtacgagttcaacattgacgaacaactgtttgctgcgcgaatgacgtaagggccgaagttggtcgtcctccccccccccccgaaaatattttttaaatttactaagcaattagaaattttgaaaaaaaaatttcgaaaaatttttgaatttttttgataaatttcagataaaaattataaaaaaattgtgcggtgtaaacgacggggacggggggatatgtgcaccacataagggcgggggtgggtagggctcgggtaattaattaattaaatattttaatgggtttttaaacgccgtaaatttcttttccccccatcattagcgacttgaacacggagttgtgcctgtggcgcatcaacggtgtgtacgagacacgggcaccgctgctgttcaacgcattggcgcacgtcggtgtccgatgccatgtggacagggcgatggcccaggggatcagcaccagcgcggatttgccaattgatgccatcaccagggtgagccaagcatgggggaggaagcaattcgaacacagcggaaaaaataaatattta

SEQ ID NO: 34889 - DNA, 856 bp, Heterodera glycines
taattttcgtcgctaccccaaaatcggaacattcttataaataagaacaaatggtagccctgctggtttaaaggcgccagcttggactcactcttattggcgctaacgaaatcatatgattaaagtgaaaaaagaagattgacgagcatttaaaaaaaaaatttgtttttttgggttaaaataaaatttggtcattcctcgatcggggtccccgaaccccgacaattgagctcctcccggccccgacccccgacatgtcgcccccgaggtccccggcccccgactttttgccccccgagggctcggggcttaaccctaaattttattgatgaattcaaaatccaccttaaagggtgtgactgtcgtgcggcagcccaccttggtactgtattcgtatgatgtgaccactggcgttgttgtggaccttggcgagcggttgtccattgtgccggtcattgatggtacggtttgaaattgtaaaataaaaatttaataatataaataaaatcaaaagaatttgtcgtggatgacgctgtcaaaatggcacattttggtgcaccacaaattcgggaacaaatgctcaagggaattggtgacgacctgcagaaagtgttggacatatttggcaatggcagtgatgacgacgatgcaagcatacaattgctgttacgatacatcgttgaaaaggtgtcatggatgtgcgttacttggatttattggcgggtctcagcttcgctttctcccgccgagggttgattctcgataataaattagtgctattcgagagtctcggcaaaaattttgctttcgatataaagaagcgtttcatttctcgcacttatttaagatggtgttg

SEQ ID NO: 34890 - DNA, 958 bp, Heterodera glycines
ttatcttatatccaagaaaaatgactatctcttattttgagaaattttatacgttacaaatgctctcgagcatgataggaagggcggtgcgcaatcgccatttaatttctcagagaatttttaaatttatcttatatccaagaaaaatgactatctcttattttgagaaattttatacgttacaaatgctctcgagcatgataggaagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagggcggtgcgcaatcgccatttaatttctcagagaatttttaaatttatcttatatccaagaaaaatgactatctcttcttttgagaaattttatacgttacaaaagcgctcgagcgtgagagggagggcggtgcgcaatcgccatttaatttctcagagaattttttaatttatcttatatccaagaaaaatgactatctcttattttgagaaatttatacgttacaaatgctctcgagcatgata

SEQ ID NO: 34891 - DNA, 785 bp, Heterodera glycines
aaaaattttataaaaatttatgaaaaagaaaacaaaaaacattaacaaatgataagataaaattgtacaaataattaaaaattaatcaaaattccaaatattttttctctttcttctccttttcctccttctcatcctcctccattctttctctcaggagggtctcgcacatgtgcagcccttgttcctcgtcattccgtgggtcggtgatgtcccactccatttgacggtcgccaaggtcagagctgccctcccggatttggtcgatcacgagctggaaagctctacggggcgcaattggttgacgaatcacactcccgtaggcgtctctctggccattgcgaaggtcttcgtagacactcctatatttctgataattgttttcaaactctttcaattttttttaccaggctcggatcacaaagtcgtcgtctgggggtcgggctgatgttgagctctgactttgttcagcaaagtaatctttgtaggactgactatgcgagtctttggtcggcctaaacaaacattttatgctatattttttttatctttttcaccatatgttgtctgggatgttgacgggacggcggcacttcgggcatgtccggttggtggtcaacgaacggcgtacgcagatggttggaagatatgcttgacattggtgtcacagggcagctgagtgacgagatctccgcgaagcagtggtccgtgcagacaccgcacgtctcagtgttgtctcaccactgcccttctatcttgctgctcacgatctccatgtgtacaac

SEQ ID NO: 34892 - DNA, 1240 bp, Heterodera glycines
ggattgcccatacattgtcacttactacgggtacatcatcacttttgtgagtgttttgtaatcatgccaaaattgccacgaatttattttttgccatttttcaggaatatttgtacatttgcatggtgagtttttgctgcatttttaatatttttttagttcattgtcattcattaaattaaatacttcttaatagataaataatttattttctttttttaatcgtcagaaaataaaaaatttaataaatatttttctgagaatttaaataaacaataaaaaaaagaacggcccaaaacatcaaaaggtttcaaagattatgcccattttttgcacttttccaaaagatgagactattttgaatttttacgatttttttcaacttgtctgcttccaaaaatagtgattaattacattttgcaaaaaaaaaaaataatatttttaatttttccaacaaaaacgccgctttttaaattttcaaccctttaaaaacccaaaatttcctaacaaataagtgtgtgtcctgagaaattgaaccaatatccctccgaaaggaactgatgtgcacctgtcttgacaagttgttgttgtggcgttgtgaaagtcgttgcgcgcccgacgttgggctgcccgaggaaatcattggtcaaattgggctcagtgtggtgcgcgcgttggactacctgaaggagacacatgtacggacacggactgacgatgattttgtattaggaaaatttgagaaattttggtcgaagtttttccgttttcaaaaattgccggcagaaaatccggcatatgccgagaaaataaaacccagattccggacagagctccggaaaaattggcgcttaaatgcatttttagtgccatttttgcaaaaataaagcgtcgccggctttttagcagcccatttttgaacagaaattggctcaaaaaatgaaaatttctacaatttttgatcaaatcacccgcattaaagagaaataaaattcagaaaatcatgcatcgcgacgggaaagcgaccaaacttctgttggactggttgggaaacgtcaaactgtgcgactttggcatcagtgcaatactgatcgagccaaaaggaaggtatatagttgttcgacattcccggcaccccttttccccgaattctaactttaacatccacgaaaacaggcttgaaccgctatttgggggggccctttattttttttaaatttaaaaaatctttcaaatttaa

SEQ ID NO: 34893 - DNA, 955 bp, Heterodera glycines
  misc_feature (889)..(889): n is a, c, g, or t
tcctgttcatgctttgccgcattttttccccgaactttttggcggcttcatttgccagagttggcgggtcgacttcttttatcgttcgttttctggagcttacgacaatagcttggcctgtgtttttaaggctttctctttgtcctctcgcaaatccttttttgcctcattgttcaaagtcgactcccaaaatgccattcgctcgtttgtcggcttcggcgagttttcgaaggcatctctttctctttcttcagaatccacaatcgagatttcatcgtctttcgttgttccgacgctgaggcttcgtttggtttccgtctcgtccttctgcttcatctcttccttcttcttttccgtctctttttcttttccctctcttcttttcttctcctcctcctctttttccttcatttcttcgccctttttcgtcgtttcttcctcatttcttcccactcctgtggtcccactggatcatcatccgacgttccggattttcatttttcgctttcggtcagactttgctggaccctcagaagttgatgttcgagctttctcttcaacctcttcagagattcttcctcctctttcgataacaattccatcttgaaaaatgaatggctttcgtaaattttcccgttcttttctttgggctcgtttaatctgcctttcgtgttcatgttctcgattaggcctaaaagctgcttattttgctcattatttttcataaattgtcccatttcttcattttttcacttcttatgacatttatactcattctgaactcgttttggtcgtcataattttctttttcacttatgaaaatttctgggatccggtttatttcatacattactcccattattcccgaaatttatttcccatatgattnccgttccatttccgttttttatgaccatttttctgcaaaaagaattgggcatccatgcccaaaaca

SEQ ID NO: 34894 - DNA, 750 bp, Heterodera glycines
atgtgtgatcgccttcggtgacacaattagcctcgtctctttacgcatccaatgccatcgttttggccttttgaccatctctttaattagtgtgcatctcgagattctcgattcgtcaactggtaaattctcgggtttatgggcccccgtctcactgttctggagagcaaacactcggtagtgctctcgactttggtatggtatgcattgataatttttggcattttttttataaatttataaatcctcgcccacttcgtaagaaggcatttacaaatcaaaatcaatttaagaataaatgatgctaaatcctttgcatttcgctcccattcaaattgcaacaattaaaatcattcctccgtgttcagcgtctccgcttttttttgtccgtccccgcggggaacaaatccccccccccaacccctccgccattccgttcacatcagaagaatgtgaaaatgcatttcataatgatttgtgtgtagaaaacccttattcttattataaatgggccgaggattcttataaaaaacaaaaaaaaaattttaaaaaatcattaaattttgaaatatttttgtaaaacatttttaatatatttcccttaaaactatatttttgatgataaaaatctatgctttttattcattttccttttccttataggataggataattagcggatacgaggcgtgccacacaattgacacgaggagaacgcacacacaggttgtgcagtgcaagtgatcaccc

SEQ ID NO: 34895 - DNA, 628 bp, Heterodera glycines
cattcgagactggttcggctgcaaccgccgactttttcccttaagcccgaggattggacaacattttgggcctaggcccattgctggaggcaaaattgccggtgcgagtgctcacggaattgcggatcagagaaagcatgatgggatcgaaatggtcagtgcgcgagttcaggagagcggtggcggaacaagtacggtgcatgcggtcagcagagtcagcattggcatcaatgaaagacccggaagtacgcactgatcaccgaaccgagcgtggtcagacgggacgaggaggcaaagcaggtcgggagccatttcaaagagcatttacgggacaaccaacaaacccgtgcgaaacccaacgaaacacgaagcgaggagcggtacgggacgaacgcccgtttcgccagacgatcgaccacacatgccaacgagaacgagagctcaggcgggaattggccccgcgtcgcatcaaacggaccaattgccacaacggagatatggagctgttcactatgcctaagaagtggacatcgaccaagcaaatgccgcgactatccgacagctcaggagcggaggaggagactcattgagcagaagcgatgcttgcgctgcatgtgctctgatcact

SEQ ID NO: 34896 - DNA, 646 bp, Heterodera glycines
tgcgctactaacttgctaaaattgaaaaatttaattaagtttttcagaaggtatacaattttttcatttttttggctagaacttttgaaaaacttaataaaattttttgaaatttagaaagttaatagcgcaattcaagggctatcgtatgataccaagaatgtgcaatttggttgcgtctgagaaagttatgagttgatttagtcaaaaatttagcaaattttgcacttttcgtcggtccaccaaccacgggcgacgaattgtttcctgctgctcttccacatttatttttttgcgctgttcagaaaccgcgaggcgcacttgcgcattttcctgcacaatttgcactttttgctgtccaaacaacagatggactacgccattttcgtcgttgaacaggtgaaaaaaggccagaaaattgaaattttgcgatcactcccaaaaaaaagcgatgttaaggccagcaaccagacattcaaccgggcgaagctgatgaacgtcggctttgtggaggcgtcccgtctctacgactggcaatgcttcgtcttccatgacgtcgaccttttgccggaggacgaccgcaatttgtactcgtgtccggaacacccgcggcacatgagtgtggcggtggacaaattcgactaca

SEQ ID NO: 34897 - DNA, 894 bp, Heterodera glycines
caactttgttcgtcggatggcgaaatattgggacagtgcattggtcgcgcaaaggatcatatgagtcttcgaccattgacgacgtggacgaagacgacgagttggaccagtacttggacgaagaggacgaggacgacgtgccgacggagacggacgtggagacgcgcacggaaggtggagggaaagggcgcggggggctatggttggtcagttacggcaatttcagctggtggcatctctccgctgaagatgcacatgatcccgatcatcaaaacttcgctttcttcttcctccaatcgccggcccagcaacgaatcaatgaacagttttgtcagcgaccgaacgaggcgaatattcacaaaaaacagaaccgttctaagggcgaccaatttagccaagtggccggcgccatcagcagcattgccagtcccatcgcaagtcggcgcattttgctcgaatgtgacgcggaacgaaagaagggcgacaaggacgcgccctggtcggccgggactgctcattctgcgcactttgctcaatcgcacctctctctcatgcttttcacgttttcagctctcgccgccacctctccgggggccaacacacttttttgggtcgtcgtggctcaactttcactaccacaacggcggcaattacacgcgcctctaataatggcaaccaaatcgcacccgaactgtccgatttggtcatttacatgcaggcaattctgcggactctttctgtctgtccatcaattagttattttgtgtcctttgacaggcggtgaaattcaaaggttttgttgtgacgtcaacggaagtgcccgcgagggacactcccgcgacgagcggaaggaatggcggagcggaaaacgatagcttagtgatcggagaactc

SEQ ID NO: 34898 - DNA, 1071 bp, Heterodera glycines
  misc_feature (74)..(74): n is a, c, g, or t
  misc_feature (76)..(76): n is a, c, g, or t
  misc_feature (90)..(90): n is a, c, g, or t
  misc_feature (96)..(96): n is a, c, g, or t
  misc_feature (105)..(105): n is a, c, g, or t
  misc_feature (112)..(112): n is a, c, g, or t
  misc_feature (613)..(613): n is a, c, g, or t
  misc_feature (615)..(615): n is a, c, g, or t
  misc_feature (682)..(682): n is a, c, g, or t
tacctcttttatcactgttgtacctcttctaatcaccttaccaggtctttaatgagatttgtacctcttttatnantccttaaaatattntataanagttgtaantgttatnatcactgttctacctcttctgatcactgttgtaccacttttaatcacagttgtacctcttctgaccagatttgtaccccttctaataatcttgtacctcttctaatcagatttgtacctcttctatacatcttccaacaattttgtacctcgtctgagctcaacaacatataaatacgggcgcgaagcgcccgtttggcctcaacaaaatttaacaacgggcgcgaagcgcccgtccaagctcaacaaaatttagaaacgggcgcgaagcgcccgttcgaggccgcgaaacggcctaagaatcaccaaatttaaaaaacgcgcgaagcgcccgttagaggccgcgaagcggcctaaaagccccagataatttgttaaaaattccaattctccacaaagcgccctaataaaattttttgattaatctcaaatatcttctggaccaacaattactccacaacccatagcttatctaggtagcgaagctcaagaagtgtgaagngntttttaattaaaaaataaagttttagattttttattattttgtttttttaaaatttttaaataaagntaattgtataaaattatatttaaaattatgaaattatttttgtacacctcataacaagttagacttttgtacctcttctaatcactgttgtacctttctaatcacttttgtacctcttttaatcactgttgtacctctttttatcacttttgtacctcttctaatcactgttgtacctcttctaatcacttttgtacctcttttaatcactgttgtacctcttttatcacttttgtacctcttctaatcactgttgtacctcttcctatcactttttgtacctctttttaatcactgttgtacctttactaatcactgatgtacctctttaaatcactttttgaaccctttttatcccagttgtaccctcttctgatcactattgaacc

SEQ ID NO: 34899 - DNA, 1017 bp, Heterodera glycines
taaacagataaagtgtatatttcacgtcactcgaacagaataaatcttttgtttgtgtgtacgcgcattaacagaatgtgtgtgataaagataagtgtcaacaaaacaacttttaaatagagaacatcatcagcgtcactaaacaattgtcattaacagcgtccaatggtccttcagtgcatggcattgtcctcctcttccgactgttcgtcccccatttcctcctcgtcatcgaactcgtcatattcgtcttcctcagccgcctcaccagtgaagaaaagcaccgcacggggaatcagctaaaaaaccaatggaaaatcgagacaaagcgcaaaaataatgaaaattacctgttcacgaatgatctgtccaacctcgaagtcatcattggttttctgttcctcgatgtcgtcctaagtgattaaaaatagcattcacaaatcagcatttttgagaacaaccaaatgctaatttaattatggcttttcgccaatccctcccaatttgtcatttttttccacttaccatttcctctgtgatggtcgtcactttaggatcgaaaaagttgaagaagctttcgttggtcacctattgatgagacaaaatttatcaataaaattttccctttttaaaatttcaccgttttggtgacgtatttgcccgcctgcgcccctttcttctgttttttcttcacaatcttttgcgtcacattttttccatccttccaatcgatatcgcagctaaagtttgatgaaaaaagttttatcgccatttcagtgtcattacccctgactcttcacgattgtcggcccgtcgtaagagaaccttaaaggtttgataaaagctgtaaatgaaggaaaaaacaatttacggtttttgcgggtccacgtcgaggttaacctcgtaatgtttggtcaacaccgcgttggtgaagtacggattctcggcaaaatggaagaacagagaaaacccctaaatgggaaatgtggaaaacgtattaaaatggataagcgaaca

SEQ ID NO: 34900 - DNA, 1152 bp, Heterodera glycines
acatgtttagaagcttttgataagctatttctaagcgattgaagaacttataaaaaagttgcaacatgaatactaccaaaaagtcagaatttttgcatatttttacttttaacttttttatgtgtcggtatatctttgtgtttttggaaagccaatagagcttgttaagagcattcgaatgataccaagtttaatggattggtcaacaaataaaaaagttatgatgctcaaacttggctcagactataccggccagactatagtgtcccagtccggtaatttctaattgcaattattaattaaatacatttattaattaaataaataagttaagccctctatcaaagggagcttatatttcagggagggcttctataggggggggcggggtatatttgaggaaatacggtaggtaataaatgaacaaaaattacccctcgtccggcatcggttcctcccggaaacggtagcgggtttggacgacagtaaccgcgaaacacaaaaaaatgatggcgatggacaatgtgaacaaatgtctgccgctggaggacatccgttcccataagcacagaattggacaattggttaattataatatgtatttgttgaagaatcactcaaattgaacgagtccaaccaattaaaatgtctttactctttgctccttttatgagttaattaattaatgaataatgggggagggggggggtgcctttttcggcagtaccgaattcgccaaacaaaactctaaattcaccatttaacagagcagttttattaaaggcatgcgagacttttttgattttagcgaagacttccccataagagtcgagaatcaagactaatgaaccgagaagtgaacaaaaaaaagttgtttacgatctaagagagcgtgagaagcttgattcccgcgacaaaaaagtcgagattcaaaaatgagagaattttccgaatcgggaatcgagactctcgggtgtccctcttaaaaacttttttgataattttaattaaataaaaaaacgcggggactgaactattgcaattttggagttagatagaactttaaatgattgaaaataatggggcaataaatttgcagcacaagaacaatggcgctacataattttggaacaacagtgggacaattcactg

SEQ ID NO: 34901 - DNA, 944 bp, Heterodera glycines
  misc_feature (848)..(848): n is a, c, g, or t
  misc_feature (887)..(887): n is a, c, g, or t
  misc_feature (906)..(906): n is a, c, g, or t
tttttacgtgctttttacacatgcttctcgtcatgactttgtttaaaaggatcgaatattgacaaaaagatatttttcagatattttcgaattcagaactttttgagttagagaaagttgcccatttcaataccagtgaggcccacgtactctctctctcctataaattgtcgctcgggctctagatgtaattttaattgaaaccttatgggaatggtggtagcatagtgcgcgggaatttaatgctcactaattaactgcttcagttccttttgacatccattggttcatttttctcatgagcatcatttgtaggctttacttgactataagctaagcagaaagtaaaatttaatcaacacttttaatttatcccaatgatcccttgcattattttaactgcctaaaactgaacgtgctggatcgtttcttaaatttcgccactttgggcctttcttaaatccgccaagaggtagaaaaacaaaaactttaagaaatataaataaattcataacttgccttaagctcaaccaaattaatatttcttggtatcagtcaatagctcaaggtgttgtacatcagaataataattgagaaatttttttttacaaaattataaaaaatttatggtcacaaaatttcaataagtcttgagtcataattttttgtccagactttttggaaaaacaaaatttacattatatattttgtaaaacagaattaaaataactttttatcgatggcataagccaacgttatatgaaattttccaaccaattcccacagtgtagaagaatggacgaataattaaaagcattaattgcgctttatcacaattttctgatttngggagggtttgataattgattttttttaatattttgctntttaagcaatggtttcganttgagctcaaactctatttttgtcccgaatgattgacg

SEQ ID NO: 34902 - DNA, 630 bp, Heterodera glycines
ttccaaaattcgtaatttggggctaccaaggacgctgatctccaatatgatatttattttagcatctgatgactgttagtcatagataggaaaatatcgatgatttaaaaatctaactactgatacaataacatcatgaaaagggcgttaacgactgacatgaagccatcaggtccataatatctttccataaggctggaaaggcagaatttgaatgggcagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtctatatttacactgagcacccgttgaagcgggtgatgcgaagccatagcaaactgtatttttaaattctggccgcaattctaccaaaaacgtgtttagaccgcagtaactcggctcagagtgaagat

SEQ ID NO: 34903 - DNA, 1094 bp, Heterodera glycines
atcccttataatcttagacgtaaagttgtgttaaaacctaatccagtaaaacttcaaattcttttatcaacagaacggccttaatatggtctaaactcaacaaagatataacagatgctccatctgttgacagtttcaaaaaacgaataaataaatggattgagttaaacaaaaatttagtctgtaaaagagctccttggacttgatattactttactaaaatctaacgtgtaagtggtcaccccttcgttggatatttttatttcttctgaataaataaataaatatgtttataaatttattttaaaagttattgaaggcaaccatttcgaccgtctcagaacctcggatttttttgtcagattcggaccctgggtttggaattagtcggaatggatggatgctcttatgcagtttatttagttcccacaaatttttttcactttccaagcaaaaaacacacaaaatatataggtttacggggtcacttgccacgaatctggttttttgaccaaaatctatttaaatatacgaaatgggtgctggattcggatcatcgaccccaaaatctcctggaaaatgttttcacatccgtaacattagcaaattttcagatttccgagttggacagttacatgtaccaaagtgtgggcagtcagggaatcaaggttagtgagactaaatatgtgctttaaaaatatggaaattgaatccgatttaatgtttgtttgatagttccttttcgaataaatttttctaaaaatgccaatttttggtacattttaaaacccaaaaattgtaaaaataggcatcataatttcttaaaatttcggctttaaattttcggtttcccacacacatttcgctgaatatttaattttttgtttgtaaaatactcctaggcctgttttcctgcaattttcagttttacgcggatgccattggcctgccgctgttccaacgcaaaatttcgggacgtccaaaatgtgttgagagcaacacttatgtgcaggacgaggaggatgtagtggaggaattgtaccacctttagaagacggtcaaagaatgggacccggaaattcgtggtgattttt

SEQ ID NO: 34904 - DNA, 1169 bp, Heterodera glycines
  misc_feature (83)..(83): n is a, c, g, or t
gctgcctgaaaaatataattcaaataaaatccatggattcgacggcacagactttgtaggaaacgcgacgttggaaatcactntggcgctgactttggcactcaaccgcttccaatggagcagtcggcacagcacggggatggcaccctgcgcaaccaatgcccgctcaaagccgcggttggccatccgcgtaaaaatggtcaccagcttaatgattgcaacatcatcattaacatttgatgatttatgtgattaattagttgtatacaatgttttagtacaacataatattaaaaataatataaaataataattcgatttattttttaattttagtaagtcttcgagaattttctaactaaaaaattttgtaatttgtgtttaaaaaattaaatattcatttttcaaaaaaattatttaaaaagaaaaatgtataaaaaaaaattttctcgtgtaaatgaatacaattaatttataaaaattcaaaattcattttttctaaaaaattattttaaaaaaatacccaaaatttttttgaaaatttttctttgtgaattaatcacaaatcacccacctcttcctgtacaaacatattgccaacactgtgctcacgtccggcagccttgaccagccgaagcacagcgttgtgcgtgtacagtaactctgtggcgggtgccgcgcactgtgcgcacagattggcgagcgccgccaggcacagcagcaacgcctcgggcgccgacgcgtggtcgacgagtttcaacagtcgcggcaccagcgcgtgcagcgagtgaggggacaagcgcaggaaacagtgggagggcgagcacagctgagccaggcagccggctgcctgaaaagtgcgcggaaaattttgaattttttactatggcatactgtaatctacaaaataagataggtaggtatactgtaatttacaaaaaaacaaaagtgtaaaaattgttttacaatattgaaaatgatctaatttttcaaatttcttaaagattttttttgttgtaattaaaaatagaataaaattttgaaaaaatctcagcaattttatactgtgatttacaaatatagatatactgtaatttataaaaaaaaaaataataatacaaaattgccttacaatatcgaaaattattatttaattttccaaatttcat

SEQ ID NO: 34905 - DNA, 804 bp, Heterodera glycines
ttcatttccattgacaatgccattctctcctcaccctccctccgtctgtccactggtccttctgctctattcccaatcgcctgtcctccgtctcctcttcctcacccagtccatcgcttcgttcgtttctctgctcgtcctcgtcttcggcatggttcgtctgctcattcgtccgttggtccccacccaccagcggaataccgttctttttctaagtttgtgcctctctttactgctcggaaatgtcggtacaccaatttattggctcattcagcttccaattggcattcgttgttcatttgccaggtgtgctcctctccaccctttaccacctccacgtgcccctcttcaggcccacttccagcctctgtttttggctgtccttttcaattggcgattgccttagtgagtgtcccttgtccctctcttacatttcccctccccccccccccccccccagtgattcggtccctcctcaacgtctctctgttctccgcttatttgtccggcgtttgttttgccctcgaaagagtcgtcagctctctgctactgctgcgaaatcgacgaataaaatgggcaattgccatttccctggccatcctccaggttttcggtctccctttccattttgtccgcttttcccctcatttcagtggcttttgtcctttttggccgtcttccaggctaaacattccgccgttgcggcgcccttcgtcgtctccgaattccccccgatttcgcgacaacttttccaccttgagtaatgtgacgccttatcccacgcaatccatccccatttttttg

SEQ ID NO: 34906 - DNA, 841 bp, Heterodera glycines
  misc_feature (17)..(17): n is a, c, g, or t
  misc_feature (32)..(32): n is a, c, g, or t
  misc_feature (83)..(83): n is a, c, g, or t
  misc_feature (97)..(97): n is a, c, g, or t
ttttcccttgcattccncctcacatttgtccncatgtcacatttccccccattgtattctcacacatttcttatgtatgggtntaattacccaagtntgagataaaacttgtggaatattttggtgcaaattcttgggcggcaaatttgggcaattggcggcagcgaaaaacggacaaatcggcgcagacccctcccccatctgcgtcaggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattgggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattgggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaatttttctagtctaatctactcaaaacggttcagattcaataaaaataacattcacggtgcgaa

SEQ ID NO: 34907 - DNA, 869 bp, Heterodera glycines
ttttttgggatagagtataaatttaaaaattccctcaaaaataaaggtctatttcgcacagccctccctatcatgctcgagagcatttgtatgtgtataaaatttatcaaaaaaagagatagccatttttctgggatagagtataaatttaaaaattccctcaaaaataaaaggtaaattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaa

SEQ ID NO: 34908 - DNA, 656 bp, Heterodera glycines
taaaaaatactttattaaaaacgtcttttttatacctcctatttatttgatttttaaaaaccctgtcttaataagaatattttttagatatattgacaaagtcaacctttctgctgtaccaattgttgaattcaattttatgatttcggacaattttttgacaattaacaatggtaacaattagcctaattatatgtacaattaatttttaaaatttgcagtttcaccgaatccaaagggtttttacaaagaattttttgaagaatcaaagcttggctcatttttggaagaatatgtcggactttggctgttggcagcggacattatgccaaacttgcgccaaaaattgacaaaattaatttttatggtgccggataaatgtagacttattcgtgatgaacgtcaccctcaaaattgcgccacatttgatcagatggcatttgagaagaagcatcgctccgtccgtcaaattaacccactcgtaaataattttaaaaatatttacaatttatttatatttaaataaatttttcttagatttcgggtggtgccaaaattgacataaagcatatgccatgagttgtgtattttatgggggttatacaaacaaatttattcaaaactaaaattgttgcatgcacagcttcactgatttc

SEQ ID NO: 34909 - DNA, 960 bp, Heterodera glycines
ccccccccccctccccccacggcggtcccttggccatcttttcgtccttttcgtccttccgtcgtcccatcggctgatggctggcaatgcgatggtgagctggctttttggtggttaggctcgtgggtctctttcgctgctgctgctgctgctccaccccaccgccacggctgaacaaagaggcggctggcagcaatgagaagagggggggggggggcagtgagggcggaggggaggagcggtggtgcgtccctttcatccgttgcccccccccctcggctgaatgagaaagactgaacgagaggaggcgaacgtccgtccgtcgtccaattcgtcgtcccttccatccaaaatcatcccttttttgtgtttgtccgttcttttttccccatgagactcaatgaaatgcgaatgaattgtgaaaattctgtcgatcttatcaactgtgattgggtcaggtcaaattcaaattcatttaatgcttttttttgctagctctctcagggtaattaattaattatgttgacttttctctttctcctaatgaccattgactatttgtccgtttccatttgtccctacttatttggtccatttgtccgtccacattccgttctaccttttgtccatccattttaattccgccaaattcgctcaattcgcattttttccatttcctaaatttcacaccaaattacccaaacaaatggtgacgaggcaaccgcaacaattcaacactaatcgtccggtgaaaaacccaacaaaaatctgtcgcgaaatcgaatattttttggtgcatttttcatttattctcgatccattttcaatgtaacttcgatcagagtggaaataatatcaacagaatggcataagacacaattcggcattttcccgttagacttttcagggccgttcagtcgaacggctgccgtcccctccccccaagttctgtttgccgac

SEQ ID NO: 34910 - DNA, 1183 bp, Heterodera glycines
gggggggggggtagaataactcgaaaataacaaaatatatcaattaatttgtcatttttgactttgagcgttgaaaatcgctctcggagcagagcccagctcagcacccagaccagcgctgtgctggcactcataatggacgacgcagcgccggccgaaatcagtcccaaggcttgggcgtacgcgtaattaattgctgtccacagggcgagaaaaagcagcgggcaaagcaaagaatgccttcgagaagaaagagatattattaattcattaaatatatagttatcaatcaatttgtaaataattaacatttttgcccctccccaccaaccctaaaaaatgaaaaaaaatgaaaaattttgagtttcaaaagttctttaaaaaataaataaatattaagactttcataagaatttctttcaaatatatattttttttaattcttgcaaatattaaagaaaattttaagaaattaacttttttcaaaaaataataaaataaattttttaatgaatttgttaggcatggtttttcccaaaattctttggttttaatttaatttttatttttctggcaaagtgttcaatcttaatcgatattttatttaaatttttgccattttcttatcctgggtattcggtcccctcaccaaatgctgaattggccatggtttggtgaacggagcactttgagtgcgtttcgctgctccatgcgaacatttttgccggatacaaatgcgaaaatgagaaatacgggcaaacaaatggtcatgaaagctgtgcttaaccaaaccttaacaacaacaaaaaaggataaaaaaaaaattaattaaaagaaagacaaaaaataatttaattataaaaaaggcaaaaattaatttaattataaaaaaaggcaaaaattaatttaattataaaaaaggcaaaaattaattaattataaaaaccaaagccgaaatttatgtgagccagcttcacaaaatttttaagaaatttaagacttttttctcattgtcagcacttttcttgcacatttaaagtgcatttaatatcactttaattctaaaatttgatttgcttctgaaaaaacgtaatttttttttgttagaaaaaatagtaagaaacgggtacagtatcaaattggcctacacggtattttatttgtgcatattttcaactgtatt

SEQ ID NO: 34911 - DNA, 1915 bp, Heterodera glycines
  misc_feature (1027)..(1027): n is a, c, g, or t
gtcaagaccggcatatcaaaaatgtccacggtcaagaccggcataatcaaaaatgtccacggtcaagaccggcataatcaaaaatgtccacggtcaagaccggcataatcaaaaatgtccacggccaagaccggcataatcaaaaatgtccacggtcaagaccggcataatcaaaaatgtccacggtcaagaccggcataatcaaaaatgtccacggtcaagaccggcataatcaaaaatgtccacggccaagaccggcataatcaaaaatgtccacggtcaagaccggcataatcaaaaatgtccacggtcaagaccggcataatcaaaaatgtccacggccaagaccggcataatcaaaaatgtccacggtcaagaccacataagcagaaaatgccatgccacgaccacataagcagaaaatgccatgccacgacgatcactcgcagcgttatggatgagttgggtttggatgagttgggtatggatgagttgggggtgactctacaaatcgtaacatttagaattataaatattttatttcctttttatctgttagagaatatcattttatgataccagtgcatatttttctataatccaatagcagttattttgaattttctgtttgtttgtcagggcacagatttttatgttttaggtgggttttctatgcgcgggaggaagtttgggcaccagaaatttggacaccgggaagtttgggcactaaattaaggatttatatattttaattgtctaaatgcaaccatctaatttaaaattttaactaaattaggaatcgaaagtttttgaacgaatatccgctcaattaaccatgcttattttgctatactcattacaatttattctatatcaatctcatattaactattatttgtatcattacaagattcagtctgttcaagatttaaaatttataaatttaaaaagaaataaaaggatctcctatttatctttaaaattccaaaaaatttcactacaaatttagttcaaaaaagttctgacnaaaaaatccaacttaagctttgtggaataagagtgccgctcggctaccctctctaagcgagcatttggccatgctgaggaatagcagcagagaaagagaggaaggagatggacaacgagaacaggcaatgagagcagcagcagacgaacagagaaaaaatagtgaaaagaaaggggaggaggagagacagtcagcggagggcatagaacaatgaaggaaaagaacggggaggaagacaatcagccgcgaaaagtggaggagagacagtcagccgaaaaaaaagaaagggaggagagatagttagacgaaggcatggaacagtgaatggaaatgatagagaagtgatcactgacaagcaatatacataattatagctgctatgtatcgctgatttgtcgaaaattcatagaaattcaattttaaatatttcaactttttataggctatattaactgaaatttaatggatttgaagagattttagaaatttagccatagatttgggaaatttttgtcaatttttagggatttggtccatattttattgcactatttatggattttatttcaatattttttcaccctcctgatcagctgtccaatcgtttattaaacattcttggtattgttcgaaagcatttgaaaaaccttattaacctggaaactcaaaaatttttattcttgtacaaaaaatctgggcaaaaaagtcaaaaaactaggtttttaagttccttctgaccataacaacaacaaaatatcactcatcaactgctcctccgtcaatcggtttaaatcccttctttttactccaccgggcgagcagacggacgcggaggccaaccaatggccgaactgcttcaaaatacgggcctggtctgcggacagttgg

SEQ ID NO: 34912 - DNA, 1048 bp, Heterodera glycines
  misc_feature (72)..(72): n is a, c, g, or t
  misc_feature (77)..(77): n is a, c, g, or t
  misc_feature (103)..(103): n is a, c, g, or t
  misc_feature (109)..(109): n is a, c, g, or t
  misc_feature (140)..(140): n is a, c, g, or t
ttttgctccccataaatgttgagtacccaaacggcacttgaaaaatcgatttttgttttcggggcagtcccnccganccgatgccccagattatggggagacngaatcnttcgggaatagcttccctatagcctgtactntaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggagaccgaatccttcgggagtagcttccctatagactgtactttaattctgcgtgggatttttgctccccataattgtttgagtaccccacacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccccacggacacttgaaaaaatcgatttttttttgttttcggggcagtccccccgaaccgatgcgcccagatttatggggagaccgaatccttccggaatagcttccctatagcctgtactttaattctgcgggggatttttgctccccataattgtttgagtacccccaacggacacttgaaaaaatcgattttttttgttttcgg

SEQ ID NO: 34913 - DNA, 1268 bp, Heterodera glycines
  misc_feature (140)..(140): n is a, c, g, or t
cgaggcattcagccatcattacaaaatcaaaaaacaaacgtggaaagagagaagccaaggctgaagataccaaagactcaaaaaattgatgtcgcaaagagggccgcagaacgcgccgggagagacgtagaaagacattntaatcagatcaacaatatctcgaattccatccaaacccaactaaacacactacgagaaacaaatcctcaaattttagaagagcctgatataaaaatttggtttgacaaaatggttgagatgggaaccgaaattcaaacatcacgaaatgaacttaaggcttttcaagaagaagtagataaagccaaaaacataacattggagcatgtggaaaagaatgacttgaaaaaagcaaagaaatcagccgacgtcgcaaagggaatcgccagacaggcaaagaccaaatatacatcaactctcgagggatataatgataaatcggaaaagggttttagcgggatagtgaataggcttaatgaggcgctcggtgagcatattaaacgtaaagatattgaaaatatacaagtatctgaagctgagaaaggaccacaaaaaagagaaagactagccaatgaggatgttcaatttcaatatgacagcattgatcaaaaatttattgtctatctttccgctgctgtctcccacatagatttgtcaaaacacctcgcctatgtgctcggttttaagaacacaaggctatttcatgcggaagaagcgaattatatgccagatttgactggcggcgtaaggcagctatacatttatgcaccaaatttaatcgaaaacacaattatcggcaaccagatggccccactcttaagaatagttaacgtcgtcgatgacccaggatcgattagtgaagttatatatagcaccgagtattttcatcgtctacagtcgaaacgaatttcagaaattacaattgaaattcacacaccgtttggtgaattcgttaaatttcactggggaagttgtattcttacattacattttaagaaaagtatattttaaaaatgacacacgtatttttcgatcccgagtcggtcgattggtcatctttttttactccccaacatggaagaggacagaaacaatattttgtcgggagcaagtaccagcggggattcggtttcctcggtaatgtggcacgtttcttgacccctattgagaggaatattgcctcgagtgcaggacatgaggggctcccagtgaggcagagagttctgagtgacatcgctcagggccgtgat

SEQ ID NO: 34914 - DNA, 1229 bp, Heterodera glycines
cgctgctgctgcactttgcggggagagattgcgccaaacggtgcccgggcatcgaattgatgtgggaccaatcggccgacggaatggcgcttctttcgacgatgggcgaaggcgcactttggccggggacgacgaacgattcgaagcggagaatgactttctccaaattctgatcgccttggagaccatccaaaatgtaagtacacgtcgtattcggtgggtaaaggtcggggaactgagcagaaagaacaatgaatgacggacaagagcagagaaaacgaacattgggagagtgcacaaaatggacggattcgtggcccgaacagacgcgaacatcgcactcggaaccacgcaaatggcctgggcagtggacactcggcttggcaccgatcagacggctaatggccacgaatttatccgagaattggtactcaatgtgaaagctgaacggggggaggggaggggggacagatggaaaattgacgagaaatgtttgaacataataaattcattaaatttcatccaaattaccccctgtcgcccactttcccctccacttcggtggtgttaaactccagcaacagctcgtgtccgaatgagaacagttcaagtcgttgttggagcccacagagttttcgaatgatcggatcggaagttgaggcgccgtcgtaaattgtcagcgaatcgtagggacagctgaaaacggcacaaatgagcgaccgaatgaatcggtggcgatgccgtggcatttcatttcccccccccccccttaaatcgaactgttcgccgccgaaatacacgtcgaaatcgcggaagaacaaacggatccgttggtgggcgaggccccgcagcagaaacaaacattgcaaattctaaacaaaaagggaggtgacacatttgattcagcggccaaacccacgcttgggtaaaccccggggtaagtgggcgacaaaatgacaccggtgccgtcgttggctccgtttggctctatcaaaaaggcacacccttttgggcccccggggagtggagggcccggcaaaaagggcgcctcggaaatgaattcgaaagtgccgccgagagcgaaagtctgtccaatggaggaatttgtgtaggtaatagaaaaaataaaaaacaaaacaaaccccggtccgttgacgaccaacccgagaatggaacaccaaaaccatcaaattgtgcagactgacaaaagaagagagggggagaaatga

SEQ ID NO: 34915 - DNA, 990 bp, Heterodera glycines
  misc_feature (10)..(10): n is a, c, g, or t
  misc_feature (887)..(888): n is a, c, g, or t
  misc_feature (953)..(954): n is a, c, g, or t
atgtaaaatntggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttaagacaattgggcaggacaagaaaagaatgaagttgatgcctcatgaaactcggaattggttatgtttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgtttgtcgaaaatatccttacataatactcataaaaaatacaaataattcaaaccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaaagcaagcacgaatgaattannagagcgaaagaattgacagtatcgtttctaatagggaaatattgacaggatatttcggctaaaanncggtttgatcatttttagcgcatttttaggtataca

SEQ ID NO: 34916 - DNA, 773 bp, Heterodera glycines
agcctggattttccctgggtccaggtccagactattttttggcaatttagattttcctggacctgggttatggtcaaggatttgcaggtccatgtcaaatatcaaaaaaaaaaatccaagtccaggttaagcacgataaacctggaaaatattcaagaatttgttatttcgagagaccaaacgttttatttcaaataagatacttttaaattttcctaaacaattaggtaattgatttttttcaagcacttgttgtttacttaaaacccgcatgccttgtcaagtctagaaatttttttcaggaaaatccgggtctttccaaaatagaatccaggctttttaaagtgaattttttttgttgccattttgtcccactattatatcaccttaacccagtcgtggccaagcagtgaaaacagttggctgaatgcatgctctgtatgcgtgtaaatggagtgccaaattgagtaattggacagtgccgatgggtcaatggtcgacatgtttttggttgccgcaatgtccaccattttttttttgaatttttattaaaactgtgggcgatttcactctttttcaaacaagaggaatttttcgttttaaatttgaggaaagaattttgctgcggtttatctatttatatttttagaggacggacggactttcttcctctaagttttgttattttcgtcgtcgtcgttaatcgtcctttttcgtcttcgtcaattaggcgctaatgacgggcctattttggatagccgccgccaccacct

SEQ ID NO: 34917 - DNA, 987 bp, Heterodera glycines
  misc_feature (847)..(847): n is a, c, g, or t
ttttcctcgtcagatggtttccctgcgtttgtcttccttgctttgtcgggccaaattgtgcccttccacaaccgaacggcggccgaggcgaaggattggcaaagggttggcaattgaaaccaaaaaagggggcggggcgttttaattaaataattgataattttactctaattgtgatgatgtttttccgttattaagaatcggggccaatgaaccgtgacaatttggggaaacatttgctcggcactttttcccatcagccgacacaaagcgaaaaggagtaattactttattattattatttttaatttcattttgtcatttttccttttggataattttggccaattatattttccttatgattaattagtgttttaattttatttccgtttagtcagccgacggagcaaaaggccaaaagcaaacaaattttggaggaccaaagggacagcggagaaatgaacaaaatgtaagacaatttctgacttaataattagttcaatgctttgttattcagttacattctcattttcaacggcatttgcattggtaagaattaatttaatattttgtgacacttttcaattgcattttaaaatgaaatttaattttaattttaatttaatctttgataagtctaaaaatcacttctcttctgatcattttatttccactttgtttttattttacattttattttctcccccccccccttttcgattttatacattttatttattttatttatttttaattcattttcattttatttttttattttttcagttttctttctccttttcggcctttgtgtgatttgcaattgcgtcgtccgaagggtcanattccaccacgagacagaggaaaagaaaaagaaaccgaccgttagcaggtgaaaaataaaacaaaaagcgcaataaataaaaatataatctaataaacgatacaaagtcccaaaaatatgttttttaatggatttgatga

SEQ ID NO: 34918 - DNA, 1700 bp, Heterodera glycines
tttttcaaaaatacacccctaagaaatcaactgaaaatttttcaaaaatgcacccctaagaattaaaaaaaattctcaaaaattgatcacaaaaatttcatttttttcttgataaaaaattttaggttcaaaaattctccttcttcgaaaaacaatataaaatatttaataatcatttaatgaccaaaattatttttttggctaacctttacatgtttttgctccctaaaaatttaattaaaaaaattttaaattccttttttcatgcttttttcggaattttcgtgccttttcatgcctttttttcaattttttcgtgccttttatagtgcctttttcgcgatttttggtgcctttttagtcggcctctagtaatgagtcagccagaatcctcctaagtattttcataaaattatcatatgcaaaattatgtttttttatttctcagaaaattctttattaaaatatttaaattttttaattttgtacatatttttaaagattcatttattaaattatttgtaatcacttcaccggtatgcagatcatttgattttattatttaaaatttattaattaagtatatttattaattttagtatatttattaacttttctttattcatacgatacttaaccttgttaagattttaacaaaaaataatttaaacagctatttttctttttttatgtgttgcaactttatttattttatttaaatcaaaatcaaaagaatttattcgttatgttatttactctaaattttttatgaaagctgcaattgaattttaataaagaaagatttaatcagtattcatatttatgataaaatgaatgtctaaagctttttaaatgtataattttttctattttctattttctacttttcttatttttaaataagctacctacatttttattaatcttgataacaaaattattttttaaatatatatcttatcttacatataaaactaattttaatattttttaaaaattatatttacagaggcataaatatttaatcgatgaaagtcctggaacaaatttagcattttccttgcgcggtttagcagtcttttgtgtagctgctaggtcgtttcttaaattccgccacattgggcgtttcttaaatccgccagggcgtttcttaaatccgccagggcgtttcttaaatccgccaatatgataattaacgaaaaaataattgtgcataaaataatttgattatgactattattattattcggtgacaagaagtgtcagccggaactgtcatttgtttattacaaaagtcagtttttgtcaacattaaaatagtataaatatattaatatttattttttataataaaattattttttaatttttaaataaatgcagacaacttttttattcttaatattatattcatgtataatattataaattgagagaatttaatcaacaaaatgaaatttggaaatgggtaagaaaaataaaaaataattatacttatatgtatatttaataattatgaatagattcgacggatttttgctttgcgatttcttcgtaaagaagaatctacaaaattttggtcaaatttacaaatgtttcgtaaaaattatgaatgagttcttagggaagaaatgaattcttttttaaattatatgaataatgagtggattcaaaaaattgactaagggaatattttttct

SEQ ID NO: 34919 - DNA, 1167 bp, Heterodera glycines
tacggcatttcccacggcacagattaagtgctgcatgttccattacgggcaaagcctgttcagaaatttcaagcggcttggtcttgtgcatttgtacggtgagaagacagaacgtggggaggcagttcgcaacacgttccggttaaaaaaaattttggtgaaattcgaattatttttcagaagtgttctttctttgccacttttgcctcccagcgttgtcagaatggctttctcaattattgtggcgtctgctccttcaggaatgcatgagtttttcctttacttctctcgaacatacatcggcttgacacagcgccagttgttggatggtgctaatgcatttggggccactcaaatcagttttttgtccagcaccgaccattgtttgttttcgtatttttgcatcgattttcaaagtttaattatttttaagctgaactagtgacaacaatttcgaccatcaactcagaacacagctacgcggctactccaatacaattcggcatcggctcaccggcgccatcaactcttacatggccaaccactgtgactccacaagaaaagcttgttcaatattcgttgagctcgctatcgacttcaacagcctcttcaggcatatattttttcacaaaactcgttgttttcacgaatctttcgtttatatttaataaaaaatttagttcccgtgtgggaggaagatatctgtcaggcgccccatttcccaattgcaatttggaacatgcactcgcaggccgcatctgctctcgctcgtacaaacaatggactggaggcaactcatctgcattttatgggttttatttactacgggcaaatttttaaaaatatatttagaaaggtctctgtcaccacccggcactctctgacttcatctgtggagtcaatgaaaacatcgacagacaggtggacgctgcccgatctgctcgtcatttcattcacaagagacacaaacgatacatcctccaggatgctgtcattatgcgaattttggcggacgcgtcgtacaacaacaacggtgacatccatgatctgatgacggcgctcggtctacaaattgaaggatatgcagcaaaattgaaagatttcgtgaattttgatgattcgattgttcgtattccgtgatgaattttttattgaatgtttaataaa

SEQ ID NO: 34920 - DNA, 1102 bp, Heterodera glycines
tctgcaggatcctgcgcaggattgcggattttaggaaatttcaaaaaattctgtattaataaaaaagtctttcaaagtatagcaaagtattcaaatatatttttaaaccaaaaaatgatgaagatgaaaaattaataacgtttttttgcttacactccaagcaatcgactgaatcttctttaatgcgtttaaaaagaccgatttgccaaattgggtggctcataataatagcttaaattagggttcgagccccgtggggcgggggtggcttttcacgggggcgggggatgcgggggtcagagtcacgggggcgggggcgggggcacgaaaatttcgcccccgcggggacgggggcgggggtttgctttgaattaggtccaaaaatctcacaaaaaatattttttaagaatgatttctttggctccacattcctttatttgttgatcgcctcgatactatttcttttgacataaattgcacagagttcgactaaaaagtaaccaaaatttagggatttttgggtaattttttttaagaaaaaaaaatgtttttttgggggggggggcgtgccgataggggcgaattttaaatttatttctaacagatattcaccaaaaaaattaagactttttcgataaattttcgttttttaactatattaaattatcgtgatttactcaaaattggaactcagattttttaatttttttttttttgcggcacatttttcaaaaaaaacttgatgaatgtgcgaggggagagttccggcggtgccgataggcgccgccgggaaaattttttgaaaatttgaatgcaatttgttaacaaattttgtacaaaaaatgagcaaaattcgcgagcttgggataatttttaagaaaaaattataggaattttagggggccggcgggtgccgataagcgccaccgggggaaaattttaagaatttatagaaattttgttaaaaattagcccaatttttccaaaaattttcctcttttaaaagaaaaaaagggattaacccccaatcaaaacattttctaaaaaaaaagaacataaagaaaaccctggatttaatcacaaaaaaaaaaatttaaggaaa

SEQ ID NO: 34921 - DNA, 1689 bp, Heterodera glycines
  misc_feature (1574)..(1574): n is a, c, g, or t
agaatcgaatccccattctcagagtcaacccctaattcttttacttttaagtcaggagctgcagcttctcgaaagaatggcaccaaattatccatacgaaatgtgttagttaaaatttgcgttagagaccatctgaaatagaaactaggtaatcctatgttaatcaaaagtaatcttgtgttaattaaaaattgtttctaaaattaaaaaaaaaatttgaaataaaacagtaaattaaatgccaatggcataatttaaaattaaaaactaaaattttttttaataaaaatattttctcggaaattaaaatcccctcgattatgcttcgtaataataatcctaaaaatgttaacaacgcgaaacctcagcaaacccttcatcttaataagaatgttgaatcacggagcactgttattgaagcactttccatgattgaagttgaggaccggcggcttcctttgctgcaatacgaacaggaaatgatgatcgacactttcatcgacgacgttctttttattacagcaaagtaactttaaaaatgtaattaaaaaaattttatatatttcaaatgaaaaatatttttcagaggattgggcttagagcggatcttcttcaatcacctccatttgtacagtgtcccaagttttacagtgctcgtcttaaacacaaccccagacgatgaagtgctttttagataatcatttaattattctttctaagccccatggaatatgattctaattttcgaggaattcttcgttggactataacttacaatttatagcatttttacttggaacgcctgcgcagattgaacccgggctgtcctcctaaattaatcactgctgatgttccttcacgcaaccggtgttctgttgggggcgcacccctttttcaagttatgaagtccatattattcacagtactctcatttaccgttctggcggtgttcaattcgtcacttctcgcattttaatggttgatttactaacggacaaagtgcctttcgattgcgttattggcatcctcgtctttagggcacacgagtaatttatcattttacgaatttatttttaacaagcagcgcaatttgtttcaggttgctttttggttttcaggaatcatttattctgagattattccgagagaaaaggccccatggctttgtcaaagtgaatactcttttattctttttaaatttgacattttatttttaatgatatcacccatttgtgaaggcattcaccgacagttgtgtacaaattaccagtgatggactcggccaattgcaacggcttgtgaatctgctatatctaaagagggtcgttgtccttccacgtttttatgcaccagtcaaagagtgtttagacgtcgatcaggcaaaaaaaaagcaaaaaataattagttcccaaattgaaatataaaaatttcagcaaaagtttgtgcaaacggtaattcaactaaacaacactcaacgcaaagtgcaggccaatctccgcgacatcatcggaacttgcgtcagggagttgaagcagtgcacaaagggcgtggatgtgggaggaattttccattanataatggccaattggtccattcagactgagacagaatccgaatattggcaccgtctgcccacttgaggccaccaaactcgagttggacttgcgtcgtcgagacgccgttctaacg

SEQ ID NO: 34922 - DNA, 950 bp, Heterodera glycines
  misc_feature (897)..(897): n is a, c, g, or t
attttaccgaattttcaaaatgccacggagtgactgcttttctgctgaccaattaattaattaatttgtccgtcgctcgtgtgccaaaatgctgaaaatgacgcccaagggcagcgtgggcagcttcgtcgttggccgatccaacatcgatttggagacgaacaccaacaacaactacagctacagcaacagtgccaatctgtcgacgacggcgattggcaacggaaaaatgtcgcagggaatggcggaggagggggaggagcaggcgaatgcccaactcagcaacagggaggagttccatcttcacaacctgctcgaaaatgtggaccaaatggtgagggggaagggagcacccaattaaattaaaaaaagttaattcaattaaataattaaaaaataatatcctcagggcactgagcatgactcttcttggcgcaaatacgctcgccttgttcttcctcacattggccttgtcatgtaagtgtgactaccttctacttttctaatgactttgcttactctcgctctctcttttttctctttttctcattctctctctctctctctctctttctcttttttctctttttctcattctctctctctctctctttctcttttttctccttttctcattctctctctctctcgctctctgataattacatatttaatccattccatttttgtaatatgaatattaatttaattttaagccccaatgttaattacctacagtttcgtgtgcctatacgccatgttcggtgcctgggtgttctacagtattgaatcgccgcatgaagaccgtgtaagaaagttgattgaaaatttgaattttggcattccgtccctctttcgcaccaatttgaatgcctttccattcagctaaaaatgatncgcattcaaagggtttacccaatgcgacagtctctgatcaatgtactgatcag

SEQ ID NO: 34923 - DNA, 942 bp, Heterodera glycines
agactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggtgctggtacgtgtcgcacgcgaccgccaccgacccccagctcgagtcaacacggacccgaaacattgcacattcacccagagtaacagcactcccccgatccgggtac

SEQ ID NO: 34924 - DNA, 920 bp, Heterodera glycines
  misc_feature (26)..(26): n is a, c, g, or t
tgtgctaaatccataaaatgccgaanatatgtgcgaaaatatgtgttctaataaccgattgagcatattaaatgcaatatttgcggggccttgctcaaattttcatgcccagacccggatgaacacaaatttcattgaaacttactccattaaaaaatgaaaattaacaatttaacatcccaactctgctgatttatcagcattttgctgcttatgcttatcaagaggtcattgctgatttttttataaaatttactggtttaaaatcagcctagtccacccccaaaattctgtttaatttttaaaatttgacaaaaaaattgccaatattcagtgaaaatccgatgaaatggcaaaaaattctaattttcccccagcgtcacctaacgacgccgcctgcccccctaaaatttttttttctgataactggctcaaaatcgtaaaaattggactttttggtgaaatctgttgataagacaatttttattattgcaaaaaccacgactgtcatgtttatacttgaaaaaacggaaattttgttaaattttttgataaataaaattttattataatttaataatcgaaaagaatttaaatttacaatatgtgtttatgaataaacattcaaggctaacaaatgatttagagcaaaataattttactatgatgatgaattctgctatatttgtttaaatgaaaattaaaataacaaatcatatttaaagcaatctttattatcatattttggatgttgtccttaattctttataaaaataatataaaaaataatactccaaagtagtaaaaacaaaaataaatgaaatatttataacttgacaaaaggaaaaactaatcatagaaataaaaattttgaaataaaaaaacgaaaaataacataaaattttcacaacaaactttaa

SEQ ID NO: 34925 - DNA, 1347 bp, Heterodera glycines
agtgattttttgacttacgaaggtccggagttctttttgacggccctttttcggcggcttgggtcgatgtaccctctccgtctgctgttgtctcggcttcggtctgctttagcgctgaaaaatgcagtgttttaaaataaaattaaatttgttcaattttcgtcactttttggtgttgatccagctttttttgcatgctcccggcgccattccttccgctttcgtcttgcttcagtcccagaattgcttagcttcataaattttccagttttattacgtgtagataccatttttatgctaaaaatgttgcaaataaatttgattttgttgtccttgaaaaaaaaattttcctattgaccaattttcttaaaattttgcataggcccatattttgaccccctctatcgaatccctgtttattttttcgaagttatgtttttaactcgagatcggctcttccatttttacaagggaaaatccccggaaaattttaagttttgcaaagttttggcgttctgattactaaataaataataaacttatttgtacttggagcccaaaattgggccgctgtgtacaaaagagcctaatatttcgcgatttatttccatattttggcatttttatccatattttatgtccttatttttttcgataaatttcaattcttaaaattgataaatttatgtcaaaaataagcaaaaaaacgaaaatttcgcttttcgggttgatttttcggtaaaaattttgagaaagtatacccttaattttgaaaaatttatatccatattttgacgtttttgccatttatgtccatagtttgagcttttaccattttatgtccatatttcgcgatttttagtccatattattttatagccatatttcgcgattttatatccatatttttatcatccctactaatagttagtcaaataaaaattacggtaatagtgccgatggtagccagatccacttttccagttttttttttctagagataatgtcattttaggggttttcagggtcggagaatccgattctgatatccatttcaacccaattccgaattccagacctgatttcgaaccaaaagtcgaaaacaaattttcacatttttttaaatctaaaaatggtccaaggtttttttactgaaattttggtgatttttattttatttgcacacatttaaaccattttagaccaaaaatgagaaactcgaaaaattttagttttcgactttttgttctacatatatcgggcccgaggttcgaaattggctcgaaatggatatcagaattggattctctgactataaaatgacattatctcgagaaaaattttttt

SEQ ID NO: 34926 - DNA, 701 bp, Heterodera glycines
gatgtctcggtcttgagaaattcaagataaatccttctaaaaagcatggggggcatccaggaaaatttatgatgaagctgatgacaaaaaaacaatcattggccattacaatttgccaaaaatggcgctaatttaaaatggaaacaaatgcgtaaaatgtgtgctaattgcacatttgtttcccggctttagcgccatggtgaaatttatacaaaaaaaaacaggttggccaattggtcattgaacaaatttttgttgtttgattttaggcggggaaaaaattttatttatggaaatttgtaatcccaaaaaattatggcttttaaaattttctaaaatgcagagggtgagtcagggccaaaaatgccgcaatgtcctccagggatgtgtgccgacgccctccaattcgacagtctgaaattggaattcagacggaccaaaaaagttcaaaaatcggaaatcggcatgccgacacatctctggtgtgcacatttattaattggtaagattgggttttaattttgaaagatttttacggtttgtttggtaaacaataccagggtcaatggcaactcgtacaacaaaaaaaaaatctaagaattttcaactaaaacttagaattttcagataaaaaaaatctaaatggattttttagcctagaaagactttaaaaaaaattctctatagtcttttaccaattt

SEQ ID NO: 34927 - DNA, 1252 bp, Heterodera glycines
ggtagttattaaataaaaacaccgttggaaattattaaattgaatatttatttaatttgaaaataaattatttttttttccaaattcaaaaaaaaataatgaaattctttaagttaaaaaaaataaatttaaataatttaaaagaaatcttcaaattaattaaaaacagtcaaaataacccaaaaatgcacagaaaaataatgttacaccgtccggattcgaactttgcaccccccccccccaaaaatgatgcctcagaatccccaatcacacagggattctgaggtcttgactatgtcaaaagttaaatctgatcacgtattcgtgatcagcgtcataaaatagccctaatgacatgtttttggaagatttttgacgaaaaaatttttccactcaaaaatcctggtcacccccctttggtcccgaatctcaaaatcacttttatttttataaaaattcttaaaaagtgataaaaatgccaaataaaatttatataatagagcaaaaaactgcggatttttgtagtattttatttttccagaatatcttttcagaaccgagttatgaatttttttctgaaaattcgaatttttccagaaattctggaataacttttttccttttttagatagaaattccaaataaagtccataaaattctcctgatttttctctatttttaaggctttattcctgtaaaattgatcaacccttcgatttgttatgaattttcaaatattaggccaaaatcccgagggccaaaaaattgccaaaaattatcgaatttgtaaaaaattccaaaaattatgaaacttaaaatagacatcatattcgtactcaggaccttattttaccccagaaaaatatttttcacccccattttcgtccgaaaaaaaatttccgaaaatttctagggggcctagctcgaaaatttttgaaaattttacatcatgtagtacaccattcaatagcatttaaaatgctaagcgcttcgcgctttcggagcttcgctacctacactgtgaagcgattcaaattgatcgaattggttggagatttttttttgaatttttaataaattattatgggtttttagtccacatcgaggctcaagacgggcgacttaaaacaaataaataataattcatttcgccaccgaaattatttcttattacaacgaattccctgccgatgatcagagctttgcttgctttgccccattactgtaacattagatcacacattttgggcca

SEQ ID NO: 34928 - DNA, 939 bp, Heterodera glycines
actgtttcccattccgtcaaatcagctgaccaagacacagagaattgaacgattatacatcaaatgtaaccattacgctgatcgtatgggcgttcggggaaatacaattaataccgcaaacggcaacccgttggcgcacagcaatttgcgaatggccatcaagtatataatagacagaagagcgggccgtcccaccattaaaccaccaggagcgaacctattggaagagcggcttaggcaggacccaattttgtattcatggacggccccaccaaagagaccgtcacagagcaaaaccacccggacggaacggacaatcaagaaggaatttcgcccgaaaaaatggagctgatcaacaacacacttgacaagctgtacaacgacccatcctccccagcggcgttcgctggagttactgcactgtggaaggaggcgcgaaaaaagttaaaacatttacgtaaaagggacgtggagcattatttggaggggcatcgcacgtacactctgatgcgcccccgaagagtgcgctttccaagggccaaaactgttgcagctggcttcatgacagacgtccaagtggatttggccgattttcaggcgctttcgcgccacaatcggggtcaccgctacctgcttgtggcggttgatgtgctctccaaacgactatttgttgttccactaaaaaataagagagccgatgagatgctggaggcatttaagcaacttatcgacaaaatgcccatggtcccccatcgcatcttttccgacaaaggaaccgaattcaaaaacagattgctgaaggaattcttcgaggagcaggagattgcgaagcacgagcccgtccattcatcagtcaaagcgtcggttgctgagcgggccatccgtaatggaagcagaaacggtaccgatatttcgcggaaaaggagacactgaattggg

SEQ ID NO: 34929 - DNA, 1273 bp, Heterodera glycines
  misc_feature (55)..(55): n is a, c, g, or t
  misc_feature (89)..(89): n is a, c, g, or t
aaaaatttgataaatcatcccaaaaaattgtaaaaatgaggtattttttaactanaattgaaaaaagcaaaaaaattgcccgtttttgngaattgagttttaagaaattggaaaacttcgataattaaattcctttttttttggtgtattaatagcaaactaacaatgaaatttgaaaattgatcaaaaatcggacagtcccccgccttttccccccttaccaacctcaacattcataatcaaattgccgtccatttcgaccaacaaatttggtgcgcccgcattcgccacacacgcagcctttcgctggacagtgaaggagggcaaaatgagacggagcctgtgccagggaaaaaatatacgaaaaattcaaaaataaataaaaatctcaatttcataaagttagccttgcctttttcaattttgtttttctcacaaaaaatgatatcaatttgaaaagcaccaatcccattcaagataaaatttgaaacaaattgcaacaaaaattgaaacagttagggagtgtgggacatcctaaaagaatgtactattttttcaagtattttaaattttttacaatttttttagcaaaaaaatatttttctatgtaaaacagtaaaaaaaggctggtaagaattttccgttttctatgtattttttccttaaatcttttggtctgctcacaaatgatgacgtggcagtcggaaggacagttcaacggcatgttcactgtgcacactgaacaggaaagtcgttgttgtcctcgttggtgtttgagttgctgttggtgttccgttgttgttgtccccgtcggttgttgtcgcaggagacggcttttgctggcgatgtttgaaagagtcgaaaaagttgaccaattgggacactttggagacgaacgctctgtaaaaaaattctgtcaattagcatttttcaatcccttttaaataaggaaatttttgaaaatccgggcaatttacaaataaatttaataaaaaattatatttcccaggatggcaccatacataaaaaaggggggtgggtcggaaaaattttttgcgaagtggggtcggccgcccaatgacttttttttttgcttttcaaaaaccgtttttttcggcgcgcttttttcataaaaatttcgggaacagggggtccggcggtgccgataggcgccgccgggaaaatttttgaaattttgtagtgatttgttaacagattttgcctaaaaaaacaccaaattttgagattttaagccaattgttgttaagaaaaa

SEQ ID NO: 34930 - DNA, 926 bp, Heterodera glycines
  misc_feature (6)..(7): n is a, c, g, or t
ctctanngagtcttttcaatgtgtcctgttgtggggtactcaaacaattatgcctgagcaaaaatccaacgcagaattaaagtacagactatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcataattaaagtacatactatagggaagctaggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtctgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacatactatagggaagctattccggaaggattcggtctccccataaatctgggcgcatcggttcggggggactgcccccgaaaacaaaaaaatcgattttttaagtgtgcgtttggggtactcaaacaattatggggagcaaaaatccaacgcagaattaaagtacaggctataggggaattatttcccgaaggaatcggtctccccataaatctggggggcatcgggttgggggg

SEQ ID NO: 34931 - DNA, 1475 bp, Heterodera glycines
ataataccgccaaacgcatcatctgcaatcgcaatgccattctgtccttctaccatttcatccacaaattcaaatcgaacacaggtcaactccctgttacagtaagaaaatcaataaaaaaattttttttttttgctttttttaaaaaaatgaaaattttaaaattaacattctgtcgtcccctttattctagtactttttgtcccttttttaatgagccttcggatttgcgcttccccataactcccggctttccatttacggatttacggcttccatccgcccccccccatttttttgtatcaaaaactcggctgaaactatgacaatcgttccgaaaatcaactaaacctaaaaagatcattctcacattatcaaagcggcaccactttctatcgcatccttccattgttggtacccgtcctttggcactaaacaattaattatgtatttttttacaaattggcattatcccagcagtggtcataactttctggcactttaaaacatttgttcagctaattaaaaattattacgagctgatttgttgaatgcgattttgatcggggattcggtccatttctcttttggttggtattgtcgttttagccgctgacttgccactttttcgggcttaagcccacatactgaattttaatttcgattttatttttatttatttaaatttccaaatttaactcactttccctcaatctgttgtactgttctcgcagcctttgtttgtcacaaagcatatcccctccacatagcattgtttcggatggctttttccatggcatttctggcggaagtggggcccagtctggctttttgaaagcctgaaattatttttaaataatattttttaaatattttttctattttttaccgcattgttttcgctttccttctttccacagtttgccaatgcctcaattttcaacaacaaatttttgatcggcacacaatctgcgccgtagtaatcacagggtgttgctctctctaaaaacatgccaaaattaaatatttaaaaatatttttttcttcctgacttgtattgttcgggtcattttggtagggcaacaattttgtacggttggttatgaattttgaaaatttgggcctttcaatttggaaaaatgcgaacattttggtatctttcgatggcggcacaaaatgaattatttttgccaaagtgccgttggcgttttccggctcaatgtcattgagtatggtgccaatgccattgctctgtaaaaaatgattatttatatattattaatttatgctttttttttgaccgttttgaattcttcacaaatgcttttttcgtcgcccttttctcggattgcgcttttccactggtcagtgccaaattcgattaagaatgttggcatccaatatgttatgtctgttattttctccaacgaaattggaaatgttcgcgtccgtttgcaacttaatgtttttaattt

SEQ ID NO: 34932 - DNA, 1313 bp, Heterodera glycines
tcagctttgcccgttcgcaaattaacgatgaaatcttttaacgaatcgtaaaaaaattttttcttgtttcagattgttcaaaaattttttcggcttcgtccaactgatcatttctgaaacaaactttgaaattgagttgaaattaaactgaaaaaagcgttaaaacgaaacgttaacattgaagaacattcgttcagtgattggcggactttgcgcaattgccattcataatcattcacactttgtgcatgcccacacaaccactcaaactgacgttcatcttctgaccattgggatataatactttttgatgatcaaattaaaatagatcaccgagcatatgagttgggatagggttgttgagagttttgtcggtaataaaggaaagtgtgatcaacgaaaaactgatcggagtcgggtgtcttgtgccttttgcagtcgcgcatttatcggcaaaagagttaagcccgttgataaaactcttaacgaaattcgattaaaacgtgttaaaataaagacaaatcgccttaaacgaaccaaatcagtcgcgcaatttccaatggaaggatcaacaaaaacactgcacgaaatgatttattcaaatgaatgatggatgatttatccgaagcattcagtccatgaccatgcagaaacttgcgggcaatcttgaacaaattttcagatttttgagttttagtgcctttttccacagacccttttcgcatttgaaatgtcggatttatcgatggcactgcgctcattaaaagtcataatcgctaagataattgacccatagcatacggacacggcaaaatgtgtggcattttccacaggcaattgctgcaaaatgaaatcacgcactttggggtggttcagcttcagtgaaaatgtctgcaaaattaattattcaatacagtaaaaaagtgccacccttttcaaccatttttggcacaattttaatgaagccaaatgagtttctatgttcggattgagctgccgcttcctgcagaaactgaccaaggggactaacatcttcaagatgcgcaagttggctgatcacactcaactacaaaaattcaaaaaaatatgtttcggattgtattatcaaaaactttctgatcaatgcccaacattttggtgcgctctttcaaatcggcaaaactttcaatttcaatgatttcttcacgcaaatttggcctgccttgcacagtaaaatttatttatttttcatcattttgttcacaaatccatgatcattcagtgacgaaattgtccgccaaagcatcgtaaagattggcgagaggcgccttcac

SEQ ID NO: 34933 - DNA, 1315 bp, Heterodera glycines
  misc_feature (26)..(26): n is a, c, g, or t
  misc_feature (1281)..(1282): n is a, c, g, or t
caaacgaacgaagcgacagatcgtgnaaaaatttccaacggatgggcggcggcgccaattggaggcctatccaggacgtcaaaatcacttggatttcactacgccaaatgtgcttccagccgctatacagcccggacgaattcaaagacattgaagaacaggtcagagaaagagagggcggaagagagcgcagaaacagagaaagaagggagagagagtaaaaggaagagagagactggggataacgaaagagaggaagagagaatggaaagaggggaagagagagagagatatgtgaatagagggaggaagataaagcagtaattagagaggcgaagaggaatgaaaagggatggaaaggggatttagagagaatggagagaaagagattaagagagggtggaaagataatgaaaaggaaggggaaaattgccatttttcttgaggatcaattcttcaaaatgcttatcgttcacggaaaagaatacgagtcgttggactgcatgagcatcgacttccacggtcggcccggggaggaggcgcgctatttggggccgaagggacggacgaacgatggcacggacggagacgtacggacgaggggggcaattgaatttgggttaaaattctgttttttcagctctgtctgtccgaatcacacgaaattgtcgcggaagtgaaagaaatacagactttgctgccgggcgcggaagaagcggaagaaaaatgcatggaatacggaggggaggagcagttcgggacggagttggagtgccatggccaatgccgacttggcctaattcgggtcggctaaatgccatttttggttggctgatcagagaactccctccaattttgcaatttaaaatttcaaaaatggactttttgatcaaaaaccatcatccgttagcaaattgaaaaattttgtgaatgtttcagaaaatttgcaaatgcaccgctcgcactttggaaagcctcgccgattcggaaactctacagaattttcccctttgtgactatgcgaaatgcaatttgaagttaaatggaaaaaaacaattaaaaagggtaattagtgaaattaagtgccaccgaagaagcattggaaaattgggaagcgacgctgaaaaattgcacgacggagtgtctgccgaattgtagccaaaccagattcagaataagcaaaaagacgaaaagcgcacagagagacggtgagaaaggaaaagcgaagggcaagaaagggaaatgaggaaaagcatttcagacagcacagaaagtgaagcnntgtctgggctcgttcgagtatttgcgactgatc

SEQ ID NO: 34934 - DNA, 1096 bp, Heterodera glycines
  misc_feature (1060)..(1060): n is a, c, g, or t
tcaacaagcaaaattcaaacgaagttggcacaaaaccatgcaaacgaatattttcattgaattcggatttttcctttttttttggccttccatttatttatggcaaataattctttggtcaaattttgctccattgatcgcattggaaattgaaggtcgacacaatcagtcgaccacccctttcaatttatcatttgctgacaaaaggcgaagtttcactttggtgtgttctttgctcctcactaaagtcaaatttcgcttaaccttttgtcattattcgataggtcaatcactgtttcggtgattgtttcttttttgaaattgcattttccctttgccaattcagcccgtccatgtcagtccctcccttcgccattcgctttcctccataatgcgagtcaccagcaaacggcgcttccccgagtttctgacgttcaaattcggctacgaattgcccacgggcgaatcgcacataaaccgcgtgcattatttcattctgccaagggcgggggaatgtgccaaggccgtgaagttggccattatcgcgctgaaaccgctggcaacggacggcgaagagacactgagcgaatcgtaagggaaacggagagagcgacagagagagaaacagacgaccaattaaaaaacaaatgaatgaatgaaataatgcaatggaaaagaagcaatgaccgaccgaccgcaactgctgactgatccccccccccacacctttttgctgctgttctttcatctccgcgcaatagtcacacaaatcaaatcactaacaaatcgctgggttatttctgcaattttctttatcagacgaacaaaatgaactgaatagcctttcaattagccttaatcccatttttacatctgtgtaataaacaatttattattatatacatatttttatttgtattccgctgattgtttattggccgattctctcaaattttgctgtttcactttaattctcgcagaggtgcaacattccgctgaaatgtcatttttgttaacttatttagcctaattcatttattttgtggacccaaattctctnaatttaattacgtatagttttgttattagtgttgat

SEQ ID NO: 34935 - DNA, 996 bp, Heterodera glycines
cgtgtggatttttgcgcagcatttattccgccggatgggccttcgccgggggggatttgagttgagttgcgttttgtttgttgtttgagttggtgggctcatcaacaaatgcatttgggggagtgaccaatgggagggaagaaaatgcaaatgaaatccgatccgtccgtccgatcttttggacatggcaccccccgcggggcagtgaccgtccgttggatggaagcgccgctctcactctcagttggtggcagggtggaggtcgtccgtcactgacgggtcgaagtgagccaaaaagtgagtgagtgaatgaatggatccccccggggcggggggggggccgcgactcggtcagccaaatgcccccgcccttccccccgcccctcgggggacatcttgtccgacggtcccgcccactctcggcaagtcgtttccccgccccaccgcatcggctgagtcggatcgggacacttcagtgccacaaattaacgggagcaaacgtatatatagaacgtagacaaaaaaagtataatttatttattaattaaatttgttcgaaatgaaacattttcgctgcggcgctgactcagccggtgctgagttggtatttcctccctcccaaaaattacccttctctccccgcctctttttctccttatttccttccgtccctctgccgaggtcactctttcgtcagcccatccgtcagcactaatgaaggggattggaattggaagtgatgtgtatgtgtggatggacgaagaaaataatgggcaaaggacagcagcagagaggggaaaagcatctgctggccccgagagtgagtcgagagtggccaaatgagccaattttattgctaaggcaaacaaacaaagggaaaaaaacatttgcagtcgcgcaattatcgcaaaaagggcataatcttagaacacaaaacgggacatcactaaatgatagtgttgagcaataggtcatttttatttgagatttagcttt

SEQ ID NO: 34936 - DNA, 630 bp, Heterodera glycines
ttttcaaaacctggagctcagattcgtgatcagcacattttttaagcctagaaaaagtatccgacaaattttaacattttttttcgtcgggacaccaattattaatgattgctccctttttgatgggtttttttataacgactagagctcggcatggacctggatccaggcctggatttttcctgaacctgtattttcctggatttttgtccaggaaatccaggtcgaacatggaatccaagtccaggtccaggcttttttcaaaataccgagctctaataacgacatagcaccggggtgggttagttctgaaaatattaagattctgaaagtgagaagacgaaatgatgacggaaaaaaatttaacgaatttttttccgaaaaaggggtgttaatttaaaatagacgcactttttcagaaggctgtaactttttgagttgagcattaaaaaatctgaaaaaattcatttaagcttagttttttgtactgatcgaaaaagtaatttgcaacaaattgatcagatcactccttcatagtgatctgaaaatcctaaaatggcttgaaaccgcgaaattttcacaaaaaaaaaccctaggggggtggaaaaaatttttcgtgaaaaaccatta

SEQ ID NO: 34937 - DNA, 709 bp, Heterodera glycines
agtactaggcttttctctgcacagtggggcgtacccaccttgagtgggaaaaggtagacaggcagagacatacactgacattggtgtccctccggggcagaaaagcaaacgaaatcgaccgaccatttactgctgatgctggacgagccaacaaactctttcgtttgaattaccggccgagccatccttcctttgccaagggtgcgtaattaacaaattaatgagccgaaaattggccccctgctaataattgtccatcccacccttccttcggccgcaatggcccccaaattccttccgcccgaacttctgttcgaaatcgtggcgtttatgcctgcaagaggtgccgtgccgaatgcttttacctcctgctggttgcttcactcacttttgctccaacgagtcaccaaatggaagcaggtacagcacgatagtgttgctcaagatcgaaattgactttcgagcagcactaataaatatgtcgtgccgtttttgactgttgtgtatttgcacgcgttcaagaaatctttaaaatttgcaggatcccgcgtggggttgcgggatggaaatttcgaaaaaaaataaattaaaaaaatctccagaaaactaaacaacctaaattcgatagccctaacaaaggagaggtacccaactgctaatcatgaatccgaaggaatttttggataaaaatgaaaaaggtatgtcatca

SEQ ID NO: 34938 - DNA, 762 bp, Heterodera glycines
ttgtctctgttgtatctatcttttgctcagggtttgtcgtagttaccgttgtattttcctctggttgggtttctacttcgggatgtgtttctatttcagcatgtgtttctgctgttgtctctgtcttttcctcaggatgtgtttctgtttctggatgtgtttcggcagttgtctctgtcttttcttccgcttctgtattcgttttggtaattccttgcccaactttcgttatctccaagcccactccaacaaatggctcctcagtttcgtttccgtctgtcacaccttatttatttttatttttttgtgttttttgtattcccttgttgtgttttaccctgtgttttggcccttgttgtcttttccccctcttcctctttacatttcccgctcttttcgcctcctccttcgccctgcttctgctgctgctccttcgtcttcgtcctgttgttctcctccaactgctccaacccctcgccaaccaatgtctccaattccgtcgtcggttcccctgctgcctttgccccctccgttttggcaatttcttccaaaatcaatggcactgattggtccaattccctgtccaactctttctccaattccgtttcactcaaatgagttgcgttagtcgcggcgaatgctttgaccaatgcctgaaaattcattctcccgatcagtgccaaaaaatcgaattgcttttctcacaatttcgcccggtgacgcgcgcggattgaccgacgcttcaaagaggaaagtgcgctg

SEQ ID NO: 34939 - DNA, 1268 bp, Heterodera glycines
ttagcaagggattcattcacctccacaatttgaccggccattgagggaaaatttaccggcaatttgaaattgtagccaaatgctctagtccggtaaatgcgcgtgcatttcgaattaattccgatgttgacaccattccgactttaccgcacattttctgtcctcttcaattagagtcaaattatgaatttttcaataaaaggtcgcacagaattggaaaaaatatatttacttttgtggacccggattcggggcccatacacaaatggcgcagatccgcttgaaaagcgaaaattattcgtcaacattgttggccatttactagcctcctgaaataatctagaacattgtatttgtaattctacgcgacctttcttgatttaaaaaaaaattccaaatttgggcctatacgcaaaaatactcatgtttaaatacatacacaaaaatgctatattgatattagaagcagctaataaaggggcaattaaatttcatagctccactaaaattaaaaattttttaattcaaatatttttcagataataattgcattcatcctcttcaaattcattaatagtttcaaccaatatttttcaaataaaatccatatccatcgccagcccgttcttccgaatttctggcacattctttggatttatggcacacattttcaacagcaaacagcagcaacagttggcatgcgcccatgggcgccgcgcattttctcgtcatcaaatcggctgcgcacagagcggcgccggcggcgatggcaccggcggagggggcgggggacagagcgccagaagggggcaacaaaacaaaaacggcactacaatcaatcgtgccaataataatcattcatttttcgggtcaccgccggacgcggacggaccaccatcatcatcattttcctacatattgttgtgccttctgtctaaaaaaaaattcaagattggaactttgttatcaaaaatttccggaaatcgggacctagccaggctccatgatttttgaatttaaatttcgaaaatattttagaccgtttttttagaatgtgttcccgtctcataagtccatccgtgccgatcttcaaaaaatttgattcccaagcctgacaatctcgacatttgttttatccttctctttatatttttttctctctctctcacttctccctctctctctcccgctctcttcctctcttctccctctctctctcctctctgtatcacttcctctctctctctctctctcatttatctctctct

SEQ ID NO: 34940 - DNA, 1274 bp, Heterodera glycines
  misc_feature (100)..(100): n is a, c, g, or t
  misc_feature (139)..(139): n is a, c, g, or t
  misc_feature (231)..(231): n is a, c, g, or t
gattttgacgccatttttcgtacaatatgtttcccgatgtttggtgttgttactggtataaatccatttctcaatccctagctctaaccctatcaattcncaacttatacccaaattcgagaaaggttcaaaccccacnggttttcgagtcgattatgtattttcacatcattcaaacacttttttaggtcgaattgcgttctttgattcctcggaatgacaaccataccngaagtcattgttagggcacgagaataccaagggcgtggtctgttgagcgcactcgacttttacaacgaactgtttcaaaaaactaatgaactcaaacagcaattaaattgtgaaagggttgtgccactcgttgaaattgacaaagcggaattggacaattatctgcgaaaaccgccagcgggattcgttgggtttgaggagctctggacccaagctgtgctggaaaaccccgacccggagaatttggtgccctatccaatccagggatttgaacaattgttgcagcgaaaaaagatgcaattggcaacggtttcttcgctccatcagggaattggttggaattactatattttttctttttaccttttattcttttattagacaattgcgtttctcgaattgctacgaaccaaagcttagtgctttctgcccacaataaatatattcaaataatgcaagcgcaaaaacaattttctaatcggttgtacccccaaacactaaaaataaaacaaataattttgcagtttattgcgcattttggcttcacaaacactttctcaacgctttgggatgattgttgacgaaaaagaagaacaattattttgccgcttagaaggaatgaatttaagagtgaacggacccgggcgcttaaaggtaatttttaatcaaaatttttttctcgtcctttatcccgagattaaattgaaatttcttcttgtcaaggatcaaataaacggaatttacgacactttgaggcaaaacgaagacaaatttcgggagacattcaaagaaaagtcgatgagtgcaggacaagccatttccgctgaagatatgaaagagcttaaacggtgtttggctacaagacaaaatttgctggagaatcttgtttcagctgttaaggtacagaattttgacaagtattttctagttgatgatgttgttaaggcgaatgctgaagtgttgcgagttgttgaacacaatcgtcagccgatgactccgatgaataatcgccgctaattctgtttttgcaatttttaaaataa

SEQ ID NO: 34941 - DNA, 895 bp, Heterodera glycines
tgttagtttaggcactctgatgctttttctatcaaaacagtgagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgtaggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggaacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagaattatggggagaccgaaatcctcccgaataacttccctatagcctgtactttaattctgcgttggattttttgctcccataattgtttgagtacccccaaacggacacttggaaaaaatccatttttt

SEQ ID NO: 34942 - DNA, 1057 bp, Heterodera glycines
gtgcgatctaaattatgagatttacataattgtgacttttttgcaacattaagtaaacaaaggctttttggcttttatagtcatagactcatgttgaggaccattagacccactaattacccttgccattccgctacagttacgcatcctccacagtaccattcgacttctggcgattccttccgccgcctccccttccgctttcacatcgtccatttcgcctcccgccgtctcatcggttctcttccgcaattcgtctgtccatcgttgggtcggttccccttttgcggtgccgtctttctcgaccattcggcactttctgatcgaagagtctcgcctcgacgattttgtccaaccagtagcgataccagcagaaggacatcagcaacaacaggaggaagggcccttttctcatttatctgtcgtcgattcctttcgaattgtccgctctcagatgggcggtgcccatctgagcgcaggcactgccgacagagtaccaacaccatttggcggcagcaaagttggaggagataaatgtaagtcaactcgacaaaaatcacttttagattggcacactggaaatggcagaatgccgactaaatcaagcgccgggagccgcctttttgaagggcgtggaagtgcgcgagcggctgattgtcaacggcacgcaatggccgtgcgggagggaccattgcggcacggaagggtcagtcatcaggggatggtaccaaaactgtgccgggtgcgtctttctatgggtcgctcgttttcaacaatcttcggcaccagcaggtccgccaaaaagccgtaaatgggattgttgaaatccctccgccgatgatttctctcgccctttccgttgttacccttcattttaggcttttggcataaccaattaaaaatgaatttatgctctccgatgatcagattgtttttggcgccaaactctcatcgcaatttgcactggcaattcacttccaaccggtgctttgacgggaattacagcgacactttgtcatcatcattaacatcatcatcatcttcattatcatcatca

SEQ ID NO: 34943 - DNA, 918 bp, Heterodera glycines
tttattcaaaaaaaataatttagtgtacaaattaattaaccttgaaagtacataaggctagctgacttttttactcatcaaagatattttaaatagatacattaatttttgttttaaaataataattaaaatatttttaataaagatacttcgttttcatttgcgagtcaccacatccgcaaattggaagccttcctcctgctgaccgttcttttcattttcggtaaaactcgttataacgaatttaaataaaattcattttttatgcaatatgtgattggatggttaaagaaaaacagaagtttaaatccgaaaaaccaaataataataaaaaaaattatattatatacttgatctatagtttattttattgtctttgttttttcatcatttttcatttataatttgttttttaaattatgatcagctgcttaaagacaaatatatttattattttatttaattaaataaattatacatccctcaatcagtcgctgacgatttttttgtgaaatttaaatactttgtcaaaaaatatttgttattgatctctgataaatattcgaaagtttttttattagattatggaagggagcaaacataatactatgtaagtttatttgtaaaatcatacattgaaaaaaaaattggccatttcttttgtcatcatatgagatcgccgggagatagccgtaatattaggattggaaaaatggatgaaccaacttagacaaataaacattcagacgtatacctagaaagtgccttttttgggaattcgccaccttttgccgcaattattgcaaacaagagggaatacagtactccatccgatgaaatgatcggacaaattgtatagttatgagtggttgcagagatgttttgagcacggctctccacttttttcgttcccataaa

SEQ ID NO: 34944 - DNA, 1653 bp, Heterodera glycines
  misc_feature (1494)..(1494): n is a, c, g, or t
  misc_feature (1536)..(1536): n is a, c, g, or t
  misc_feature (1574)..(1574): n is a, c, g, or t
  misc_feature (1587)..(1587): n is a, c, g, or t
cgtgcattcaagccaaggggagatcaaaaaaaaatagagaaaaactaaaatcgtagccctacagattattgtaaaaaaaaaaaaaattaattttttaatgaatttgatcgtatttagttttattaattttcttttcacctaatatcccctgttgatccaaccattcatcggtcgcaaatacatttggaattccttccatatgacctttgctcagtttacaaacgaataaataatcgggaaatttttggattgtcacttttatggcttcgatgacatacgaaaaatccgatttattggtgtccataactgtgccaaaactgacgaaaacaatgccatttctgtcgccaaaatttgcagttattttctaaagaatcacaaaataaaatacaattaaataaatattttgagctatttttactatgtattataaagaacatacaattattattaagtttgcttattaaatattcaaatgccaacctcgtctaattctcgtccattttgttttaattgaaatccaccaattaatttgatcttttcaatgccattaaaaatattgtaattgtcaaagtccacttggggctgggaatttacaagaaaaaaacgactttttctgaaaatttcatccaaaccggggaaagattggagcgcatagttttcttgtgctactttttggtactgaacatccttaaaaatattaaatgtgagtttaaaaaatatacaataaattattgaaattttatcaaaaatctaaaaatttaaaggtgaaaaaaggaccaaatagcattaaatttagaaacaatttcttgacctgtatatatgtatatttatatttttatattaattcatcgaaaaatggaaaatttatgaaacgaaacttttcaaaaaaatattaatttgacaaattttttatgaattttaattaatgtaatttgcactcgataggactttaaaacatgaaattctacaaattaggcagaaaataccattacctaacaaataatgtgcatagattttgtgaaaatttttagttttttagaattttccaaaaaatttgttttaccttttcaacgtgacccctaatttttctaacagttgcttccacataatttgtccagatttctgtttgtctttgctgtaattgtttgtcgagatggtcacctacaattgttccactacgtattgtaagttcacatcgcaaattataagggctcagatttttggggtctaaaaattgttaaaacagattaatccccaaaaattagcaaaaataaaatacgctaatttaaatggaaccaattctaataaaatttgcttaaatttattttttcatattttttcctgagctcccagtgcctacaacgcacaaaaaacaaaaaaagtttttttgtggttgttttaaggttgactttcgagttatttacaactattttatagttttttattaatattaacacctaaaagcctaaaaaaatttgaaacaattattttcanatatttcagtgttttgtccaaaatttgtgcaataaaaacganaaacacacacacctctaagaatcgagcaaaaattttcnaaaatgaaccctntaaaaatgaaaattttctaaaaatttcaaaaattatttattttgttttacagattttaaatttaaa

SEQ ID NO: 34945 - DNA, 820 bp, Heterodera glycines
  misc_feature (12)..(12): n is a, c, g, or t
aattttatttancatatttggggttttttgtacatattttgggatttttcttacatatttactgtatgtacatatttggaccactttttgtacatattttttgcagccctattaatgatcgatcattgatggaaaaggattaaaagttaaactgctatgtagtcatttgcagattcccaatggtaagagtaatgaattcgaagaaaaagatattttatttcaagcattttatttgtaaataatcagtagggttataacttataagttgtatgcactaaaaaatgccaaatatgcgcataaaatatgcattaaaaatcccccaaatatgccctaaaaacccgaaaaatgcccaaatatgcacccctttcttcatagcatatgcgcagaaaaaatatgcaaaatcatacaatttataaccctaataatcaggaaaaaggaatgcacttagtttgatacaacgaatttcaatgattctgatcataataattattccgatcgtccgctggccatctcatccaaaaaacgctgtgcaacattttccataggttccaacgtacgcggtgtatgcggcaatcgtccattttcatcaccttacataacggaaatttggatttatttgaacggaaatacaaattgttaagaccttattatctttatgtgaaactaaaaaaatcttgtcagctgtttaaatgtagattagacagtataatttccacttgtggttagacccgaatcatacctgtgcaagggggtcgtagggggggggggtctcagtcgatcgtaagggttcaggacagtcgatcgtacgaggtggaggggt

SEQ ID NO: 34946 - DNA, 593 bp, Heterodera glycines
ctgcaaaatttcgaaaaatttagttaaggttcaaaaaagttatggccagaagaattcaaaaaaccaaattttccaacttttttggctcgaactttttttgaacttgacgaagttttttggaattttgcaggctaatagagcatctaaagagctttcgaatgatatcaacaatattggatttggttggcaaagaaaaaagttatagtccaaaaacatgtgttcgtacgaaaacggcccgtacgaaaacggcctggccccaaaaacttcacatcacaaagaaaacattcatacacactaccatctgcgtttctatcacaagattattacgccaattttcaaaaaatttgcatattttgggactttgctatatttgattgtgttgaactttactttattttatatatattatgtgtttaactttgtagaatttatggattgttgcattttttatcaattttagagtctaaaaatgagaaatgtgaaaattttgaattttcgacctttcgaattcggattaggggtttgaaattggtcgaaatggatgtcagattcgtgatcagagaccccaaaaacccccggaaacttgtttttta

SEQ ID NO: 34947 - DNA, 571 bp, Heterodera glycines
  misc_feature (460)..(460): n is a, c, g, or t
  misc_feature (510)..(510): n is a, c, g, or t
  misc_feature (524)..(524): n is a, c, g, or t
  misc_feature (547)..(548): n is a, c, g, or t
ttaccctcctcctctctcttcgcgcccaattccatcggaccgtttttaagcgagaatttccgcttcgttttctgcagcgtttggcgccgttgtgccgtttgaattcgttcctaaatttctttcgaattttctttcgtttgctttcctatgcttttctttcacctgcaatttccgatacgggctcattctgagtgcgatctgtgcattccgttccgcttgtttctccaccaattgcgcgtgctgttcggcttcttctttccgcttttggtcgtggggagaaagcggaaaaaatgccattgaattcggtggtggagggaaaggcggcacacgcgcgacagagtcattggcacaatattcgaattggtagcggatgtaagcagagaattccgggctcagctgcagtgggtcgaactccaagtcggacgaagcgccactcgtcgaagagagaaggtcgtccagngaggggtcgggcgaaagcgaactttcgatggaagccaagtcccaatcggnggactgaagcagcngggccgagccgaaacgtgacggnntcgaacagtgcgcgagagcagcg

SEQ ID NO: 34948 - DNA, 991 bp, Heterodera glycines
actcggacgctaaggttctaaaaccaacaaaatcacttttctagtgtcgaattgccacaaatgccggcgaaatatttcgaaatgtttgcgtaaggctagaaaaacaaatctatttgattctttagtggttaaaatattgcgagtttttactccaagactttagagggcaatttgaataacgaactcataatctaattgcgaatgctatctaaaaaggtagcgattagcagcagaaaagattcgtaaatactaataggctaattttgccaaggattatcgtcctattttggccattggacttaaaagggttagggtgtacaatcaaaaaatttcggtctcccagaggaaaattatttattgacctttatgcacaattttaatcataaattaggatttaattgtacctcattactcggacgctaaggttctaaaaccaaaaaaccacttttatagtgtcgaattgccacaaatgcctgcgaaatatttcgaaatgtttgcgtaaggctagaaaaacaaatctatttgattctttagtggttaaaatattgcgagtttttactccaagactttagagggcaatttgaataacgaactcataatctaattgcgaatgctatctaattaaaggtagcgattagcagcagaaaaggttcgtaaatactaataggctaattttgccaaggattatcgtcctattttggccattggacttaaaagggttagggtgtacaatcaaaaaatttcggtctcccagaggaaaattatttattgacctttatgcacaattttaatcataaattaggatttaattgtacctcattactaggacgctaaggttctaaaaccaacaaaatcacttttctagtgtcgaattgccacaaatgccggcgaaatatttcgaaatgtttgcgtaaggctagaaaaacaaatctatttgattctttagtggttaaaatattgcgaggttttactcccagactttagagggcaa

SEQ ID NO: 34949 - DNA, 860 bp, Heterodera glycines
gcgctgaagcaattgggaggagggaccaaaaaggtgggaaatgggaaaaaaacattaaaaatgccttttacgcactgaaaatgagttaggtagtccggtcggaatgtctcaaatgtgccgttcttaaaggtgctcgttttgaccaccgattgctatgacaaacctttgccggaatcgtcgcgagtcattccatgctggccacatttatggtccagccgaaagaaacaatttgcgaaattcaattcaatttttgaaaatattcattttcccgttttcccctcgcaattcccatagatgctaaatttttattataaaaaatacaacaataaacccaaaaatcaaatggcatggctatttcctgctatatgaaaattttaacgttttctggatttattaatagctcatgccacttgtgctttgggtttggaccatcacgatcggtaatttcttgtgcgaatgatcgaatatcattcgttctcatcgctgcatcgtagttgttgcgccatctggcgcgcataagaaccggctcgtgcccggctttccccaaaatcaaattgaggaggagccgggcggtactcccgttcccgtcaaggaacgggtgtattcgcacctgaaaatttttgattcaaaaacacagccagggagtttttggggtacactatgaataacaaatcttaggatttttttataagaaaatcccacgaaaattttttttctaaaattttgatggtgaattactaagatttttcaaaatgtttccagaaatcgctcgctgaaaatttcccaaccaaaattttcctgacatttaaaaaaaaaattttgagagctgctcccgaattttggaaggaacatttcctttt

SEQ ID NO: 34950 - DNA, 840 bp, Heterodera glycines
agaagagagggagagaaaggaagagaggggggaaattacaatgagaaaagaagagagggagagaaaggaagagagggggggggggagggggaattaaaaggagaaaagaagagagggagagaaaggaagagaggggggggggaattaaaaggagaaaagaagagagggagagaaaggaagagagggggagggaatagaggaggactaacaaataagataaacggggaaaaaattgaatgaatttggttttttgatccgataactctttcgcttctcttccctttctcctccattcttttgtcattgcaattgaattccataaaatgtcctgaggcaacaaaagtgggcaatcattgaaaggtaaaaagggcaacagaagggtggggggaagttcaacggagggcaattcgtagggataaaaaacgaaaaggggaaaatgattataaaaagagagggaaagaaaaggagggggggggggacgagagtggaaaaattaacgagagacaaagggaacaggcagaaaaaggttgatagcaggcgacaaaaaggagggagacagacagttaaagataaaggcattcagtgataagaaggagtttggcattttgcaaaacttagggaggaggaggggggagaatgtttgctgaacagacaaatggcgctgctgaacacccgagaatgagcaaaatagggctataataaacaatgggtcattccgtaaaacatgaaacggagatggggggggggtatttgaggacaaaatgaggggacacccccacccaaatccattggatttacttatgatgaacgaaacagatgcgcaacatgaaaacgaatttt

SEQ ID NO: 34951 - DNA, 1247 bp, Heterodera glycines
  misc_feature (1178)..(1178): n is a, c, g, or t
ataaaattgaactctgctgatccgctgatctttttatgattattacgtcacttatctacaaattttgctctcttccgttcaatgagggtttctcaattatttttgttgttttccaatgctttcggaagaaagtcgtaaacacaaaacacttccatttcgtctcccccccccccccccttcactccccacttttttctctgtttgctttgccctttcatttcgtttttatttttgtttaattttccattggttttatttgtggcttttctttaataaaaatattttcaattttgcactttttttaaattttgttaaagattttcttgctaaatttgtgtcgaataaacgcattttgggaatattttaccggattaaataaaaaaaagatggccgagacaattaaggcaagcggaaaagtgattcattaaaacaaaattgatttaattaaaccattgggtttattcaaatgattgagtttgactttgttttcaggatgccacccatcgcatgggccgaatgcttccggcagaggctggcccgcgttatgggctttacgcggtttgttttgtgatttcgaatattttgtatagctgcaatttaattttaggcactggcggcaattgccggattggcctattgttaccgcgaccgtcttggatttaaaaagtgaatggacggacggcggaacggattggtcacccaccattttgatgagagagggggcaattttgaattcggattgttccaaggtccacaaattttatggccaatggtcggatcttttttcatttgatgctttttggtttcttttcactgtaaaataaatactatttcaattggactgtgttttattcgttttttagggtttcattttccattggaatttctcccccccccctttttggcattggcacttccaatgggttttggtttagtgcccttaatcccccttatttttgttttactttttaagcatttggcgtttcacttgtcttttataatcctcctcattcgccaccttcgaagtcaaaaacttgaaaatcccggcatagtcccgccgcaccgatgccccttcaaaaagacaataaaactgagttgccgttattgtctccattaactttcaattttcacggcaaattagacgcgttggtattattctgtctttttgtgtaaaatgnccaatgttgagaagccaaaatgcaactaattataaagacaaaagctgaattgaatttggacaccaaaaa

SEQ ID NO: 34952 - DNA, 1516 bp, Heterodera glycines
tttgcatcttgtgtaactaagtgtgaaagccgcttgctttacaaatttggcgaaacaaagtgagagaatggacaaaggagtgccgtaaaaccaggacaaaagaagtgttccgaggtcaccaagaacagatgaacaacccaagaaagcagcttataatgattgtaaaatcaatttattaactgatctaaaaaataagcatgtgaacgggaaatgtgtttacgagaggaggaatgttgtcaaattgtcccgggattttggggcttttaggttatacaatttcaaattattttaaatttaaaatcacatttaaaaaacttaatttgaattgatcaaagagttcaattgacgctttcattttacaaaaaatattcactttaaaatcaattgtatagattattaaattaatttccaaatagatttaacaaaatttgccattttttgcgtcattaaatgtaaaattcaatggaaaaagtggcatataaatgaacccgcagagacccatttctccacaatttgtttatatcttcttacttctatatcatgttgagctgttgatttgtggcttctgttctgaacttatattaataattaatattcattaaattaaacaaaaaatttgttttaatttactttatttaggatgaaaattttattgtttttcattgctttcattggcattctgtgccatgaagtgttcgcaaaatttacaaaggagaagaaagacttcttctcatctgtaaattttaaatgcctaaaactcatcaacgaaatgaaaaaatattctactgaagcagaatgtgagtaataaattatataataaaaaagttgttttaaattttttggtttcctttttttttgaaaagaaaaaaatattgcagaatattgcttagtctcttctttttttgctttgtaaacaaaaattcacgtcattttatattatcaatttaatgccgaattaatgaatttatttttctttttgctatagattctgaagacaaattgatggcaaattttagagatttatctgagaaagtaaaaacttgttcttgttgtgtggacgaaggtaataaatcttttttcaattcaatggacaatgccaaagaattctttgaaaatattgggaaagatgccaataaaagtcacattcaaaaatggcttcatcaaataagcaccgatttcaatacattgactattgaaagtgacctgtttgaaatttgggaaaactttatcgaatactcacatgccattacctcggaaaatttaaagtaatgtgtgatcaagtggcgaaaaatcagaatgatataagaaatgatgcggcactttatgctgtccttaataccattcattatgctgtagaaaaatgtaaaagtttagcagcaaactatgaaaagcctaagctttctgaaatgatttctgtttttcgtgatacactcctcattatgaaaaaatccttttacgaaagggaattaaatgccaaaattgtatttatcaatgaaattgggcatgaaaatgcatg

SEQ ID NO: 34953 - DNA, 1612 bp, Heterodera glycines
  misc_feature (1591)..(1591): n is a, c, g, or t
caaacgttcattcaatttgaccttaagaaatttaaagaaaaggttaatccattttttggggcgatattatgcgataaataaaacatgaaaattaaagggaattcggttaaaaggaaaactaaatcaatgataaaatgtttttgtaaaattaataataaaaattcttaattttatatggttaaaatttgtccatgggttgaattttgccttatctggggaaaacaatcaccggcgagttcaatttctggcgaaatcaaatacagacggcgagaaaaagagaaatagttcactggcgaaatcactcactggcgaaatcacacactggcgaaatcacacactggcgaaatcacacactggcgaaatcacacactggcgaaatcccactggcgaaatcaatcactggcgaaatcacctggcgcgtttttattatataggattttttgaaataacgcacaaaacttacgccattaatttatttggcataatgtctaaatatatgaaaaaaaaccgcgaattccccacaatcttgaaaaaccgagttttctacgtctgttcgtgtttcgaatccggtttcgggctcaaaatcagtccattcggaattttgaggttctttgtttgtcacaattagctagataagctgactcgtaaattatgtgtcgtaatttacaccttaatgttttttcaaatttcattcctattaatcaaactttcctatattttgggccttccatttgtccacaatgaatgtgtattaagaaaacagcgtgaaaatttcacgcaaattgaccaaaatgactgatgggacgaaatcggtgagtgtttttctttctaacttttgatgccattacatttcttgggcctttgttttaagatggacgacgccgttgaattggtcactgccctggagaacatgcgggtgaacatcgacctgctcagtgtaaaaaccgacaaatttgggatttggggtcacacttgagaggaatcttgccaatgcaaaaatggtttaaaacctttgttggttttgtttcgattcaatgccccaggattctatgctcgtaaaaactagacatgcatattccaaccgtttcaggtacttttccattgatgacacaccccattaaaaaaatgagcaacaaagccggttcagtatacatagacttacctattttgtacgcataaaagaattgggttgggttcaaatgggacaaagttttctcatcttctttatattttgtatttacttacacatatcgaatggctttgttgcgcttttttaaattggggtgtgtcatcaaaacataaaaatataccttttattccctctattaatttttcaacgaatttaatttacaattttgcttttttcagaaaactcgcattggcgctgttttgaacgaattccgcaagaaaatcaaagacgaaaaactagcaaaacgttgcaaggcattgatcaaggtttgttttttttggaggagagatgcacaaaaacaaaggactcaaaaagtttaaacaccaaaatttggcacaaattttatgaatttttagcattacaaactttttgaatttgttgccaaaagacgtgctcagattntgttggcacaaactcgaaaat

SEQ ID NO: 34954 - DNA, 956 bp, Heterodera glycines
aaaaatggggacaaaaaatcatagaaaaaccaattaaagataatcaccgcttgagctgttccatcgttgacgaccattgatccatcggtgaattcacaaagcatctgatcaccttcggcacaccatacaaacaaggcgtgaacaaccatttggccaccgcttagccatccgacgcattggcactttcatccggcggaaattcggggaaaatgacgtcaaagaaagagacaaaacgaagtgatggacattcgctgagaagtgacggggccaattgacgcaaacgccgaaaagcgatggagttcaaaagcataacacgaatggagtcatgcagcattggccaaatgttgagcaaaataaattccaaaatgcgatcattgcccgtggtaatgtacaaatccgttgaacaaacggcggataaatgcgatgacattttgatcgatgtagctgaaaaaaagagaatgtagatgaaaaattccaatttaatcaaatttttacaagatatgaatgtgtctgaatccgatgactttgttcgacaacggattttgcgggattgacaatggatttccatcggaattgacaatttgcattttcttcgtgccattctctccaattttgtggcaaattcgcattttgcccaatttccatttgcgtgttttgaagtgttcgtcgacgatgcagttaaaacggcggttgaccagcgcaatttcaaggccgagctgagaaggcgcaagaaaatcgaacaccaaaagccaacaatcgccgcagataaagctgaaaaattgaagaatttctatgaaatttacaaaattttcaattttatttacatttctttgtgagggcggaagtcgttttttgacattgcttgtgaataagaaataaaatttctgcagaaaatttttcgaaaaaaaaaatccagctttaattatgttttaataaatttaaaaaattcatttttt

SEQ ID NO: 34955 - DNA, 365 bp, Heterodera glycines
tcaagggcgtagccagatcattggctttggggggggggggggggtgaagtcaaaaattcgatttttaggggtgtatttttcttctttcagtcgattttgaggggagtatttttgcttttttgaaatcccgaattagggggggtattttacataatttttcgccttttttcgccaaaaaattactattttttgccattttggccttctttttcaaaaatatggtaaaatggggtccggtggtgccgataggcaccgacgggaaaatttttgagtattttaatgcaaatttgtcaagaaaattgcttaaaaatttcaaaaaattaactgaaaattttttaaagatttgggtttcggggggggggggc

SEQ ID NO: 34956 - DNA, 903 bp, Heterodera glycines
atggcatttcaatctcccacctcagacgtttgtgggcactattgcatattttttatttatttggcttcaaccggaatgttatatgatgaaattttgaaacaactgaaattgtattgtgtggattataattgtgacattgcaattaaaaactacgtgaataaaattttgttttatctcttggggggagccttcaattagtaaaggtggatgattccgaatcatgatttaaaaatataccagctagtgccagtctctgggcattggggtcaaaaggcgtcagctgacacatttctcctgtgtctatctcattttgatgcgtcagctgtctagcattttagtccttaatttattagagaaaaagaggcattgagtatcgtaaaaagagaggtattgagtatcgaaacgattcattcataattttatggaaattactgctagtacggggtataaattaagtgaaaaattcaatacaacctcatttattggccaattccaaaaatcatcatgagcaatcgatcaaacaatgaacctagcccaccgaagcgccgaagaatgccaaacatcctcaaaagtggaagcaacaacaacaacaacaatggcaaaagacgcaattttcggcactatgtacgcgcgctgaacaccgacgtagcgttcaacaaaaaattcagactaatgaatgctaaaagtacattcatgatccagactctaccatcaaatcctgagtcgcttttgcgagtcatttttggacattgcatacaatcgtcattaaatgaagctcagagacgtggaattgaaccgagtcgacttggggcaacaattacttcacagttattggaccctgacatttggattccgatccgtcagataactccaaacacagtggacacaattttgaatcgcttc

SEQ ID NO: 34957 - DNA, 425 bp, Heterodera glycines
ttcatttctctctctgtctccgatcgatgcgcagttccaatgccaaaaccaaaaatggacttatttgggcactgtttgggcttttcgtgcgttttaatatcccataacaccgatcacataaaggccccgttttgttgttgttctctttcattgccaaataatccgccaaattttctgcgtttgttgcgttgaatatttatttatctgaacttttccaaacctgttattcgcagaatgagtgctttctccgaaaagcagctgtgcaattcgctcggcttcttcttcagataccctccttttttcgcctcatttggccttgcgaaattacccgcccttttcgttttgcgagtgatcaactcgttcttgtctcccgctggggctaattgcatcaacacgtcaccgggggggggggggggggcgggggg

SEQ ID NO: 34958 - DNA, 1884 bp, Heterodera glycines
  misc_feature (986)..(986): n is a, c, g, or t
ttcttagaaatgattgataaaattcaaaaattgccaaatctttttatgtatgaatatagaaaacagtccttagctatgcaaaaattagaaattggtatcaaagaacgaaatatatttaaatgtcaagaagcagagattatatccgataccaatttatcgaagataaataaattccaaaaacaagtgccaaattatcgatttgaaatgaaaatgttatacaataaaattagaataactgcagtaaaacatttgtttaaacccgaaaaagaaatattttttagtccttttcaaatagaaagaaatagagaaatattttattcattatttcggcatatctaataaaatcgcaatacaaaagtgggcccaacgaaatgatgagctttggaagaaaacgcaggaagagagcagcaaaattggcatccgtgacaaccattacatttggaaaaaaagattgtgatgggggtctatggggaaaatgttgagaaaccccttctccaccctccagctcccctccccctcccgcttctaaatatgttgttgtttttaaataaaaatataaaaaatgtttaaacattaatttgattttttactttggctactataccgagaacttttattttttgtacgtttttcttaactttttttgacgatttttgattttttggctattttaacgaattttttcatagtctttatgatatttttagtaatattaatgggttttttgtaatttttaacacttttcagattttttttggctatttttatgaattttatgatttattagcgatttctgattttttttttttggttttttaagaatttttacaaattttctatttttggcatttttttaccaatttatcgtgaatttttttttgatccttccgcaccaattattcataaatttggccactggtttaaacagcgaacagggttaatttgggtcggtgttaattggccacaacgtgcgatgcgactttgcncacaaagcgagatgcgactatttggagggaggtggggtgtcgccacaacatgcgatgcggttgcccacaacgcatgatgcgaaattggggaggggccacaacatgcgatgcggttgcccacaacgcatgatgcgaaattggggaggggccacaacatgcgatgcggttgcccacaacgcatgatgcgaaattggggtgttgccacaacatgcgatgcggttgcccacaacgcatgatgcgaaattcgggtgttgccacaacatgcgatgcggttgcccacaacgcatgatgcgaaattgggggggaggtggggtgttgccacaacatgcgatgcggttgcccacaacgcatgatgcgaaattggggtgttgccacaacatgcgatgcggttgcccacaacgcatgatgcgaaattggggaggaggtggggtgttgccacaacatgcgatgcggttgcccacaacgcatgatgcgaaattggggaggaggtgtggtgtcgccacaacatgtgatgtggttgcccacaacgcatgatgcgactattagggaggggatgaaaaattgatgcggtgggaaaatttaaaatataggctgaactaaactccattttaaataaatttattttaaccaatatttatttacattttttataattgtataacgagaataagatataatttggaatgcatgtttaaaaatattaaatttctttatcaaaacaaaaaatattgttaggaaatgtttcagtttacagaaaattaaacaaaaatttttttgggaataaacacattaaaaacttttatattttgaaatgatacaaatttaaaaaatttgcataactttacgcagaaggacagacgggatttggataagaaaaattaattaacgattaaaaatt

SEQ ID NO: 34959 - DNA, 847 bp, Heterodera glycines
tttttgcagcactgctcactccaattttgatcgatttggcacgctcagctataaattcgggcttcaaatctgaaaattaatcattttatcatggcatcaaaatttgttctcatccccgacgaaatctatcaaggtctaacaaacaatgattcgggaaatatcaatttggactttgctcaacgtactttggaaagaacaaaaagaaggagggaaaatgtgacggctaagaatgtacattataaccaggaattgtcccgttatctccatctgcgagatgaacaacaaaatcggccaactaaagttgaaattgcgaaagggttaaaagcgttgattaaaaggggagatgaaagtgatgaagaaccggtttttaatttgggatcagacagacagcaatcccacgcttcacaaattcgtaaaccacgtcgacaccatcacagctataatgaggatgaggaaatgccattacagcagccttctccaccgcttcgagctgaaaataggggacaaaagcggaaaccaaatgatttttattcctcgtgggaggaaggcgcaaagagacaactgcgtcaccaagatgaaccggttcctccctcctctaagatcgtgaatagacaaagaagaagtcaaccgccagtttcattgagaagagaagaacaacaaattccagttgacatcccgcaggaagaacccttccaaccagtcccacaaccgtctattcctatacatccacaagttaacagaaaacggaaagcccagcataccctaaatgatattcgggaagtgaaaaagagccttataggattggaagagctaagacctccttcgcttcacaggaggcatcccttcg

SEQ ID NO: 34960 - DNA, 960 bp, Heterodera glycines
ttggtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgactttaattctgcgttggatttttgctccccataattgtttgagtaccccaaacggacacttgaaaaaatcgatttttttgtttttcgggcagtccccccgaaccgatgcgcccatatttatggggagaccgaatccttcgggagtagctccctatagcctggacttaaatct

SEQ ID NO: 34961 - DNA, 1008 bp, Heterodera glycines
tgagaaataaatccaaaaataataaatattcataaaaaacgattaaattaaatgaaattattaataaaactaaaaaaattattaaaatattattatagttaaagtaagtttaaaaaatatttggattagcaaattcttctttaatactcctttcaattggatattgttctgtaacttttaggagagtcattgtcaggaagttaacgaaaataaacttgtgcctcacctcataaatctgttttaccccaaccattggtcaaagcatgtgttggcattcctattgcgaagctgggcaatgtgttcatctcttttgccaaagctcgcttctgaccgaaaaagtataacataaactaacaaatttacagttcaattttttccctcatttcatgattttgccgaccgttgtttggcttacattgatcggaatgcggacaccttgttcaaatcagaggcatttttgcaaattgaccagaaattattgttcaaaattctgtgccgggatcagttggttgtaagccaagaaattgccatatggaatgccgtaaatttttgcattttgtaaaaatttaaaattttgcttttttgggtcgattcttaggggtctattttttgaaaaaaatttttaggtcgattcttaggggtgtatttttcgtttttattgcatttttattataattttggacaaaaggcaaaaataggttctttcaaaaaatttttaggcttttaggctctaaaaataaaaacctagaaaataggctctaataactcgaaaagtagcttaacaacatcccaaaaaaccatgtttttagtgcgtttcaggccacggggagctcaggaaaaaataggcttttgcctaaaaatcccagccctagtgaggaccgtgggaccaagctactttaagacaattaattgttgctgtctgattgtgagatcgaaaaacccttgggctttagagactttttttttgtatgaaaatggcggacgatttgatcaaatcggaaggaattt

SEQ ID NO: 34962 - DNA, 859 bp, Heterodera glycines
ttccctttttttgatgagccctcattttctctttttgttatttgaggaaagtcaatggcaacggacgaattgtcacactttttcgcttctctcttacgcactcagaatgtcggtttgccattctgattttgtcagaaatgttaatcgggcgtgttaacccaaaacatgcgggttttttgaaattatatttttctatttgtacgggcattcccttactatgttttttgactatcaccagcaggaaggccattttttacaaattcgttcaaaatttttgctcaacagctgatcgatgatcactgtctgtatgcgttcctcaacagacagtccccccacagaattgtctcctccttcttctgctgctgtccccggttttggttgttatcatttatcaatcactcattcattcattcgactcgcacccattggaacaattcactcaaaaaaattaaaggaagaaattattcaaaatgatatgaatggtttaacattcgtaggattttttatcagtgtataattgcacttgttaaattcgtttgatttccttatatttaatcgccattgattatttatgattttagctttttttcttcatgttttcggatgtttccgttcaaaaggttaaattattgtcccattgaagaggaggaaggagagaattcgcagtcaattcatggccggattgatggcacatgccaagttgggacggactgttgcgacacgcgagagtgtgcaggagttcatgcaacccaaagcggactcggcgtgtctttcaaatgcgagaaggacccggaaatgacccccccgccagaggaccggccccggtgggaccacgagggggacgtgtaccacgcaagca

SEQ ID NO: 34963 - DNA, 965 bp, Heterodera glycines
tccgcaggcgaccgtaaccccgattgagttgggtacagtcgtcaaagaatgtgtgcccaatgtgctcacgttcggacgtactgtgccgaacacggactgtgacctcgtatggttcggtccagccgtggatgtagagaaaacccggaaatccgacccgatttcttaaattttttaggcatcaaaatccaaacccaggtttttttttgctgtgatgctgtttttttctaaagtagagacaaaaaattgtcataattttctttaaattttccgttgaaattttacaatattttagacaaagtttcaaaaaaaattttatgtaacgaatttttttgaagcggaaatttctatttcaatatagcttctactgagaaatggacaattttttattgagctcaattcaaacatgtccattttgtatggttgccaccaccgtacgtccgagagcagcacacactgtacaaggtgctatgtcattacttaaaaaccatcataatgggcgttacttaaaaaaccatcataatgaaaatttttgcttataactttgctctaaaaagaccaaatttttaatccttgctatcattcgatagatctaaatgttctttatgagcctgtaaaatttcaaaaaattttattaagtttaaaaaaagttatggccaaaaatgttcgaaaatcaaggttttttgagttcctcgagctataacttttttgaaacttaacgaaattttttgaaattttgcagactgatagagaacacttagggctatcaaatgatatcaagaattaaaaatttggttgctttcgagcaaagttataaataatttttcgacaaaaattttcataatgatggttttttaagtaacgcccattatgatggtttttaagtaacgacccagcaccctgtacaatgaactgctgccgatcctggaaacagtcgctggcgaatgggtcatcgcgctgacaacgag

SEQ ID NO: 34964 - DNA, 707 bp, Heterodera glycines
caaaagataatttggccaagtgataaacaaaaatattattttcctctgaaaaagcaattcaaatttttaaaaaattaggtcactttttggcattttttgtgcctaaatttcggggttttatccccactaaaaccccggacacttataatttgaaaaactttgcccctattaggcctttttctttcttgggaggggaattcagtcaccctttgattgattgacccgtaaaactgaccgaaatttgcaaattttttggcggtgcacagattggcatcggtcgctccacaaaatgttgctgttcaccggtaatctccagcagtccaattcgatcacagcacacaaaaagtggcgccaattttcgacgctttgtccaaatgcgacggttggacaatgcggcgaatcgttgagaaacgaacgcaaattgtgaagcgagaaatgggcgactgagctgggacaacacgtccaaccaacaatcatccggcagccaaatgctgtgaaggaaattaaaaaaactgttttggcgttttatttccatttaaaatatattttcaaaatttttttaaattttattatgtgctttaaacattttctcgacaaactcacagtgatttaacggtgcacatggtttgagacttgaggtgaaagacggtttttggttttgttgttgtaccagtgaaacaaaatttaattgaataaaataaatgtgc

SEQ ID NO: 34965 - DNA, 958 bp, Heterodera glycines
  misc_feature (854)..(854): n is a, c, g, or t
  misc_feature (859)..(859): n is a, c, g, or t
atacaaatcgatcattttaagaaaatgatgatgttagattttgtatgcccaaaattttacaataattcattcctgagtatggtaacacattaatccgtgaaaccaattggtttcctaattacataaaaaatacgaaaaatattaaaaatctctcaaatttggaaatatgttcatctctatatacatataataatgatcaaaaaaaaacattctaattgagatcggattaacatttgatcaaaccaactcacttgtatgggaaatggtttgtcgtggcgatcagttggaacggttgtgccagatcagaactgcatgagagcagctgaacagcgccagaggaaagcatggtgagcagaaacacacgccctggccctctcattgggtggtcctcttcggtggcgataccgtacaccttaccgcactcttcatcgcctacagtagaccatggttggcagttgtacacgctacaaaaacatttttttattaaaaaactcgcacaatattcaaatctaaaataatttgaacattcattttcagacattgcatcatttgtcgcaaagattacggtaatgacccaacaaaattgttactgtacattttgtaaaaggacgaagtgctacggtaggcaaacacggtgtacgatgaagcaaacaacacagtggcacgtgatactagcaatgccatcgcgtgaaaatgtacagaatccaggaaatgggcagataacggtgttacagtagtgattggatcaaaactgcgcgttactgtaaacaccctttgccatgattggtacagtatgccggagctgttgtcaaatgcgagtgacacaatgccagcgtctgcgggtggtaatttgngtctnaagaatttatgtataatcatttaagtttaaaattaaaaataatgttggatctatatttagatataatttttaaaaatatttttgcttttttatttaatt

SEQ ID NO: 34966 - DNA, 1272 bp, Heterodera glycines
caaaatgataactcatacaaaggaccaaaaaatagtaaattaataattttaataaaaaaaacatatatggcttaaaaaaaccaaaattatttctgaattatgacctaaaactgtgaaaatatgacctaaaagtcccgaatttagagggtgaaattgatttggaaaaattccctttccaccgaaagggttctagaaaaaatgcggataaatcacaaaatccctaatatggatctgatctaccggaactggtcgaagttttcggatggttaaaaatcagtaacggtaaaagtcggaaaatcggggagcggtcagtcatcagatgcatttttaggttcaaccagtaattttgcatttttctttttttctttgttggtttcttcaaatcccatcccaatttgacctgaatgttgacagtgatttgttgcgaaattttgaatggaaattggagaataaaaaattgaataaaaattaataatgaaaatgttctcattttatttatttattggtaatcccaattttctcctctttttcgtttgaatgggaaaaccaaagcttattttctgctgctaatggtgagaaattaatttccaaattcagcaaatgaaataaatattttttaattattcagctgcaatttgtgataactattaaatgttttagtaaattaattcatttttactgaatttttcttaattgatgcaaaattcaaaatttaatcaaaaataattaaatgtgaaaaataataaataaaaacaattatggaaaatggtcacaaatggccaaaagaatgctttgttggcattagattttaggcacagaattacgacatgaaaaaggggtgccagggcattttcaaaatcctaccattgaaataagaaaatggaagaaaaaatcatggcataacccaagtcagccaaaaaaatgttttatcctatagtctttcttagtcaactaaaaaattcaacaaattcagttcatccgatagctctacgtatttagaacttatcccctacatttaagccccggacaaatgaaattggacatttgcgcccggaatttatgtgcccgacatttgctccgcattccttaagggctattttgggacatttgccgcttgatcattctaaatttatatatgttttgaagagaaattaattatagttagcatgcatcaagcattcaatatttcctacactatttatttaactattttttgttagcagaaatgagttaaaatttttaaaaattcataaaaaattaataaatcattgg

SEQ ID NO: 34967 - DNA, 1163 bp, Heterodera glycines
agaaacagcggtgcaagaagattggcaagcagttgctgaagaagagcagaagcaacaacagaagggggccatcggcgcatttgcgtcgcccgaggggacaaattgctgcagcagcaaaaacccattgatgcgagatgattttcgccaattgccttcctctaatggactcgtcgaggcactttccgcctcctcctcttcgtccgcttcctcctcctcttcgtccgcttcctcctcctcttccgcctgttgctgtgcggagaatcgtctctttctatgctcaccgcagcagcggggactgacttttccgtccccaattcgcccctccggcgaatgttcatcttcctcctcatcatccgcttcctcttccgcttcatcttcctcctcctcttcctttgctttgtcttccgtcaccccccgtcgtccttttttctttcacaaagtggcaaagacaattgtggcggaagatgaggacgaagttcaacagcaggggacggagaatatgtggaagacaaatccgatgataaagcgaaggacgagcaaaaacagtgccaagggaaagggaaacaaaggggaggaggaaaattgccaacggaggacggacccgaaaaaggcaattgaagctgcggacgccgtctcacggatgggttttctaaactgatcaaatggcgatcggacggaccgatcgataggaaaattcaatcgcaaattattttccttttttgccccctcctctcaaatttcttttctgtgtttttttgatatttctgtataaaaagactgttgttagtcaaataagtattattatttttcaaattttaaatgatttcttttttaataaaattttggcgctactgtaaaagtggccgtttttgaaacaaaagggggggggggcccttttgttttgcaaaatttttttaagataaaaaaccatgataattttttatccggggttttaaaggtcgctaatcacgaatctgacatgtattttgactaatttctaatccctaacccgaactcgaataaaaatcgaaattttgaatttttcaaattatgattttttgttcaaatttagattaggaaatcggaattgatcaaaataattgaaggattcgtgatcgggggcaccaaaaaccccagagaataaatttttatgactatcacaa

SEQ ID NO: 34968 - DNA, 702 bp, Heterodera glycines
tcgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttggacatttcgtggcttggacactttgtgggggtgccatttcgaaacgggccagttgcgtctgaggcaagtttagaccaccattttttataagttgttcaatcgcttagcaatatcttatcaaaagcttcttcaaaaattatcatttaaaaatctaaatttctctctgaatcctaaaaataagactaaaataaggacaaagagcttaaataaggacaaatcttacaaataaggacaaagggtaaccctgctctaaatggctgactatggtattaaaaaaccggtacttgtgcggtttacatgatactttttacatagatttttaaatgcctataaatgtgtttttgaaattaatgaaaataagtttttagggtcgctgatcacgaatatagcacccatttttgtcaatttcaaacccctgatccgaactcgaacaaaaataaaattagaaaatttgtaaggatgatatcttggcatcttgcccatgagggtaacattggtacaggaagcctatcaatt

SEQ ID NO: 34969 - DNA, 754 bp, Heterodera glycines
  misc_feature (706)..(706): n is a, c, g, or t
ttttaaagaatatattaatatattttttaaattttttctttttaactccaattttcctcactaatttttcactcagacccccattctgaccagtgcttgtttttcccggttcccggttgccctaccgggaccgggacatgagcttttcaaaatccgggaccgggacctcggatgaccgggaattcccggcccggtcccgtggcactctacatgaaagtatcaaacataattgatgatactcctactgtgaaccgatctagggctccaacattttaaagaacaattggcagtgaatgcattttcaatttaatctaatcattagtgaacggattcttaagtttttgcttattttttctgagcatggacggtaaaaaacgaaaaaaattgccaaaaaataattggcgtaaaacaaaacgccaacacactcaaattgaaaaacaaattatattttcatctgatatttgttattaatgattaaataattcataaactaacagatagaatcaaaaaataacagatgaatcgatgcagaatttttttctctatcgctatgcaaaatttggtatgaatttaacaagcagaaaaaaagttaaacaggatgaagtaaatgttgttctttacattattaagaatgaagagatagtacgtaaaagtgagagaaataaagataaaaagtaaatgtgacagaacgccaattttttcccantaattatccataaaaagatttattgtcgcttttttttcttttttaccg

SEQ ID NO: 34970 - DNA, 983 bp, Heterodera glycines
tttttaaaattgactagagcaatcgaacgctaacggacgatctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatgcaacgcagaattaaagtacagactatagggaagcta

SEQ ID NO: 34971 - DNA, 1427 bp, Heterodera glycines
gctggggggcctaaaatatggggccacattggagaattaattctgatttctgaaaaagtcccagaaataactatttattctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaatagtagataatattcccaatcaaattatcgattgattttcgatcgataatttgagtgtgtctactttttttctctgacatccccttccacaaacccaaacctattggatggtctcctcgagagagagagagagagagagagtacattgaccccccccccccatacctattggatgatctttgatcccttcaacccaaacctattggatggacttgtgcgcgagaatttaattaatttaaattttaattaattaatttaaatgagcgagagctgcgcgactatttccgaaaaattgtgaaaaatcaaaaacatggtagtggactcgaaccgttgagagtggaagcgaggagcttaaccacttggccacaggggcagttgaaaggtatgggataattgttgactttatgatgaaaattccgaaaaatcgtgaaaaatcaaaaacatggtagtggactcgaaccgttgagagtggaagcgaggagcttaaccacttggccacagggtgagttgaaaggaactggataattgttgactaaatggtgaaaaattttcccctttgcttcaccacaagcgctgcggaggcgggcgtgtggcggtgagagagtgatggtggacgcctctgtttcgatttttcaattaattgattatatgcgcagccctttaccgttgattaaggatatttaagctccttaacattgcctttttctctttttctcattttttcaattttgttaaattttcatcagcaacaaacatcctcattttataataaatattaattccttaattatattcgtttttatatattaattttctaatatgaaaaagaatattttcaaatgaaaaaatgcattttaaaattactttaagttaaatgtattaaatcactttattacgctactttatattcatttttatttaattcagattttagacctaatcctgatcatttttgaagagttcgaacaatgttcgacttttcgaccttttgttcgaactcgttattttcattacccagggctcccagtcactgtacaaacatttaaa

SEQ ID NO: 34972 - DNA, 958 bp, Heterodera glycines
  misc_feature (765)..(765): n is a, c, g, or t
  misc_feature (774)..(774): n is a, c, g, or t
  misc_feature (786)..(786): n is a, c, g, or t
  misc_feature (800)..(800): n is a, c, g, or t
  misc_feature (806)..(806): n is a, c, g, or t
  misc_feature (828)..(828): n is a, c, g, or t
gggtttttagggcatttttgggggatttttagtgcatattttatgcgcatatttggcattttttttagtgcatacaacttataaccctagtaattagttctaattaaatataaaaattatcaatagtaaatttttttttgaagaattatgtactgaaatgaccgcgctaaatcaattttgaagcctttcaacgcatcaaggaactcgggcaacctgggaaacgagttctgcactcagtccaaatttatttacctgccgtttgtcactgtttggccacaacaaagttgggagagccaaagtgcggtaaaacgggagagaaaggggagaggagaggggagggggaattgaaccgacaattcacacaaactaaacaaaggcactaaccactgagccaggaagtacactctcagaaaatgcccaaactcaataaaaaataagcatgcaaaaagtttttttgatttttgaaaattaaatttggcaatttatgtggggaatttagggtcgagtggtgccggggtttttagggcatttttgggggatttttagtgcatattttatgcgcatatttggcattttttttagtgcatacaacttataaccctagtaattagttctaattaaatataaaaattatcaatagtaaatttttttttgaagaattatgtactgaaatgaccgcgctaaatcaattttgaagcctttcaacgcatcaaggaactcgggcaacctgggaaacgagttctgcactcagtccaaatttatttnacctgccgntttgtcactgtnttggccacaacaanagttgngagagccaaaatgcactgcgtnaacggaagagaaacgattttcagggtatgggctctattgcggtgtacacgaccataaaataacaaagacaatttaacacttcataaagcactttcagaagacccaattaaatattcttgatattcttaat

SEQ ID NO: 34973 - DNA, 750 bp, Heterodera glycines
ccccccgccccgcgccccccgaaaaggtcggtcggattggccgcatttatgcatgcttcttctgccctccggcgggtccctccgccggagtccgtccaatgtctcctcaccggtctcccccgccgcccaacccttctaaatccgacaactgactgactcattccgaatggggaaaatggatttttacggccgacatggggggaggaggatgaatgaaaaaggaagaggaagaagaagcatgtattattgccttcctcccccgctcctctgcccaatcaagccggggacaggactggatccccccgggcgataacgatgaatgaattgctgcgtggccttcattctctctgcccccttaaggatggctttagtgatcggacaggcactgatcgaggaggggttttgttgtttccgattgtttttgcttttgtattggctttttctttttttgtacaagcatctgtcaacatcaacattgagagggcggggcggggggcatctgtcaacaacatggaaatgctggggggcaagtgccgggggaggggtagagtgagtgagagagtgaggaagactgacctgtccccgaagacgattacaagtcttccgatctatggtttttagaactaaaaagtaatcgtccgggtggaattcgaacccatgacccttcaaaaactctaaccaaataagtgagttcttttagacgctctcccatgccctttatctctattccactttttgggcccattaact

SEQ ID NO: 34974 - DNA, 861 bp, Heterodera glycines
ccccgacccatagttcctccccgcttacatttgtcccactctccgccgactctggtccccgctttcgattaccaaacgcaaatattcccctcgtaaatggaagaatgaatgaatggatgaataatatgcaatttctcaactttcaattttatttcctgattttatctgcctgtgtcgctcaccccgtttctcgccgctctgctgcctctgatcgaagcataatctttctgtgcccccgccgctttcacattttgcatgtaatccgcgcactcatctccaacacacacactctgtcatataaaccctccgtctccgtgcccccgcccctgccgccgctttgcttttggttgggtgggcacatttgtacgacgtcaccgccgccgccccccccccgcgaccgtcccctatgactcgcgtggaacacgataaaagttgaggcggaacaaccggttcacccaccgctcccccccccccccgctcgtcccattaatgggctccgcgcggatcggcgcgtcggggacctttacgccccaagcgcttcacttataattggttattggtcaaaccctccaccgcgcttggtgaagtatttaaatattctgaccagctttttctaggcctttgtttgatcactaatatattcactatattagaagctcatccgggtcttataataaacaccaattaattgacaacagaattccattttttgatgttaatttcagaaaaggaacttcacaatgtgattccttctcgtaaagatacactcaagcgaatatattacatttgctaagaatatatttgtgatttccaaacagtgcatacttggagaatatttttatatgtatgattgtagtgtaa

SEQ ID NO: 34975 - DNA, 954 bp, Heterodera glycines
aatatttgagtttaaaattcagttcatcaaaagacggcaatttaaaggacattaaagagccgacagcagcaccttctcacaaaacaaaggcaaagacaacggtcaatttcgaaatggaaagttcgactgaggaaaaaatttcacccaaatttcttcaatttataccaaaatcgccaattattggtgggtgatcttacacaaaataatttaatacattaatagagcatttttttcattaaaaaagataaataaatattaaagtttaatgataatttggtcaatttaaattaaatcttcgcttttgaaaattattttaatttttgacggacttttatcttctaaaagtcgttatccattgtaataaataatccgtatttgcgtagttgaacagccaccttcatacgctactgtaacacagtatcagcgccagcaacagcaacaacagcagcccaattataataactaccaatcgtatcctgtccaaccacctcaacactgttatggatgttacgatggtgctggacggtacggaggaaacggtaataaactctcaattatcattactattttttataggagggtataatggaaatggaggatataatagtaatagtggacaaggtcagctaaacagtaaaaattaacagtgttcggtggaaatggaggatactattatggacaaggtcatcttctaattgccaacataaataacaagtactttaggaggatacggcgtggggtacggtgggaacggaggatacggtaactaacaaaaccacataataaattttaatagtgcttttgtactatatcagttccctaaaaacatgaatatttaaaaaacaagattatattttaaaagataagtatcacttaagcaatgatgcctatgtcatccccatcatacatgggaggatatggtggcaacttgttcaattttggcaccggatgggg

SEQ ID NO: 34976 - DNA, 1254 bp, Heterodera glycines
  misc_feature (1227)..(1227): n is a, c, g, or t
ccaccaccaccaccacaacgcgacgagttaataataattaataaaaaaattaaattttgtggcatttggtcccatgcccccttaaactctcaaactgattaaaaaaactcagatgctaagccccgaggaatgggaggtgcgcatgcgcggcggcattctcagcaaagcgttgcgccgctacgccgccgacggacacttaaaaggcgacgatgtgccaaagtgaggaggagacttttaaaaattgaaaatttgattttttaatatatttgtggcgattcgaatcggattttctttaatggcaaagtttttccttgccgatttcttgagtcaataaaggagtttcctttatgactagtgaatgatcatatgggttttgccaatgttttatgaactgaatgcaaagtcaaaattcaaaatttgataatttcgttacaaatttttggcgaaaagttgtttgttgattttgacaaaaatttgagaaaatttatcatttttttgtagaatgagtggagataattttgaatctgctgaatttaagtatttttaaagaaaaaaatcagtttgaagattttttaaagttttcatttatttttcactttttttttttggcatttttgagggtttttagcacaaataaaccccaactaaaatcgggcacaaaatatttttcctgctgttaaattgggcatcgcgatatataatttgaaacttttgaatttgaaatttgtctccaattgattctaatgaatacagtaagcgtcgtgtaagcgttgtggacagttcggacgacgactatcgctacggtattttgggcaagtcgctgcgccaattcaacgatggcgggaaactgtatttgcatgacaaccatcgacggaatgacacggaaacgagcagcagcagcgctgaagggacgatgacagtgcaaaatgcaattggcagaaagggtacggtagcaataggaaatgaatactgtaatttgttttaagtacggtaataacacagaagaatactgtaatttgttgccaatgtgctgttaagcttttgaaatctataggaaagcatttaaaatttattgaacaagctacggtgttattataaaatcatcattttatttttagaaaatcctactgtaatattatattcaaatactaaattatattttaaaaatcgaaactttagttttaaaacaaaaaataatataattttttcttatttttcgaaaaaganttattattttttgatttgttttgatca

SEQ ID NO: 34977 - DNA, 1024 bp, Heterodera glycines
ccccgcttttcgttactccctccccccgcgcccccgcccccttcatttccagacaattcgcagcaaaagtttgttttttaaaaacgccaatttaaaataataatttattaaaactttataattattattgctttgtatagaagtaaaattttttttaaatgaaagatttctattaaatctcaaatagcttagaaatgtaaagtttttgaataatttttacaataaatcattttttggaatattattcgaactaatattttcgaaaaaattttgaccaattccctaaaagaataaaattcactgatgcattgtcttccccccccccttcgtttgtctcttttctccccttttcaattaagcctttgtctccgcctttgtccttcaatttgtttttgaaactcttcgtggaatggagctgaaagaatttaatttaagtgatgagaatatgaaacggcggagagaaaggccgagttaaattgggagtgagtggtgacaattcggaagggagacgaagcggacacggacaattggccgacttaacggccaattgggcgactgaccgatgagacaaatcgtcttaaaatagaaagacacacaaaaaacagaatgacaatcatcatcttcttccggcggatgagcatcattttccgatggaattcagtggagaggaagcggagacgaagccgaagtgaaatgggcggaagatgaaacgggcggaaggggcggacgaagcgaagggaccgatgacgggtgggaggcggaagagcagtccacaaccgcatatttgtgctggaagatgggaaattgaattcagactcagcgttaaatttggtgagacattttgtcggtagaaaacggaaaaatgccgagattgtgggaaagaaaagaggggacggcatgggatgagaggggatggggatgcaaattgggaaaatggcccggacgagaggaatgggaggaataggggataggagaggcaagagggagcggaagggagggagggagagagagagagggaggagag

SEQ ID NO: 34978 - DNA, 991 bp, Heterodera glycines
aatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaagggtgtgcatttaagcgactcgctgtgcttgccactgcatttcaatagctggtaattttatttgtccggctaatcagaaaaatcactatctcttttttt

SEQ ID NO: 34979 - DNA, 163 bp, Heterodera glycines
aaagaaaaagagagggaggagagagaaagaaagagagtgagaaaagaaagggagaggagagagagagagagaataagaatgggagaagaaaatggaaggcgcgatggaaagaagttgtttttacattttttttaataccattttaaaaatttaaaatagagcg

SEQ ID NO: 34980 - DNA, 905 bp, Heterodera glycines
  misc_feature (830)..(830): n is a, c, g, or t
  misc_feature (840)..(840): n is a, c, g, or t
  misc_feature (884)..(884): n is a, c, g, or t
attcactgaagagttatttcatttaaaatattaaatgcttgaatgatgattacgaaatcaacatgtactatttctgtaatatattttactcggagtctatgcaatcatttggttcgtctgtgttacatattgaaaacatgttttgaattttgaaattaattataacatatattctaagagaatttttaggaataagctatatttttttctcttttcattatttaaatattattttaattattccgttttatcattttcgttaaataacccactttcaaatttctctgtttaaaaccacgaccccacatcgtcaatcaattcttaacatttttatgaaagtttatatattaatctaattgcttatttgttttttatgcaatacttatggccattaaaaaaacaatttatgtaactttaattttaaataatattatacagattatttgttttaaaatattttttttcttactagacaacatttttctattaaatacaattttcaatttggtataaatttattatcattttttaattaaatttatattaatataaactatgtttattttttaattaactatatacaataaatgtgatttgagagtttaggaaaattcaagctcacttatgtggtttcatgaccaaaatgcttcatcctatttttactattaaacttttaagaaaatttgccttaatggtctcgaatgtctattttccgtgatgaagttatattcatagggcgttggaaaaatacatgttgctctctattttgagctattatgtagataaatttgctttcgctatttgaaaaaaatggtttcgaaattccgaanattgcaccanaaattcaagtacgatataaatagaaaacggaccttgaaggcaantttaggaagtgtcgtgccttc

SEQ ID NO: 34981 - DNA, 1815 bp, Heterodera glycines
  misc_feature (41)..(41): n is a, c, g, or t
  misc_feature (50)..(50): n is a, c, g, or t
  misc_feature (88)..(88): n is a, c, g, or t
  misc_feature (139)..(139): n is a, c, g, or t
  misc_feature (145)..(145): n is a, c, g, or t
  misc_feature (160)..(160): n is a, c, g, or t
attaagcaaaataagactttggatataatcgcttcaaaaantatcattanaatctaaatttctctctgaatccaaaaaataagactanaataaggacaaagagcttaaataaggacaaatctacaaaataagaacattnaaaatntgtaagattgacccntaaaaataaggacaaatcttacaaataaggaaggacaaatggtaaccctggtctaaaatggatcaaattttataatcttagtattttcgatagctctaagtgttttctattatcctgcaaaatttctaaaaaattctttaagtttaaaaaaagttatgacctgagaagctcaaaaaaccatgtttttttgaacattttcagtcataactttcttgaaacttaacgaaactttttgaaattttgtaggctaatagaaaacacttagtgctatttaatgatatcaagaattaaaaatttagatgctcttgaacaaagttatatcaaaaaatattttcatttgatggttttttgactaacgtcatagcacccattgcatccctagtaatgaattctctaatatgcaaccacgcgaaaacggtcctcacgcaaaaaaggccacgcgaaaacgaccccgaccgaggtatttgttaggacgataattcgtagattaattcttaactaaataataaaattctctatttttttctttctttctctctctctctctctcttcactcccccctctctctccctctctctccctctctctctctctctttctttttctatctctctctcagttggtcttactgcactaaaatggtcaaaaaattatcgattggtttattcattttttttttgttccaatctcttcaatattaatccgccggattaccttcgtccttttttgctgcgtcatttaacttctcttttctgttaatttaccatcagcggaagacaaatacattttattttgcagaattacgatttcgaattttttgttagagttgccaaatatttttttcctttttgatagagtccgttaaaaaaaatttccgggagcgtgatcgggaatcccgttaaaatcccgctgaaattttacgggagtcccgggcgggagcgagagttaattaaagactaacaaaaatatttttaatgcacaaatttgaaggacaatcctttattaaagaaaaaatagacagaaaaatttagtaagcagaaatttgaaattaaaaaatcatatttttgtgtcaaaaatcagaaatttttcaaatttcttcaaataaaattttttaataatttatttgttgactcccttcaatagagccaaaaaataatcaaaccaatataatttttaccaacaaacggtaaaaaataaaccggatttaagatttaccaaatttctaattcgcataaaataatgccgcgaaattcacatgcaattggcatcgatcttggcacgagcgcttctcgtgtcggcgtttttcgaaatggatacttcgcgtcgatccacaatgaccgaggtgataaaaagaacattttggccatttttgagtaaaacaaaggcagtgccgaatatgttttaatttctttatattttcaaaatttctttcaataaatttctttttttttcgtttcgagggttgggagatggcctacccaatttcctaatctttttttcattacgggaggttcaggagtttctcccattcccctgaagggcctaaccaaattttttcattttgtaaattgaggaaagcgtatgacgccatcttacgttgcgttcactgacagcggacctttggtcggagaagcggcaaaagcacaggcaaaaa

SEQ ID NO: 34982 - DNA, 1065 bp, Heterodera glycines
  misc_feature (978)..(979): n is a, c, g, or t
atttcctttcagtttgggttcacacacaccaaaaccggcttaatgtttttcctttgtgacggctcttactgtttgaccgccactctgtggggcgttctgttggaccgatggaattgcaacaattttctgatgtttttcggctcatccgccaccattgtttcattggttctgtttggagttgttgaaaagtatgtttttccatttcctcttaatcaaaattactccaattttcacttcccattttcactgattaggcgtctcgaatggatttgcatttccttggccattcttggcattgcctccggcgccctttacatcccctcgtttcagcagtgtttggacgttgtcaagtcatttgtctcatttaaaatgttgttcttccgaaactaaactcttttcaggaagaggggttacgacgattcatttcaaacgtacggatgcgtttccggacttattcaatcctcctacgcattggggtgactaaataaatttctggtttcattatacctctgacaatgtgtttttcctttgtttagtggttttatgggtccgactgtcctcggcggttggggctgtcaaaagtttggcctacgttcgatcgtgttatccatcgtggtcatcaatctcatttttgtcagtttttttgaaaatcaatttgcgcaatcattcaattctttttttcagatttttgcgcttctctcttttctcactgcaaaacgttgttgtactgctacaacatattttgtagacgaggctcacatcatcaaagaaagcagcagaacttcacttgaaacactttgagcattcattccttttttctctttattaattgctattgtctttgatttaattgttaataaaaacggtaattatggcaccgaaaagaatgttatttcggttcgcctaattctgtacccctcatccaaagcggtacaccccaaaacgtcgtcataccaaaaattctgaaaaatttactannatttaagtttttgaaagaaaatttccggaaaatacttggaatttggtccccccccccccctaaaaaaaatttcaaaaaaatttttt

SEQ ID NO: 34983 - DNA, 984 bp, Heterodera glycines
tttcgaatcttaattttttctcgtcaaaattgacattctttggagcgaactttgatcaaacaccgatcattgatacggtgatgtacagatgccagactgcgccgggcgccacctttcagacttcttttgtcgggaagtccagttcggtcaacggtggtcacagtaactgtgaacggctcgccccagagggtcacattttgctgctgtttgctttgcgccactttattgaattgattaaggatggtgtccaccgtgttgttagtgatttgacgaatgggggtgggtatgtcaccgccggtcaacagagggctgctgatcaaacatccaatatgggttggtttgattccacgctcttgactatccgtaatggcctcatcaatgcagaattgaaaaatgcctgcaagcagcccttctggattcgttgggacgtcctcgatgctgaacttagatttggccttgacgtattggaaccgtggcacatgctccacactgttttccaactttttgacgaaatcctttgcagatttagccgatgacgttccagctcccgcttgaacaccatgacgtggcttttttgcaggaatggacagaatataatcaatggaaaattttgaggggcactgaaggttgcgattttccatttttaaatctaataaaaatccataaatattttttaaatattattttaatgataaatatgcagcgaaaaggagtatttatatgagcaatactcatcaaaaacacaattggtcatgaaaaatatatgagaaaaatgcacaattatttgaataattgattttttaaaaaaagacaatgtcaacccatcttggcctgatgagcagcgcactgccacccatgaagcacaagacgacagggcacctaaacggctcaggaaattagatatgtctaaagcatgacctcaaggtctaaaagacaaataagaaaattgtgctgccaggataaacggagctctgtatgtcgaac

SEQ ID NO: 34984 - DNA, 862 bp, Heterodera glycines
ttggcttttcaggttttgacattttaccgtttcaatattagttcaatgggtctattaaaaaattggcatgatattattttttatccaatgaggattatattatccaaatgctttcagcccggagacacagtccgcttcaagcgacaaaaagtaaacaagcatgatgatgcatttgtcaaattggaatttgattcgttttttgcttcctttttggttcatttttatgttctaacctgtttattgtttttatgttttccttggtttatgggtttatttttctgtttacaatggtggtacaaatgtacaatcactttgcattgcattgaacgctttcagcctggggacgctgtccgtttcctgcaacaaaaagatggtcgaggtcctcagattgtgcacgacctggtcaaagaaaaggactacaaactggaggtggtccgtgagaagacaaagaacggcacaatcgcatggaaagtcaaagtgaacatggtgtttgcaccagaaacaaatgaacggctgcgaaaaatgaaggaaattgatgaggtttgttacaaggtttctaaaatgagggattttttgcgattgaaccccaaattacggagatcaattcattgaatattttgaaaatgggtcacattccgagggcgtattcagccatatttttgaaaaatgtccccaaaatggcaaaaaatagtcatttaagcgaaaaacagctataaatccggccaaaacacccgcccccccccccctctcccgaagccaagggtttaatccaactaaatttattgcatttataatttgttgtttttagaaggtacaaggattggcttttacggacaattttaatgaagtgctctgctttctt

SEQ ID NO: 34985 - DNA, 831 bp, Heterodera glycines
cctccctctctctctgtgtctctctcatgcctctctcccttatccctctctcttcccccccctcctctctcaccatccctctctcttccccccacaccctctctctctctctctcctctctttctttccaccctctctctcgcttctctctaccccccccctccgccctttctctctctcacctccctctctctctgtgtctctctcatgcctctctctcaccatccctctctcttccccccacaccctcctctctctctctcctctctttctttccaccctctctctcgcctctctctacccccccccccctccgacgtttctctctctcaactccgtgcatctttgagatttactcatggcatatgcatcaccatacgtctctcttcgccgttcatcaatgtaaatgatgcacgcttgtggatgaaattgatagtgttgatcgacggaagtaattatataggatcatgaaggaaaaagctgcaaaaacctcttgtaagataatatttggtaaaaatggaatattttttaaatttttatttgaagacaccaaaatgtagatcaaaagatgcctattattcatttataactgtctgagcatgggaatgcacaaagtaacataaattaaaattgaagaattcgagactgtaggcgattgaaaaaaataggtgagagagtttatcagctatttgacatattgcctttttgcagtaaagatcatcattttacaggtagtagataaaatagaaaaatgctagtgaaattatccataatgaaaatgctgttttcattaaaagaaagatagaattttcctcattattctttaatgag

SEQ ID NO: 34986 - DNA, 906 bp, Heterodera glycines
cggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgggggggaaggcccaccacgaggccgcgaagcggccgagtgagtaccttcggtgcaggaaaattattaaggaagagagttcattatttatttgttttttgcataattaattcataaatatttttttcagaaagggctctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaaatttttaatttcctttttaaacag

SEQ ID NO: 34987 - DNA, 757 bp, Heterodera glycines
ttaataaataattttaaaaatgataaattaaaaaactacgctaaattaatttacgtcattagcaagctaaaaaaaatatacagaaaaaatcaaattatttattttagtaattaatttcattcataatttaaaaacaattgaaattaaaaataataataataaaatttcaccttcaattcctgcaaaaatgatttgataaatcccgtaagtgtccttgcatgaagtcccttcaaaacagtagctgaccgtaatttttcaaaatcatcgaacattgccaaaattgtcggatcagacctaaaagatcaagtatcaaccttaatatcctcaaatactggaattgtacttaaatttaagaagataaaaaaaatgtgtcggcatgataattttgaaatattagcaaaatttttttttgaaaattaacccattttcttaaaaaaaaaacattttttaaggggcgatgctaagcagttttgcagtcctggagaagtctctaatttaggaattttgcgctacaaaatttgcagtacaaaaatttaaggacataaaataaggacaatttgcccaccaagcaggcttctcatgctcatacacagcaatgccatttttctcatcagattcaatcgcgtaaacacaacggatcagctgggccggtactttgggatttgttgccggacaaaaatccgcaagacgaaatttttgtgctggaaattgtaattaatttaaaaaattggaggagggggggggggggggggggggg

SEQ ID NO: 34988 - DNA, 926 bp, Heterodera glycines
  misc_feature (42)..(42): n is a, c, g, or t
cgcgatgtttggatgggtgagattaaatttaaaatttttttntaatttttgtatatttgcttcgctttatccatgcacagaagccaatccattggcgcatgcattcagggaagatgtggcaccggttacacatgcacaaccggcaatatttgttgcccgtctcaattgaaccgtaaattttgtgaaatatttactgtatcacaatataaattttaattttaaccggccagaatcattaaaactaattacaaattacactaaattttgccttgggccatttcaagtttttgagaaaaattcaatttcaatttttgcgccttcgaattatttaatttaattaaaaaaaattacctatcaattaaaaattttaaagtttgccctcctggccaaacatcggttggccaagcagtgaacggccgatgtcccgccggctacacaaatttcaatggccaatgctgtggtccgcagagtgcgcaaagtcaagtgtcctgttccgtcgaagattcttttggttggaagaaatttttgaaaatttcaaatttcataaaaatttaaattttatgaaaaatataggacgttgtgatagcaatcaacaatgtgccgagccgggctatgcttgtgatgttgccaacaattggtgctgtcctcaagtgatcggcgacgcgattggcccatgcattcagggcgaagggggcaatcggttgtgccctgagggtaataatgtgtatcacttttaatgagagccagtttctattgaaaagagtcgaaacttgaccccgagaccgggtctcgaccacgagacctagacgtacccgactataagaaactataagaattgaaaccaggatcgcaagaactcgagacttttctcgagtcagactcaagactgagactttttgttcaatgaattttttcttgtatattaa

SEQ ID NO: 34989 - DNA, 684 bp, Heterodera glycines
tgcatattattctctttgttaaatttttaaaatattccattgaacctccccctaatggtctctcatttccctccctccaattgtctctctctcttcatttactccccccccccccactctctaatgggcctttctcccccattattctctccgtccgtcgcttacctttccattcggcccccgggcgatctccaaaattctcgcggaaagaaaataatcggcggaggatggtaatgaccacccgacaattcattcaccatttaaatggaggagttttggactattttatttagggatgaccaaaaggttaattgtcatggcattttgtgaggggggggggggatcattgacaaagggagggaaaaggaattaattttggtaggaaaaaagagtgaaagagaaggaagaaaagctggacaaaagtgcggaaattggaaaatactgaccaaaaagttagaacggagcagctgtccgatcgaatttattcattccgaacacttttcccattcgaacaattgaaaagtgagcgaaaggaacggacgaaacgaacactcatccgcccctttcttccctccccccgcgccacccatccgccgatcgcatcacagggaaatgacccacaaaaatatatttgttggattccgaacttcactttgacattttgcgcataaatttccaagagaa

SEQ ID NO: 34990 - DNA, 941 bp, Heterodera glycines
ctcccttctccccaggggtatttttttgtagaatttttttttcccccatatacttttcataccccattttcgccccgtgaatgttattttattgaattctgatccgttttgagtagattagactagaaaaaattaaaaattttgaaatcatgtttccctctcccttctcccaggggtattattttgtaaagtcttttttccgcaataaacttgtcaatccccatttttcgcaccgtgaatgttatttttattgaattctgagccgttttgagtagattagactagaaaaaattgaaaattttgaaatcatgtttcccactcccttctcccaggggtattattttgtaaaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaaagtctttttttcaaaataaacttttcaaaccccatttttcgcaccgtgaatgttatttttattgaattctgaaccggtttgagtagattagactagaaaaaattgaaaatttcgaaatcatgtttcccactcccttctcccaggggtattattttgtaaaagtctttttttccccaataaacttgtcaaaccccatttttcgcaccgtgaatgttatttttattgaatagagaaccgttttgagtagattagactaaaaaaatatgagt

SEQ ID NO: 34991 - DNA, 693 bp, Heterodera glycines
ataatattttaaaaaaagctgaatattaggagggggaatcttttgcaaaactaactcacattgtttgttagaagtagtgaacattttttcgacaagatctgttaacaaataccatttaaattacaaaaaataaagaatcgcaaaaatttggctgtttttagtgtaaatatgttaacaaattgcactgaattttcaaaaaatttccggcggcgcctaccggcaccaccggaccccccccccacaaaaaaatttgtttttttttgaaaaaagcgcaccgcaaaaaaaagcggtattaaaccgcaaaaaaaaggtcgtcaatttcatggctggaccatttcgcaaaattggccgctgcccccccctcccccccacttccttccagaccatttcgcacaaattttggttgatggcaatttttaatcactgtaacaatggacttaaaattaacctcaaattttattgccatttctcagcatttggcgttcgttccgcttcgtctccgccaattcccaaattgtcaccgccacgtaacgtggcggacgctcagcttttggatttgttgggcagtgttcaaccaatgcgcgacgccaatcgccctgccgcgcccccgccgaagaaaaattcgtggtgtaaagtgagacggagtaaaaagcggcagagagtggggggggggggcaaattaggaaaaaataa

SEQ ID NO: 34992 - DNA, 510 bp, Heterodera glycines
attacaaggccatgtcccacggggcaatgctttcgctgagtatcgtcactttcgttgaattgggcccattcgtaagggcactgaccaaaagggcgaaccgttacaattccgctcgcattttgcacattctgaccagcaaacccgtgattttggccgagccaaagcttttcgagcagtacaactcggctttttctgaaagaaaccgttttgggttcaacgcgagtcagttgctcaattacctttattatcggctgcttttggaataccgaaatttcatcccggtcagttcagtactgagtgataacttacaattagaaaccaatttgatcattttccgaacattcagggccaaaatggcggagatggaatgaaaaatgatggacaacaacagaaccaaatgcatgaacattctgatgaattgaaaggattcaaagcgacagaaatgatcagaccgattgagggggaggaaaagcgggggacggggagaacggacggggaggagggggaggg

SEQ ID NO: 34993 - DNA, 992 bp, Heterodera glycines
  misc_feature (954)..(954): n is a, c, g, or t
aaaataaaattcagcaaaattttattcgaaactctcagcaaacatttccaaaatgtgaactatgacgaaaagcgtcaattgctttcgtttcccctgtcaacgggcgaactcattatcacgcgattcagtgaactaattaggcaaaaacggttggtggttatatgcacaataataaacattaaaaataaacgggttttatattttgttcaagagtatttggcaaaatgtctggttctataaaatgggtcttcggactcaaattttgttttttacgcttaagagttgaagccttatacgaatatagtaaacggatcatagtccaaaaaaaggatttaaacctagaagatatggataagaattacacataattatggttttttgggagcgtaaattacggattacggatttgttttagtcacacaatacaaaagcataaatttgctggacttagaagacaaattgatgttatgaaaaccattcaaaacattgtttcaatggagcccattcatttttataagcgaaaattgactttgtcttcggatggatgcatatatttcgacttatttttatccatggcaattcgtttgagtgcacaaattgagcgcaacgattgtttcaacgcattattatttggcggccccccaacatattaccaaaggtattagtacgtaaaaaataaatatctttttataacaaaaattaattttcattttgggaaataccctaaaacattgttattatagcattattttagctttttcgattataaaatacaaatcacaaatggcaatttggtttcctatcgacaaaatatgatccacatatatattttttttaatgatacatattttatcaattaaaaaaaatccgtataattgttgagcctattaatcccgaaaaccagtcttttttgttgaaaatctgttaacaaattacactcaaattttcaaattnttcccgggcggcgcctatcggcaccgccggaccccctt

SEQ ID NO: 34994 - DNA, 1106 bp, Heterodera glycines
ttttcaaaccccctttttcgcaccgtgaaatgttatttttattgaattctgacccggttggagtagattagactagaaaaaatgaaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaacccggtttgagtagattagactagaaaaaaatgaaaaattttgaatcattgtttccactcccttttcccaggggtattattttgaacatctttttt

SEQ ID NO: 34995 - DNA, 752 bp, Heterodera glycines
tttcctgacgacgaaacgaattaatcgaaaatgccgctccttgtatgcatttcgcgttaaaatatttaacttgttacatcgtattttatttgcactgttcccccaaattcacctgccgcagaagtgcgaattcgttacgcaatttgttcccgagacgcaataaccctcgacgattttaagcataagtgcgtcttcctgctcttcggcagaaacttaacatggaaattgccgttccattctttcgattggtctctttggcattacgtcctttgcgcattttgacgggcattgccctgccgaagtttggcagccattccgcacgatggggagggaacgggcggagagaccaaccggaaaagggcttacacagagcgggtggagagggaccatcacacgcaatggaatttcccaagaaatcatcgccttaaaataatgtcttatgggaatcttgacagaaaaactatttgggtgtgcattacgtttccccgcttcccgggaaaaatttaaaaaacttaaaaattttccaaaaaaagatcttatggttaataaattttaattccctgctgttgaatatggatgtgttggaataccacgaattaccactgccgaaatgtttgatgaaaagacggtaaatttttatgttattgccgattgggatttttccaagaaacaatcactgaccgcaaaatatgattttacagagaatcggttataaaattgtccattctctcagctcttaaagccatggttgt

SEQ ID NO: 34996 - DNA, 409 bp, Heterodera glycines
aaaaaaaaaaaagaaaggaggggggggggggtggttttttttttttttttataaaaaaaaaaaaagaaaaagaagaggaggcccccccccccccccccccccctccccctctttcttttttataaaaaaaaaaaaaaaaaaaagaaaaaaaaaaaagtagtgcggcccccaccccccgccccacccccccaaaaaaaaataccccccccccccccccccaaaaaaaagaaagagggggggggggggggtggggtgggtttttttgttttattatttttacaaaaaaaaaaaaaaaaaaaaaaaaagagagaaaaaaaaaaaaaaatttttttttttttttttttttttttttttttttttttttttggagaaagaaaaagaaaatattttttttttttttttttttttt

SEQ ID NO: 34997 - DNA, 581 bp, Heterodera glycines
gaaagagagagagagagagagagagagagagagagagagagagagagagagagaaacagacggagaaagagggaagagagagggagagataaaaagagaaagagagagagagagagagagagagagagagagagagagagcagagaaacagacggagaaagagggaagagagagggagagataaaaagagaaagagagagaggaaagagaaagcgattaattacataatgaccgatggatgatcagaaattgacacgaaaaatggggttaaagaacactacaaccacgactttaaattgggcgaaaatgtatttattactcgtggcgtcacaacatttttcttcgtcatcaaaaagttggtttgattttggatttattatcgccgcacctttttttaatgaccaccaaaaaagagcagaaatagttgtaattaacaaaaagtgattactaataattaataattgaggaggcggatgcgaatttgttgaacaatatttaaaactgtgccagacaaactacagctgagggtaagcttacccttacctcgctctttttctcggcgtccctgatagagattgaaa

SEQ ID NO: 34998 - DNA, 1061 bp, Heterodera glycines
ttaatggaattactggtcttcgtgtaactgagaatacggtgtcgagccgagataacatcgggacggggggaaggaattaaggctaattagtgatcttggtgctactcgtgaatactgtatcgaaccgagaaaataccgtagttttaggtatcgatatcaaattttgggtttttttgttttatcgaaaacgattatttttttctaacttctaaaaataggttttcttgaggccgtacatacccaaattgacgaatttgattttttgttggccttatcagtgtcataaaatgcagccataaattatttcacgaaccaattcttccaacagtctgttactgttggtggcgccgtgcattggtcggattggcattggacgtgcaattccatcgtcgtcattagctgcttctccgtcggcacttttcggtcttggcaccatagttgatgcgttggtcgtagtcgtgccacgacgatgctcaacaatgatcggtggccggaacacggcatcgttgctgatggtaatggcacttaaattgttggcaccagttggcggctgattggcatggcgttgttggtgatcagtgagtgttattgttgctgacattggcacgagtgttctgaaacaaattttaaaaattactgacaccgataaaatgacatagaaacgagactagtaaaataggttaaaaaaaattacggtaatataaattaaaaataattttattatttttagccgatagaaaaacccaaaattttagttattcttattttggaaaatgcttttgaacgccttgagtataacgttttatttatttttaattcttttttttttaatttataacattcggatatcccacaaaagaggtgtacaaaaattagtgggaaatttttattttatttttttccctcggaccttgcgagcttggtcaagaaacaccgggtcgttctatggccttgggtcaggttgggccaccaaactcttgcgccctaatgccatcactaataatcaccacgcttttataaacataggaaaataaataattgtttaaaaatttaattttcaa

SEQ ID NO: 34999 - DNA, 1209 bp, Heterodera glycines
  misc_feature (88)..(88): n is a, c, g, or t
  misc_feature (144)..(144): n is a, c, g, or t
  misc_feature (155)..(156): n is a, c, g, or t
  misc_feature (162)..(163): n is a, c, g, or t
  misc_feature (169)..(169): n is a, c, g, or t
  misc_feature (327)..(327): n is a, c, g, or t
  misc_feature (332)..(332): n is a, c, g, or t
tgtgtttcgagtttgccatttttttgtaaataaactgacaaaaaatgagacaatcaaaaaaaaggaaagaaagtttataaaattttanaaacacttcttatgctttcgtttttttttactattatttgccacttttttagttcnatgtgccaatnntgtgtnnccgcgnatgcacagcgagcatgggacgctgcaattgcactgtttgagcgtgccggtgcccgtgttcgtaaagtgagcatgccgcactgcccgttgtccatccgagtctatgccattctgactgatcgggatgtggcctcgaatatggccaggtgtgccagtttnaaatntaaaaagaattaaattgaattgcataattttagacaaaaaaataaaatataaaaaatcaaaaaatcattccgttgcggggaatcgaaccccggccttgtgagtgagagtcacaaatcctaaccactagaccacaacggatatgttttggttgcccatgtcagttaattaaatacaatatttttacgctcgattttgctgataaattaaatgttctttcccgtttacaaaattttaaatccattttttgttgcccaaatcatcagctggtaaactaagaatttcctccttttttcgttcagatatgatggcatccgatttggccacaacgacgccgttgatttggacgtttcctttgccgaacaaatcgccgccagtcgaaccgaaacacttggccaaaatgtgaagcgtcgcatttttgctggcaattattttgggcttcgcgagtgagttttgtcaaccagttttttttttaatttccattttctatgactcatttataattctttttttttccaaattttgccttttctgattggcaattttcattttttgatcactttcctttgtcatttcatttaaaaatcactttccaccgtaatatattacagtatcatccgcccttaacgtaatcatttttattgtctgctcataatttcccatcatttccctttctctaaattcgtttttctgctgatcactttccaccatttctattacagtaccctgtgccataccgtaatcccttgaacttatcacttccagcatatttctcatactgtgtctccctccgcccatataccgtaacccctctgatcatttctctcccccctttcctccccagaaactatgaccaatttgtgggccaagcgatgcgcg

SEQ ID NO: 35000 - DNA, 879 bp, Heterodera glycines
  misc_feature (820)..(820): n is a, c, g, or t
ttcctaatgggattagcgcctttttcgtccctttccccctcaccttccattggctcctctttctctcttctttctctgttcgcactaattaaatctttccgcaacatttccacgggtattgccaaattgttctttttcctttgcctttttcaccaattctctccctcttcttcttcttcttcttctttttcttcttcctccgtcccttccctttttctttacttttcatagttccctttggctatgattcctttgcttatcggtcggcacataaatgtgttcgttcgattgggaagtgaccccgaaagtgctcttctgctaagaaccgatggatgccttcgcccggcactttccatctttttgtccctcccttccccctccttctgctgctgctattgctacgccggtcatttgtccacccctaagggattgatggtgcccctggggaacgaccgatgaagggccaactcattggaaagttccaaaaactgacatttccgtcccccgtgtcggggggggggggggggggggagagactcaacgattgttccaatttactctttgcctcagttttattccattgtccaaaatttgctcctctccacgacttcttccgatgcaaaagtcatttcagcaaatggttgccattctctgctgccgagggatggatttgtaaaaacatttggcaatgaaaagcagcgaatgtactgagttgatacggaattaagctgagcaaacgaagaaagaaaagaccaaagatcggacaaattgggaaaaatccgaggcatccgccaattctccgaaaggcattttcgattanacgactattccttattatttttattcaaattattattcttttgaatcgtcaaaatcgga

SEQ ID NO: 35001 - DNA, 1004 bp, Heterodera glycines
  misc_feature (912)..(912): n is a, c, g, or t
ttttggtttggttttagctttagttatttttaatttacttttttggcttattttttcaattaagctattaaaacacaattaattttatttgcatttttgtttatttgaaaaataatcaataaataatggtttatttttcaaataattatttaaattatatatataatattttctttgcttttaaaaatttcaatttgtaaaataataatttttccaattttttattaccaatttttcggcccaatttcagcacattgccatgactgagttgccccatttggtgatggatttgcacgttcgactgccgaacagcttcaaatgtccggacgcatgttttattttgtccggctttgtcgacgctttgtcgttccgcgaattgtttccgcattgtgccaccgacgaatttatgcgccgggcagagaatgccaaaatcaaaacaataggacacagatcaaagcaacaaagtgccacgtccgacgatagtgatgacgaacaaggacaaatggacaacccatgggtcggctttttggtcgaaaacccaaacggaaccaaattcgagctgaaattgcactactcaccttcgaactatgacaaatggtcgaaaatggtgatccgacaattggccgacgacgaccatcagcaggcggcaaaagaattggacgaaaatgccgaaaattatgatgttagtagctaacccttttatttactttttgattttgttattgtattttcagaaatgcatttgcttttgcttttataaataaataaaaatcatgtatatgtacttctcaaaaacggaccaatgataaaatgaatttaaatcaaaatttgatttgtgaaatgaccgaaaagtaaattagcaaaattatggacaaaaactggcgaaatcttgttcaattttaaatagcgaanatatatttttctaattgatacaaaaagaaaaataattttccttatttttttattcccaaataaatattaataattacaaaataataaaaatg

SEQ ID NO: 35002 - DNA, 882 bp, Heterodera glycines
tcatctctgatctattattggtttctttttatatttacctcctgagagaataattaatttaaattattttatttatcatttctttttttgaaaactcaccgcgtcagccatgctatgtattggcatgttcaaaacgatattataaatgtgttcggcatttgctgctgttgatgaggatactgataacgaagcaggtggtggtgataatggcgatgatgaaaataacggtgaaaatgccgatgccgatgataatgaagataatgccggcgacgatgttaatgattccgactgatctgctcttgccaatgaagatgatcccgactgatttccccgtgcccctcttccaccactgttggcatttctctgtgcattttgttcaatcgttttaaatttattttccatcatttcgtcaaactttgcctgtggtgactcttccatttttgccttttgcttcccttttccttttgttttgtcttccgaatttgctttataagcatttatttcctcctcgtttggcagaattaagcccatttcttcccattcttttgcattttcttccgccaatttcgagccgtgacaaaatttaaaaatgtttgccaatctttccataacttggacaaatgtcagacgaatttcaccattttttgtcctaaaagatggctttttggtcggaatctcagcataaatatcggaaaaatgttggtacaaaatgcccaaatatttgcggtattcttcacaatgagtcatgccaaaccatccaacacaatgccaattctgtttcatatagtgcaaaatgccaagatgggtgtcataaatttggaccagtaaattcttgctttgccttgtctgtgacttcattttgtgtacaaatttgctcaaaat

SEQ ID NO: 35003 - DNA, 1197 bp, Heterodera glycines
tccacttcaccggataacattccttacattttattaaaaaattgtgctgagccaattacaaaaatattagctgacatatttcgacttgctttggattccggtcaaattccggaaatatggcgaacatcattagtggtaccaattttcaaaaaaggcgaaaaactgatccattaaattacagaccggtgtcattaaccagcactgtctgtagagtttttgaacgaattttaagtagcaaaattttagaatttctgaacggtataagattttttgataaaaaacaatcgggtttttaaaaaataggtcgactacaacccaaatattaaaaacaatggacgatataataattctctacaaaaggatcaacaaattgacattatctatattgattttgtcaaggcgtttgattctgtaccaattgatttattacttcaaaaaatcaaaaagattggaattgaaggaaaaatttataaatttttaactaactttttaaaaaatcggagttttaaggttaaaatcggcgaagtattgtcagaaagtttcagaatattttcaggagtgccccagggaagtgtcttagggccattactctttttaatttttataaatgatcagccgtccgttattacaaatgaagcggcatcagttggcataaaaaagtatgccgatgatgttaaattatattatgccaatgaaaatgatgaccattcgaatcagttggataaagcaattgaggctttggaaaatggtcaaaaataaatgggttagaaatttcaactgggaaatgttttgttctttatttagggaaaaataatatgaaaaaagattatttaattaactcaaaaaagatttcagaatcggataatgttcgtgacctaggcattataattgactcgaaactgcatttttcagaacatattaacaaaattgtacgaaacgcttatcttagagttttccagattttaagagtcttaaaaaccagggaaataaagactctaacaacagcttgtaaaacttttgtccgacctcaattagaatacgctaccgaagtgtggaacccaaatttaaaaaaagatatagacaaaattgaacgggtacaaaaatttttcacaagaaaagcttttcgaaaatgtggatttgtgtacaaaaaatatatggaaagactaaaaatcactgatttacacaaattagaagaaa

SEQ ID NO: 35004 - DNA, 1085 bp, Heterodera glycines
  misc_feature (17)..(17): n is a, c, g, or t
aattcaataaaaataancattcacggtgcgaaaaatggggcttatacaagtttattgggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagacttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggattgaaaagtttattggggaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattgtggaaaaaagactttacaaaataatacccctgggagaagggagtgggaaacatgatttcacaattttcaattttttttagtctaatctactcaaaccggttcagaattcaataaaaataacttcacggtgcgaaaaatgtgggtttgacaagttattggggaaaaaagatttaaaaaatatcccctgggaaaaggagggggaaaattgtttcaaaatttttattttttttagctaatttattcaaaagggtccaatattaaaaaaaaaactttcccgggggaaaaagggggttgaaaagttattggggaaaaaaaaatttaaaaaaaaaacccccggggaaaaagggggggggaaaaatgttttcaaaattttttttttttttttattc

SEQ ID NO: 35005 - DNA, 1523 bp, Heterodera glycines
gatgaggtcgatgagccggaagtagaggggatgcgctaatcaatagggattttcatcatcatcttgtgtttttgataagttctatgaggacttttgcgtattattgaatcttctgtgggagacatcagaatgttaaattttatgattaatattcgctaatcgtattatttttgacaatcatttaattgaggttattaatacacccggaatccaaaatctcaaacaaaattttcaaaaatttcatagccagaaagaaattccattcttttctgaaaaacgaaaaattacaaaaagtacaatttcctaggggttatcattttttggtaaaaacttagttttttattgatttaaaaaaactcccctaacctagaagccattacactttcgaaaaaaataatcgaataatgggagcgacacaccctctaaaggattgttagatataggagaacaatgtaggttttggtgacgcggttaattctccctccttcaccgtacatctattataatggggggttgcgtcccatccttctcaatcaataaatcggagagtacgatgttgggccggtggtggtaccgatgccaaaaatgatgatatttgttcatctcctggtgatatcaaaaaaacagatgagtacgaagcctgcgctggtgaaggaagtggtggtggtggcggagctggtggtggtggtggtgccaatgccaaaaatggcgattgttgttgttgttgttgtggtggtgccaatgataatgatgatgatgatggtggtggtggtggtggtggtggtggtggtggtgccgatgccaaaaatggtgattgttgttgttgttgttgttgttgtggggatgccgatgataatgatgatgatggtggtgatttttgttgtggttgcacagttgccgcagcaacgacagatttaaatagagcatcagcagaaatttcagtgggggcgaaggcatgtgatgttgtgagaaactggttgtccttttgtcgcaatgtcgcagccgtttgtagaccgtattgttcctgtacagagaatgccaatcctcggtcgaacaactccacggtaccgcttgaagacggaagatccatccttgtgtgttttgcgataggcacaacagggaaaatatccgcaatgttgacgctgccatttgtcgattcgtcaaaaccgtgaatttttagggagccgttattattttgaacaatactaaaattgatcgtatttatcattatgactagggcttatatttatttgaatatttttaacagttttcatttttgtgagaatttccacaataactcgtttttggtcggaactatcttctttttaacgttaatattcgtaaatacaaaaattttttgtacttttataaataaaatgttgtaaaaaatacagcgttaagaaaaactgttgaaaaaattcgaaactggtagaaaattttaaaaaattaaaattaaaaaagattttaaaatagccatatttaaatgtacgcgccaaatggacgtctatatggccctcgattct

SEQ ID NO: 35006 - DNA, 605 bp, Heterodera glycines
acgtaattaacagtaattttttaggggcggtgaccggtgagggggggggggggaacttccgccacttttgccatttatttttcgcccttttctttcgcactcagttccgagcagaaattcatgcagtttttttggtgttccttaatacgcactttcaattgcttttccttcccttcgcttttcacctgcactttgttcacttcttcttgcacccattgggccaccaaattcaccgtaaaatccttcggaaatggcaattaaaagaacacaatttggggagaaacaacccgttggaattccgaaagagattcgttgtagtcgagcacctgacaaagggaaagggtaaggacagcttatgttagcttgtcgagagtctcggcatttggtgaccgcaaattattgaaatggcaaaaaatttgctggcaaaacttactcgacgcgtgaaccatgacaaatattgggcactttggtgcaaattgtcggccgtcttcagcaatccctcggccgtgttcagtccgttccgcgttttctccgcctgaactgcaaaatgtgccgtaaatttcttttccgtcctttttcttctgctgctgctgctccgaattctc

SEQ ID NO: 35007 - DNA, 728 bp, Heterodera glycines
cgtttgctgaacgcacactccgccgttgagacagcgccgtggggcaatgcccacggggcacggcacggcattgggaggggaacttctgctaaattagggaaatgacactaaccactgattttaatgacaaaaatgaacagttacccgtcggccccaattgaacgcgtcattttcagcgtccgttggtaaaggttcgcccccggcacgcgtcccctgcggcgcgcttcgctgggccgagccaaagccgaacaatggaaaatgacggagtgatcagccgaagaaaagacagacgacgaattggacctgaataatatttaattggtttgcctcctctgctcattcccatcctttggcttcattcacttcgctttgtgcttttttgcccggtggtgccgtccctttttcaattgttccttttcgctgtgcctttgcttttgccaattcattttttgttcattcgattctttgcccaaaatgatgacgtcatccactgattgaccaatgggctttgtccgtcgatgccaaggcacaaagttgtaattcaggctgttaaaatggggtcaataacagttcgtacaatggagtttcgtacaataggtatttttataaaggcttagaataagcatcagctttcggattaagcttaggcttgagccatgcttagccctaagcttagggttgcttgggcttaggcctatgcttagtattaggctttattttggaaattt

SEQ ID NO: 35008 - DNA, 758 bp, Heterodera glycines
cccatttttgagattttaaaaatgatctatcgattaaattcaagatagttagactcaaataaactgatgggtctacttaaaaaagtggccaaattcaaccactgatttattggccaagaaaaggctaaaggtacaaaacaaattatggttttgtagagcaaagttgggactatctgacaagctgaaaaagagccaccaagaccgacggttatttttttaaagttgtcctgtcagaaaatgggtgctcaaaagtgccaagattcagcacccactttgtacaacattgttctgaaaggacctaataaaatgaaattgatgttttcatgggcaaaccaaacccggagaatccgaatatcgcctcagatttagtcagttgctgttctatgaccctgtactgcttcaacttcttgtcaacgacatggagcagtacaatgccagagaaaatcagagatcaaatctgaggccagatttggattctccggacttgatttggccacaaaaactgcttttaataaatttccaactgatcaaagcaaagttttgacccgtacaataaaagtgatcgggttttgatttttgaggattctattcaaaaatttctaaaaaatccaaaatgaggtggaaaaattaaaatggccattttttcgaaaccgcagacatttctttacaaaatgcaaatgagattgggccggggaagcaacggagacattttttaaaaattcacaaaaaaatcaattcacagctatgacagaacttat

SEQ ID NO: 35009 - DNA, 1237 bp, Heterodera glycines
ttttcggcgcccgccactgttgcggatgttcggcgtgccgctcagtacgcccaaaaaagacgtcccttcgaacgtggagtgttttggtcgcccccccccctcctatctttccccgatttccaatcatgacctggatgggttgttgagacccatcgatggtgtttgctgatggtgaaggcaatttggccatgtccggtgagtcggcattctgttgttcgccgtcgttgtccaaaacaagaggggccgaatgagtgtcacgcggggaggcaggtggcatttcactgtgtggaatgtcagatgccagagaaaccgaatcggcatcgatgggaatggggacagcggcaaattttgggggggtttggtgggttttcggggacaattttaaaatgtgaaataatttgggagatgagaggggtcattttatttgatttttccattgctaaaggggtggaaaatgataaattaatgggaaatacgggaaggattagtgcgattgatgagttcatccacagcgcagcgaatttcggtgagctcagttgagttttggggactggagggatgaatgagtgggcgtctacggaacaatgtcggaaaaaacagtgaaataattttgaaaaaaaacatgaaaacaaggatgataaggcagcccaaaatggttaaaaggacggcggaaatttcgggctcatcctcaagaaaggatgccaatgagtccaatccaaaataaattgccgtagtggagaggagtgaaacggcagttttagcaaagggtttcccaactcggcggattgggaaggggattggtttaccctttccctttgggtgggcattggaaaactcgacctgaattaagcacagaaaaagagaaatgagaatcattgtattgggagcacggcctcgggagtgatcagtggtggctttaatgcgaggaccgggccggccgggtgtatggtgccgaggcggacggcggcactttgcacggcaacggcaccaccaacagatgaagaaaagtgccaaaaggaagaaaagtgccaaaaggataaaggaaagaaatccccaattagtggacggttcggattggtgccaatttggaagaaaaatattgagtgagaacaattcaagggagaaaatactgcccatttctaaacaaagaaaaaggaaatgaaaaattaaacaaaaaattgaagaaatgaaaagaaatgtgaggatgggcacccagccatgtgtttaaatattagaa

SEQ ID NO: 35010 - DNA, 595 bp, Heterodera glycines
attatgtaaataaaatatgcataaaaaatgctaaaaatatatatgaaatatgtacaaaaatccccaaatatgtactaaaatatgtaaataaaattttttaaatggtaattttttggataaaaattcttcgtaaaaaatgaaacaggcacaaaatgccataaaaatgaccaaaataggctagaatcacattttaatacttaaatactaatttttggtatctgtttttttttgaaaaaattcgattttttagggatacattttcaaaaaaatttttaatttttcacaaaaaatttctataaattctcaaatatgaaaaaaaatgaaaatatgtacgaaaaaatcgcaaaattttgaatttttttggggcatctaaaaaattttccttaaaaaatctcaaaaattgcaaaatatgtataaaaaatgcgaaaaagtccaaaatatgtatgtacatatgtaatatgtagaaaaaccccgaaatatgtaaataaaagtcccaacttttgttcgcaaacacaaaaaagaaagtgttttccccactaattaggctatggagaatccaggaaaaatatgtatttacataaaattagcagcccta

SEQ ID NO: 35011 - DNA, 998 bp, Heterodera glycines
aaattgaaaattttgaaatcatgtttcccactcccttctcccaagggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaccaataaacttttcaaaccccatttttcgcaccgtgaatgttatttttattgaattctgaaccgttttgagtagattagactagaaaacattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaagggtattattttgtaaagtctttttttccccaataaacttttcaaaccccatttttcgcaccgtgaatgttatttttattgaattctgaaccgttttgagtagattagactagaaaacattgaaaatttataaatcatgttttcccactcccttctcccaggggtattattctgtaaagtcttctttttccccaataaacttgtcaacccccatttttcgcaccgagaatgttatttttattgaattctgaaccggtttgagtagattaaaatagaaaaaattgaaaatttttgaaatcatgtttcccccctcccttccccccaagggtattattttggaaaaggctttttttttcccaaaaaaatttttcaaaccccctttttttcgaccccgggaatgttatttttttattgaatttcttgacccggtttagggaaaaataaaataaaaaaaaaattggaaaatttttgaaa

SEQ ID NO: 35012 - DNA, 488 bp, Heterodera glycines
cccgattttcactgtattttgggttgtctaggtcaccatgaaggagtgatctgatcaagttggtataaaagacgtttttgatcagcatcaaaagttttgtttgcttgaattatttcagatttttctgtgctttcaaattcgagattcaaaaagtggtgctaaagatatgaccgccccaaaaaagggagtgcagttgttcaaatggtttataaccaataataacaattatgaaagggttaatgattggtatcattagaaagcccacaaaaaatactacaagaaatgtataacatatatacacaatataatcaaattgagattttataatcaattttaaacaaatttgatatgaaattttaagtggttctaaagacatgaccatgactgtataagcaatgaaaatcatttaaataattagtttcctgcaatatcattaatataaattattacaactcccggctctggaaaaaccttcatgcaaaattaat

SEQ ID NO: 35013 - DNA, 1041 bp, Heterodera glycines
  misc_feature (736)..(736): n is a, c, g, or t
ttgtttcttccttcccattaatccaaataacaaaatctttatcgtcggttgcagtcacttcaatgtccattaattctttgacagggttttttaaagaatgacttggtgttggtattcctattttctgtttaaaatatttttgtcatttttttttggaatcattttttatttattataatttaattactccaacagcttcggacgtgaatgtgattttgcccagataaaattgcatttgcataacagtcgcaccgactagaaatggcaaaaatttagtcttaggtgttcagttcaaattaaaatggctggatttccggcccattataattctacaacaataaatcagggttagaattggtgttgaaaatgtgtgaggtttttttgggccagcaaggtcgggcggactgaccaaatttgagtatggttttcactagaggccggaattttgaattggccgggaccggggccgggagttgaaaaatggaccgggacgggatcccgggtccgggactcccggtttttcgggactcccggtcccggtcccaatttttgggccggggccccgccgggaccgggattttttcaaaatttttgaaattttgataaaaattcgaaaaaatttttacaattttatattttagcttagaattatatcaagcctgtaaattgacctttttttgcttttaaaagcacttttttttgcgcgtgtttttctaaaaaatttagggtacaaagnggggggggggtccgacagtgccgataggcaccgacggggaaattttgaaaatttgtgtgtgatttggtaacagatttacaccaaaaaaatgacaaagttttgcaatttccactcatttttaagaaaataaaggattttatgggccccggggaaaaaatttttttagatttttctttctattaagtaattttcccccaaaagggtatgttaaaactaatttttgaaaatttttggggggattttattattctttttaacagtttaatccgaaaaaaaaccccaaattcccccttcaaaattttaaa

SEQ ID NO: 35014 - DNA, 1121 bp, Heterodera glycines
tccactcaaaactcgcctgcttcatctcagcaattatgccggtgtcgagaagccaattgctgacaaaatggtgctcgaattgttgtagaatttggtcggcatccggcatgcatttccaccattgctccagtcttcgccaaaccgagtgcagcgcctcatcccctaatgtttttgaaaatttgagttaattaatttttgctgcccaccctgctcgtccagcaagccgagaaaagagtgttgccgagcaaatgggacgaaatgattgagcaataagtgggccttcggtttctgagataggaagtcgcgcatccgttgttcttgggccagaaaaacacggaactcctcaatttggtgttcaaatgcgtccaagtcatttggcgaaagtggttgagcctaaatttataaatttgggagtgatttgctaaaaatgtgtacttttgtgaaattttggatttggcctaagtgcataagagcttgccaaattgtctttggtcatgtcgattcaaagagatgttccatttccgatgcacgtttgaggacttagccaatttgcggcgtgaggtgcactgcaaatgatcaacatttttctttggtcgtcctgttggagtcgctaaaattagaaaaagattaagatttcgaaaaagagtaaagggggattttatttcactcacttttgctcgtcgttggtggcgccgttggtggtaccgcgcattgctccagctggcaacgcagatcactgatcagtgcatcacggttgcgcacctgctcgcgcagaaacttgatgatgtcctcctggtccttgagctgcttctccaagtgttcgatgcgcggtgatcgctcgtcgatgaccagcggtggcggtgtcatttccccggtgtccattggcgcagttggtgttgtcgaaaacggcaccaaatcgccgattggtgtgacagatgtcgacggcagcgaaaagccaaattccaaaatttcctcgtccatctcgggcgtcggcactggtcctggagttggtggcggcgactccatcgcttcttcggccggtgcagcagatgttgacggccctgcttcgtcctgctgtggcgtttcggcattggggttcggctgtggagcgtctgaaatag

SEQ ID NO: 35015 - DNA, 464 bp, Heterodera glycines
tttagtacatatttcatacatattttagcatttttttatacatattttatttatatatttcgcgatttttcttacataaaaaaatgattcctgattattggtagtctttaattggtttggatagcgtagccaaaggcccagagacagcgacacattttgcgagattaataaaagacgcaagcaaaagcaaaaactggactgaaagacgatgaatgaatgaagtcggaatatttaaacgatcggttgttggcccatttcgcgctaattagttttcctacagctgcttcgccgccaacaaatgcgtaatgtattgcaggatgatccatcaaaagaaaatttattattttaatgtgatagtttacgaaacgacccatcattaattttgtctcactatgcgtttgatgattccgccaaattgggcgttttcaacaaaaaaaattcccattattttcaccataaatcca

SEQ ID NO: 35016 - DNA, 785 bp, Heterodera glycines
ttttatttcagcattggtcggaacagattgccaagctcagtactactgtatggattacacatattaatcagcattttaaagcaattaattaaacgattgaaaatttgaataggatgacatgctaattggaaaagtgggccaaattgtgcacattttggtccataatgaaggcacgccaattcgcgcattgcataagctttccatcagtgagtgataaatggattttaaagaattatttttaacaattccatttttcagttttatattgtttcaaaaaaagatttgccgatgattgggaagaaagaaattatgtttctttccaacaattctacaaaaggtattcaaaaataataaaatattgttgtgtatttattaattaattcgtaaatccgctacaagaatttttcaatgaaaatttgtaaaaaaaaacttctgaaaattctaggtaaaataatttgctaatttcatttatcgaagatgaaacaattcgctaacaaattttcatctttccggattatattttaaatttttggcgccatttaagttgaccaaattctcatcgatggaacgcacgaactgaccaacaaaaatgcatttaacactatgataatgaatttaatcccctttttaccatttaatttatttatattgtttcaatattaatattgatttaaattttgcataaataaattttatccggccaattaactttttcaaattaattcaaatccatgaaatcctttaatccatcggcaataataagcaaagtgacagacgccattttt

SEQ ID NO: 35017 - DNA, 288 bp, Heterodera glycines
aatatctaatatcattttttgtttatccagatggatgacccctttagcaccgcctaatgagccccccccccaacccggcgccacctgttcagtccacgaatagccgctgggtgaaccgagaaggaagtggcgcaatttgcccttcgacagttcgtccaaatgctcaaactcttccgcgtccatttttggcaactctctcctgcaaatggcataatctgtgcacatttattggcatggcatttcatcgatgttccagttataaattggtggcaaaatgaccgaattatg

SEQ ID NO: 35018 - DNA, 1167 bp, Heterodera glycines
tttttgtttgtcctacaaaatatccgcgctttcaattaaattttcatcaaaatttgatgctttaatccaagaatttaccaattcgctttgatgtgaggcgaatagaaatggtcgaggaactaaaagaaaaatgtgaatctatttgcttgctgttctgcttaatccctctcctcttctccacctgtgccaatttcagctcccatttctcggcatttgcttcttcctcctctgtgccgtgtttcaatgcatacggtaacatcagtgcctttgcaccggcaatcttccgagtctccggctccaaagagagtccgccgagcaatccgcgaacgccgttgccgagggaatccaacgaaagagagttgagaagctgggccagggacgaatcaatgggaatactttcattggcgtgggtcccattttgtgtcaaagcatccatcaaaattttctggcttttcagggacgagtccaacaacagtttgatcagctccaacaacgggttggacacgcacagttcgtcctcaaccggcacattcgtccgattgtgccgcgtgtcgtcaaaaaacagggacatggcattgtccagcgagtcgggcaggggaaagcggacacaaagggacgtatagtcaatgggaggagcggcggaccgcgggtcggcggattggttctcgtcaattgttattgcttgaatgatggaccaaagtttgacagaagctgaaatttatttgaaaatacaaaaaccgaagagcaaattcatgataagccgcttttggacgtctgtttaccctttaatgttgccgcttttaaaatttcgcctttgtcaaccgccgtcacaataatgtaacccatgcgcttcatgtcatatctgaaatttggtcagcagaaattcgattttttaaaatagtaacgcaacaattagcatcacttaatttattaatcagctttttttaaaaaggtatttaaaattactattttaattggttgcattataatttaaataatatcttcggctggcatagaacgggtccgagtcgtttatgtgaaaaaggtcgcccaactcgcgcagttcggcacgcgcacgcgcattggtcggcgtgtacagctccaaattgtccttgagcaacgcgtcggaaatgcggagaaggcccaaactgcacagaggactctaga

SEQ ID NO: 35019 - DNA, 277 bp, Heterodera glycines
ttgatttacattaatttacatggccggagaccccttcgcaaaattggaaaattggctgctgaccccttgttttgcaataatctgaattttgaggtctacatctgaattttagtgttctatgtcctgaatttgaaaaaaaaaaacttggtcaccctcaatatacatatacttctgaacaattctaatgctaaaaaacaggtactcgcgcgaaaactgaataaaaattttgtatttggaaaattttgtccaaaaatttttatgctctaaaattaccggt

SEQ ID NO: 35020 - DNA, 863 bp, Heterodera glycines
  misc_feature (19)..(19): n is a, c, g, or t
  misc_feature (68)..(68): n is a, c, g, or t
  misc_feature (172)..(172): n is a, c, g, or t
aaaggcagatttcgggacnatataagcgcccctcatcgtcttatcaaaagctttcgagcagtttagcnaactctttcattgtttgagtgtttttattattgtctagcaattcacgaaagtgagcgcttttggtttaccttttgaaattcttagtacattacaaaatgatttntaaaaaggcatttatatacacgagcattttacgggggctggaatttataaattctgagaatctcgtaaatttgctaaattttcacttttatcattggcaacactgctgaattgtgcattaatcagttgccataattctttgagctataacagcaatgggtgcattttaaatagatctgaaccttttaattaatgccaaatatggtgcaaagtatgtaaggattaaaggcagattttcggaacatataagcgcacctcatcatcttatcaagggcttcgagcagtttttcaaactcttttcattgtttgagtgtttttattattgtctagcaattcacgaaagtgagcgcttttggtttaccttttgaaattctttagtacattacaaaatgatttttaaaaaggcatttatatacacgagcattttacgggggctggaatttataaattctgagaatctcgtaaatttgctaaattttcacttttatcattggcaacactgctgaattgtgcattaatcagttgccataattctttgagctataacagcaatgggtgcattttaaatagatctgaaccttttaattaatgccgaatatggtgaaagtttgtaaggattaaaggcagattttcggaacatataagcgcccctcatcgtcttataaagggcttcgagcagtttagcaaactct

SEQ ID NO: 35021 - DNA, 701 bp, Heterodera glycines
ctgttgggttgagtcccagtgattggaatgctggtgggttgagtcccagtgattgaaatgctggtgggttcagtcctggtgattggaatgcagtcccagtgattggaatgttggtggattgagtcccagtgattgaaatgcaggagaattgagtcccagtgattgaaatgctggtgggttgagtgccagtgattggaatgctggtgggttgagtcccagtgattgaaatgctggtgggttgagtcccagtgattagaatgctgttgggttgagtcccagtgattgaaatgttggtgggttgtcccagtgattgaaatactggtggattgagtcccagtgattaaaatgctggtgggttgagtgccagtgattggaatgctggtgggttgagtcccagtgattgaaatgctgttgggttgagtgccagtgattgaaatgctggtgggttgagtgccagtgattgaaatgttggtgggttgagtcccagtgattgaaatgcaggagaattgagtcccagtgattagaatgctgttgggttgagtcccagtgattgaaatgttggcggattgagtcccagtgattgaaatgctggtgggttgagtcccgttgatcggaatgttggtgggtttagtcccggcgattggagaaaaagccaagaataggatgcgaggccgcgaagcggccgagccagtcgattttat

SEQ ID NO: 35022 - DNA, 841 bp, Heterodera glycines
taccctttctgatcattgttttcctctataatcacttttgtacatcctatcatcactgttgtaccacttcttatcacttacgtacatttcatttcaaattaaataaatatgcacttattaattttcaaaattgtttttaatgaataaaacgagtattttattattataaatttgaattaaaatgcatccgatttttaattttttataaaaacttttccttatttatttaattttaaatcatcttgacctctttcccgttgtattacctcttctgattacatttgtacctcttctaatcacttttgtaaaaattgtttcggttttcctttttaaatattttttataatacatcttttcgacaataaatctcaatattttctctggttatgcaataaattaattatttaacaatatactttagatgtcaccgctagcaattgaatgaaatcaaaatgcacaactaatcaatcaaaactgaaaaaacaaatagatattggtaaattttgccccatttatgctgtatccccagcattcaaatttccatattttgtgcataatgcaaattgccctattcctccacccaatcccgtcataaacttagtccgtctattcatccaatctcaaacccaatccttgtccctctcatttatcgagccgtttctatcccattcacctctgttgcatatgccatccctttctctcttattcctgtgtttatgccgtcatacccctcatcctatccaaaatccctacccattgtgccagtatataactcccactcaattttccccctcggggacttgcgaaatgtctgcgggtgaatcactctgtgccatttctt

SEQ ID NO: 35023 - DNA, 978 bp, Heterodera glycines
  misc_feature (972)..(972): n is a, c, g, or t
tcacaccgggacgagaaatgccacaaattctttattttggggtcaattttttaacataattttttttttttcaaaataccttctggtcatttcttaaatgctgccagaatgagcattttttggcaaaaatatgacatagattttctaattgtaatgggaaagaaattaaagaaaaatgaaatttacgtgattaggcttcataataattgaaaacccgttcttgatgcttattaggccattgaaagttagcagaaaaaatatgtaatgcatcaaaattcgctctctaatcatttgataggtcgatgttatctcaattagcatgcaaaattttaaaaattacacagtttaattgatgttgtttttaatttattttttgaaatttgtttctgagaaaagttaggtacaattttaaaaatatattagtggcgcagaactcaagcaatattttaacatttttagagctataccaactaccaaatgggtggaagaattcatattgttgatgaattcccagccaatctcaaacacgctgttgctgaggtggagtttatggacagattatgaatttttaaatataatttttacttttttaaaatttaggcttttagaaaatagctatagatacacatttaaaaaaacatttgatcagaaataatacctttttagctattttctgaaaatctgattgtgggttttaatgggggaaaaagccaaaattaacaatatcaccgaatcaatggtgctctcactaattgcacattggcaggataagaatttgtttccctcattccttcaaattagttaatttcttaggagttttttagcctaataaaaaaatatatatatatttattttttgtatgttttctaccaatctaaaattttttctacatatgcaaaaattttagccttatcgttacgacgctcgcaggcacaaggaaagtcttgaacttagccgcgacaattcggccanaaagga

SEQ ID NO: 35024 - DNA, 1070 bp, Heterodera glycines
  misc_feature (1038)..(1038): n is a, c, g, or t
gccactaaatacggtgttctttttcgtgccgtcgtatgaaacggcaacagtttcggcaccggtaatgacacgggatttggtttcagcacttcgagcgtttgtcgcttcagatgactaataaaggaaatttaagttaattatgccgcccgtaaagaaccaaaattaataattatctaaatttttattttctcactttcattttccctaatcatattttcactttccataagaaaatttttgttacataaaattttttgaactcttttttcagttagcatggcccgactgggctcaaatgttgggatagggaatatttctatttttttaaaatggcactaaaatcagtgaatgccgtgccatcccatgcaactttaaaaatggattctataatgccaaaaacaatcaaaaaatctcatttgtcattcacccataaaagcatggcttacgctttgcttttcattgtgcccattgcatctgttcccatcgcaaaaattgcgctctgccgtcccattcatcgattggcattcatttaatccaaattctttaagtggcagtttaacatcccacaatttgtccatgttaacacatccttttgtgtggaaaagcgtcgaattgtccgtcccaatgcaacgcactgagaagcattgcgcatcttcacaccttaatttgtccctctttgaatttatctaattagaataattagtgctaatattgtcccctcactctccacaaaatttcttcacctaatttcggtgaatgcttcgtcctttttctcgccatcattcatagttccattcaaacacacaacaatttctttaccaataaattcaaatcagttaataattaaatggtttaaaataaaaatttaattagcaccgtttggaattttgtcgttacaatacgaggtggaattgcaaactgagcagtctaccaaaagtttgccaccatcggttaagcatttctgttcaagctcagcgcattccctagtgccgttgaaagtgcaaccctttgacacttttgtccaactttttcccgcangtttctattgaaattaattaattaattcatta

SEQ ID NO: 35025 - DNA, 534 bp, Heterodera glycines
gacgttatgtcccggcgagttttggtttgagcagcattcttcgggttcgagtcccgccaggcgcgtacccttttatgttttcatcggtgctgctgcgcaatgccgattcttatttattgttttctcatcacaaaaaagtggcatttattggactgtaatgtgtattggttgcaccaatgatatttttttatcggatttccattccgtatcaatgccacattcttttgaacgaaatgccaacaattccctcatattgttcttttttcttgcaggacgatgtgcctcgtgtggttgccagcatgtgattgggtgtgtgttaagcggtggtggttgtgctgctgctcgtcaagagacgagagtctccacaaagctgatccgagccgcataatcctcagacggaagcggaaaagcatcatcggccatccctttttttatttcttttttggtgctgacgccgtagttcttccatcatcaatcaatcaatcccaatctgtccgcctccatccctcccgcgctgatcagttgatcactgat

SEQ ID NO: 35026 - DNA, 1625 bp, Heterodera glycines
  misc_feature (32)..(32): n is a, c, g, or t
cagagttgacaaatttattcccatcgtttttnaaggtattgcgaactttgctttgcccgattcggtatcattcagcagatgaagtactttttgttgctgaatttattaagatttttgaaaatatgtccttcattggccgttagaggcagtaaaatttgattgaattttttaataatccacacaaaaatgggcattgccaaatccaatttccaaagtttcattgctcttttagggaattggacgatggcatcgccgaggcagtgagcagtttgttgtgggtggcgcctcgcattggacacgaaattgcggaattcaaggcatactttgggcaatggcaaaatcagaaaaacaatgccgtggtgtgaaaagcttttgtccaccctagaaacaaaatttggtgccaccaaaattactttcgtgtggtataaattggccgattccaatcctaaagaatttaatggaatttttccattttccctaaaaattccttaaacattatcacgcttacaattaactaaataattcaattaaaccaaactgaaaagcatcgtccaaatgtaggtgatcaacgacgaactgacccacaaatacggcaaacaattcgcggaggccgcccgtatgaaccaattgccggagccgagccgagtgtcgaccaaattggtgcagaaattgtccgtcagcgcaccgtccaaattgctcgtcgaaaagtttgtcaccatttatttggggggtgtgactttttttgacaatttctcggtaattgcttaaatatttttctaatcaatgccattttgtttgctttttaaattccaattttttctctaggtatttggtcactattgcgcaatcggcgggcgtcgatttcgcgccggacgccaaagtgatgcgtgaagacgacgacgaaattgcacgagcggaacgcaacttgatcaacttcatgaacgaggtgtggtgccattggggttgggtgggcaccgtttaatcagccatcgaattggcgggattctgcgtttattgttaatcagacacgaaaaccgcgcgcaaaaaatggcacttttgcacccttttttgattttgtgccttatccgaaaaacccgcttttccgagtcgtacagcgattggtccaccttttctacacgctttccccccccccctccgtttaggagcagtacgggtggactgtccgtcacaacgacgacccaaacagcaaaggcggcggcggagggcatttcgctgctgccgtcggtggcgccattggctccgccgatccgttgatgaaccagggcagcaacaacgccagtggcaatggtgctaatgcaatgcctatgccgccaaatggtagcgctgcctttgccatgtcgccctccacgtttgtgccgtcgcatccgtctcccctcgccacttcgtcgtctcctccgcccgaatacgcgccgccgcctccactgccggcccatggcgctggtgtttaccgacagcaaacgacgggcggagtgcgtttttggattgcataaatttttcgaaatccgaattttttaaataaaaaagtcggggaaagacgggcaatctcaaaatttttattggtgtgaggaatacaaacagcaaatggatgacaaaagttgcgttat

SEQ ID NO: 35027 - DNA, 713 bp, Heterodera glycines
tgcgtagtatgtatttgtaaaattaataaatttttcttttctattttctataaagaaatatttttttttataaagcttctaattcaattgtagtgaaaacgccaaaatccaggagtctggaacttcttttcaacaatgaattgaaaaaaacgaacgcatttttatgttttatttttttgttcgttatttgataattattatttaaaaatagaactcaacttcaaaaaattcttaagtgtatctttttatttaggtgatcgattatttttgagaatactagtaaagcatgatcttatttcctgttgggttttaaagaggcaagcaaactctatgcgaagtgcataatatttctcttttaaaattttcaatttatgagataaatttgtgttcgttaatttgttaattgtccatttattagattatgattattttaaaatttgatgtcaaagtttttaaacgattattgaactttaatcttttatatctgtttttcttaataagcgatcactaccacgggaatttttttccgctttggtcactaataattcaaaatctcatttatagcaaaatatcagacactgttgttgtgtcatcttacaagtcacgtgacaagggggttagataatgtagcgaattgttaaaatcaaaaaaatcatcattcttctctgtctttttttgcatacgggaggggagatatatcgtacaattaatca

SEQ ID NO: 35028 - DNA, 860 bp, Heterodera glycines
gtcccgaaaacaaaaataaatcgattttttcaagtgtccgttttggggtactcaaacaattatgggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgcccccccccctcccacgcccttcagagcacgacaaatatttcaacaaaaattttgaaaaattgactagagcaatcgaacgctaacggacgacct

SEQ ID NO: 35029 - DNA, 614 bp, Heterodera glycines
attaggctgtaccaaaattgtttgtttattttcctcattcattgcttcagcaaatgctttgctggggttgtccgctgctgtgctttcgtccgataaacagtcattcctttcctcttttgtgggtccttccgcgtcacgtcctctcatcactttgacaaaaactagctcaacagaagggcggctccttctgccccctcacaaatttcatctgtccgtgtccatatatttaatcactttgctgctcctcatgcgtgtcttatgaatagcctttactcctccactgtcgtctgtaaggacagaaaggacgatgagtgaattgaaatgggggggggggggaagtccaattcatcggagatgaacagagggggggggggacggaggagggatcatcatcggtcggtccgttcgtcgtccatccctcaaacgctccgcaaaaagaactccagtccttttctgtttggaaagcctttgagtcgatttgactcatcgtgcattctccttcactctttaaaaacctcttgatttactctaatcgagtggacgatggactcgtggaggtggggaaaaaagagggggggggggggggaatttatttttaccctcctcaatgaaat

SEQ ID NO: 35030 - DNA, 1130 bp, Heterodera glycines
caaaaaccaacctttttttgttgaaaatctgttaacaaattgcacccaaatttttaaaatttcccccggcggcgcctatcggcaccgccggaccccttctttcccaaaagttttttgaaaaagcactccgaaaaaaagtgatgtgaaaatcaaatctgaatttctattaatattcgatgatttagtccaaaaatgattaattgtttgaaataattgaagaaaatttgtttgaaaattttcattaaaaatttgaaattttttttaaatttttaaaatttttttgaatttttaaaatttcccggttggtcccggttcccggtttttcttgcggtcctggtcccggtcccgaaaaaaaatcgaggtcccggtcccggcttctcaggtcccggcaagtcccggttttggcaaaaattcccggtcccgtggcactctaaattaaataaataaattaatttttatatatgaaaatagaattatatcacaaattaatttttgtaatttagctgtctttccctaatttaaatgtttgtataaaaattttttaaaaatggtaaatagtttaaatgttctttttattatttgaaacatcaaattctgaaatgttgatctttttttctaagaatataaattagatttttttagaaattttatgatttttttttcattttattactctttggcgaaatttacgaaaaaagcgacttaaaagcattaatgataaaaaattaatttatacagtatgctcaagcttttctttgttaaaaaaaataaattaaattttattaaataaaaatgaaaaaatacaatgtatatatttttaattaggtaactaacaaattgtcaatttattaaaaggatcaatttacagcaagtgattcgattaaaatttattccctaaaataattttttaaaaatttaccaaaagaaagtatacttttgagtagcatttcataaattccgccaagggtaataaaattaaataaatgcataaaatcatatatttgtagagtgacaaattcagctgaatagtgaatgaaaatttttgcatcgttttgcttttcggataattttccaagaatttcggtgttattgggattcgtcggcggagctaggatttctatattaataaa

SEQ ID NO: 35031 - DNA, 1144 bp, Heterodera glycines
  misc_feature (69)..(70): n is a, c, g, or t
  misc_feature (82)..(82): n is a, c, g, or t
gatattttagcgctcataatgggatgtataaaggcgatgtagaaggaatgggaagcgctaaaatgttgnnagaagcttttgnagcgtaattacgattttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgtgatgcataaaggcgattgtagaaggaattggaagcgctaaaattgtttaagaagctttttgagcgtaattacgatttttacttacaccattttttctaggcttagatcacatgcgattttcggcactctgataattttagcgctcataatgggatgtataaaggcgattttagaaggaattggaagcgctaaaattgtttgagaagctttttgagcgtaattacgatttttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttagatcacatgcgattttcggcactctgataattttagcgctcataatgggatgtataaaggcgattgtaaaaggaattggaagcgctaaaattgtttgagaagctttt

SEQ ID NO: 35032 - DNA, 939 bp, Heterodera glycines
agattttaaaaattagcgattgtcctctttaatcatttaaaaattttgataaaaattggccttttcccgtttgaacaaagattaaattaaataatttgtattaatttgtaaaatgatttcaatgcttttaatttgtccgataatttggtattctgtcaacaaaaatcagtatgaagctttttcttttaattatatctgatcatataaaattaaaaattggaaaaatgattaaatatcataatagataattattttttcaaaaattttgtttgattataattaaaattcattcttttcagaaattagagcgtaatctctgtaaataaattatcttcaatagcgggacattaatatttaattattttatagtaaatattctcattattaataattttttttaatatatatttttttattctaatgtaagtatttaaaaagatttaatattttacttaccgttaaaatttttgtttttatataaatgaaataaattttatttattatataaatgctaatctattatttttgaaattattttttgtgcattaaaagtttatttattcctttttcaattacaaaatttcgaaaaactttgaagaaattgttctattattcttgtagaatttttccaagtttccgaatattttttaatttttatacctaatttatttatttttatttgattttatcatttcattttacataatgtcttttttactcattctcctttttctttattgtgtaacttaattttgaggtcgtttttaatcgatttatttattatattttaaattttagctattcaaaggtttatatgacaatcaaaaccgaatgaacctgatgttattcatttatttagtcataatctttcaatttcgaacatttttatgtctaattgattaacatttaagggaaattcattttttcatgtatcatctg

SEQ ID NO: 35033 - DNA, 789 bp, Heterodera glycines
tcattttctgtttctattttgtaagtatattactttattttatatttatttaagaacccaaatttatattattgcattatttaatggctccattttttctcttagtgatcataggttttttccttgccattagttgtttcatggctttataattttttttatttttctccatttttaaataggttgagaataatcatttttcaaatgtataattccatatttctattctataataatgaatttaacttatatattttaattttagcgaaacaataacttcaaataatttaagtaatagataaaaaatcttttttaatcatttaaatttaaaaaataaataaattattgaaatttttatgaactgctttttttcattgtttatttagttttcagattaattttttatcagttattttggcaatgacctgctgaaaattttgcattcagttttatattattgtatcggaatttcttccaaaggtctatcaagatgattggccgacatttgcggcgctgacatttgcggcgctgacacttgcggcgcccagtcaaagcgacacttgcggtgccgacgtttgcggcgtgacacttgcggcgccgacacttgcggcgacgacagatgcgatgcccagtcaaaaggacttttgcggcgcccacacttgcggcgtgcagtgaaaatgacatttgtgggcgctacattaaatgactcgagaaattatttgaacaattcttttattaaaacacgtgtattaaatcactcttgcagtcctattcttcagagcctttcat

SEQ ID NO: 35034 - DNA, 200 bp, Heterodera glycines
ttctgctcgtctgtcccgtcgttgttgcccatgttaataagatcaatgtcgctaaacaatggggaaaacagtcaataaaaatgccaagtaaaaattttaaatcagtttttttgtggaattttttttggaaaacagtacttattaaaaacagtacttttcaagtttgcataatacttttagcataatcaagaatcctttat

SEQ ID NO: 35035 - DNA, 721 bp, Heterodera glycines
gggttcgaaattgagcctaaagaaggggccggattcataataagcgcctcgaattacccctgaaaataattttctaaaaacttatttaaaattttttttcgggaccaataatctttaccattgccgaaaattcgccctgttcagctccgtcagttgcgtgccgagtttcgctttcgcggcgtcaaaggcgccgtcgggacgcaggacgcgttgatgcaactgttcgacgaggacggggaacgcgtcgccgcgttggacgccgcggtggcgcggaaggccggcttcgagcacagtctgttcaccgtctgtggccagacgtacccgcgttatcaggtgaacacatttaatgtgactgcataattcccacgcatttcttattatggcgatattttatgatcccccgaaagtaatttttttaggttaggtattttgactatttttggttcctcaaaaactttgtcattggtttgaatttgagtccgatttttggtgaacaagataaaattttgcacccaaaatttaaaaaaatatattttttagcgatttttttttgaaattttatgacgaattagtacgttttcgaaaatttttacaaaaatcgctaaaaaatttttaaaattttggggtgcacccgaatttggcattggtccatgggcacctttcttaaaatgttcagaaatgattgattgctttcctcttttgtcaggaatccgatattctt

SEQ ID NO: 35036 - DNA, 866 bp, Heterodera glycines
aacgtacaatggatgaagtctctacgccgagttctaaaaataaataaatacattaaaatgtaattaaatttcggagattttgctaacaataaacttcggctctaaataaataagggggctaatttttgaatgagttcgacttttgtgcgaatttggacgcagagttaaggaatttgttgaaacgaaagcgacaaaaacccaaattataaatggaggaaagcaatcaacgctcaattggtagattcgtcaccgatttttagtttaataataaaaaaaactaacaaatccacgatttttgcggaagtgatgaaacactggtggagatgataggtgagcaacggctccttcaacgatcgcaaaaaggttttgactgccgacgaaattgttttgatttcccagtcggacgcaaaaacggtgctcatgaatttgtcactttttttgctcgggtccagcgcaagttgcatcaacttctgcaccttggagttgacgccacaatttcttaataaatgggggcattttatataatatcagaatcagttttttccaaataaaaccggatccaaaaagtggggaaattttggttttttggaagcaattccaagggttttacgcgtcatttagtgcattaatgccgaaagtccacaagttcttaaaccgggttcaaaattgggggaaacgatctgctcccatttaaatcacaccgtcgcacctgtaaatgccctgctctttgatgcccttttcctcaagcaccgaaatgcaatgacgaacaaaagcgaagccacgttcatcaagcgaagctataaaacatacaaaagagatgaatctccctggcatcaccgttcgatggggaaaaaagtcacttactc

SEQ ID NO: 35037 - DNA, 641 bp, Heterodera glycines
gttaatgccccgcgggggacggatgatccgagggattataattacgctaattgcctctttaatattaatattccgtcccggcccccctgcaattacgctgagtggccgtttggtgccggttgttgctgttactgctccgttttgtggcgcctccgctgccgcatgacgccacgcgccggccgcgccacttggcgccataaaagcggaagcggtggaagaactgcgcgggaaggcgacagcgcccgaggcgcggtgatggccattacccagttcgctggccgatttgacggcagccgcggccgctgtcgcgcggtgctggtggcggtggtggtggtccatcaaattgcccagcgaggcggcgttggccaacggtgccgacgcggcggtggtcatccgacgtccggcacgagttgagcaacgaccacggcacacagtgcagcaggtgtttgtctgcaaatttggagggagggatttgttttaaagagccggaaaattttcctggccccgattatatgggcatacgtaaagcacaataatattggaatttaaattaccatatttgaatttaaaatttaaatcacttttttgacttgaaagtattgtggggaaggcaaaaaattatgaagatcctccaaacaatg

SEQ ID NO: 35038 - DNA, 514 bp, Heterodera glycines
ttctcagatcacaaaaaaagacaaattctacccattttgaggttaaaatttcaaaaatcaagttaacatgaaggtccggcggtgccgtcaggcgccgccaggaattttttttgaaaattgtaataaaatatgataggaaaagttgcaaaaatttcaaaaaatttactatttttttcaaaaatactgaaaaaggcatgaaaagtcacaaaggtcaaaaaaggcacgcaagttagcaaaaaaggtaattattaatcctgcagctcaaaataataataaactgaagcattcgttttaaaaatttaaaaatatattcattcttaggagtggaaatttcgcatttcgcgccaaaaagcgaaatgcgaaacgacaaaaaatgcgaataatgcgaaaagcgaaacctaggcccatccccgacatacatgatcaaggggtgcgccggcgcacccccccccccccccccctcgttcgtcgtaaggggggcaggctgtaaaagaggaagggggtggggtggggg

SEQ ID NO: 35039 - DNA, 620 bp, Heterodera glycines
tgaaaagatttaatcgaaacaaataattcttaccgataattatgcaaaaaatttaaaaaatatattatttttaacatttatatgaaaattaatatttaaaaattaatttaatgttgaaagtattttttaagttttactttaaagcattaaaaaaattttaagtttcaaaattgttttttttcttcacccttggcacaatgatgcccgtggctggtgccatttccacaagttcggcagctcccgcagcgtcctgtgccaatccaaactcaacgtcgctgtcgttgtcgtgctgtgccgttggtggcgacgcgtacacgacatgcgcgagcagtacaaacagtggtgcgaacgcgcgcgcggtagcgttatactgaacgtgaaagcggtcgcgtgcaaagcgcggcgagttctgtgcattttcgacattttcggtgttgttcagtgatgtgaacagttggattgggtgaagcacatattttggcattcctgatgattaatgttattttaattaagtgattaagtgatttaattatgtaattaattatctggataaaaaaatttgctaatattaatccaaatattattttaaacttaaataaataaatttaaaaatttatttc

SEQ ID NO: 35040 - DNA, 303 bp, Heterodera glycines
atttttgaggtttttggccataacttttttgtaaacttacaaaattttttgaaattttacaggctaatagagaatctgaagagctatcaaatgataacaaaaaattttaatttggttgatcaggaaaaaagttgttagcaacggcgccgaagtgggcggttcccaatggtttgtgatgatttaatttttatgaataattattttctaacttaaatctttcgataattaataaaattgcatcaaattttatttacaaatgcacatatttatttagcttttttgaaattcataattttgttcctt

SEQ ID NO: 35041 - DNA, 1200 bp, Heterodera glycines
agtgcatacatctcggatgaaaaatcgcgttcaaatttactatttttccggcaaccccaagcatgaaaaccatgaaataatgctttcacagtttgcaaagtccaaactctgaccccctttgacctcccccaaccgcactccagcagggggggggacgaccttttttttgatgttcgacattcgccacgattttccaaaaagggtaagataaggcaaccggaaaatttttggaatttttgtcgatttttaatgaaatttcttaagaatatggtatactttttactaaattctcacattttttattaaaaattttttactttttgcgttacgggggcagcgctacgcctttgcccagggggggggataaaaattctccaccaccaaaaaaaattttttttaagggggtgatgggggaaagggtatagtgttcccattgagttttgtgctgactgactgactcgatgccctcctgctccgcaatttccaccacatcctccagcgccatcacaaacagtttgccactgccactggctgcccatttggtcagcccccgttggaacagccaaacgcggtcctcctcgtccgccacgtagcggaacgcgcgtgagtacacgctgaacaggtggccgccttgaaagtaatgtgatgggaaatgactaataatttcaccccttgcctacttcacacgtcgggggagttgcgttttctttttgaaaatttgattaacttctatattattgtgcatcggttatcacacatttgcgcaccgaacattcgtgagtatgtccaaaaaagggttcaaaggtaagtttttccattgatggtagcttaaacagatttaaataagcgagtttgaaggtagtaaatttttgaaaaaatagtcaattattcaaacaacagaattaatgttcctagtaagctagaagtctgtattttcttaattttaattctgtttaggctatcagggacatacattttttagggggggggggggggttcgcagaaaattttcctggcggcgcctatcagcaccaccgaaccccaaaattctcatttttcttaaaaaattggcttaaaatcgcaaaactagccatttttttgacaaaatttgttaacaaatcgctttaaaaatttcaaaaattttcccggcggcgcctatcggcacgaccggcagcccccccccggtctccaaagtttttt

SEQ ID NO: 35042 - DNA, 1585 bp, Heterodera glycines
aaaaaagtaattactcggtaattaatgcaaaaaccccatacaattagagctatcggcagtgtttgaacgatacatttcgacactgtttgacccaattggacttccattcggccgccacctctgccacgagacaatggcacaaattcgaatgccatcgtttgctgacgttgagcaaaagcactgagcaaactgagcatcgaatttctgttgctgatggacaaatgaaatgtccattaatgtcgaatttcgatggaagagaagcggcgggtgagaagagcaaacaaacacttaacaaatcaaggaattctcagcaggaaaaagtttttgaaaaaaagataacgaaaaatattggataaattctgctaacaaaattcgtgaaaaattgttaataaattttgttaaaatattttttggaaaatatttttttataagagaacgaagtggattcatctactgctattgttgaagaatattattattctgaggaagaaaacgacaacaatcatcgccagcgaagcgatggaaaaaggcctttgttttgcgcaatattcggacaggtgtaataatacttttatatcttcgaattatccgtggtttctttatcaaaattttttccaaattttttaattctttccatataaagcgattaatcagacgtaaaaagtgcattaattaatcagtcactctgtcttaatttagccattaatctgtgtctatcattaattattaatttataatctctttaagttgcatcttcgtcctttccatggtctgtccctctcccaaatcgatcagtgcgcttttgctggcgctcgaccactcattgaccatccctttttcttggtccaaatcaccgcttccgatcttttggccaatgacagcaaaacaactgatcaaagcaatgaaacgaaattatttggcattacaaaagtcagttttaacgcataaaataaagaaacatttccaaatttgaaacgaatttattacttaatgaatttttacgctttttctccaattatcaaaacccaaaacaggtggcagtaattattcgaccaaaaaagggatgtgtaaacgaccgaaaggtttatttggcggaagcctccgctgatcagcaaaatgatgctcttcccgccacatttgcggatggatcttcagaaactggcgctattctttcagggaaaaggtcgtttttcaaacaaaaaatgcattaaaatattaaatttttattaattaaatttttaagtgtatttattatttttcatatttttgttccattttagagctgttgaaatcgtacgaagtacaaaagaaactgcaaagatcagtttgaatcatatcgacacgcaaatttcaatcatttccattggaaatcttttcttcaatgtttttgtccgtcttcgttctccaaaaatagaaaatgtaaaagtaaatgcacaattatatacagtaattaatagtaattaattccttttattgcaggcatttcagtcatcgctttgtgtccaaaattgtccggacggcgcaaaaatggacgaatattcggcatttttaaacagcaataaagaaaataaaggtgtctatataa

SEQ ID NO: 35043 - DNA, 1044 bp, Heterodera glycines
gccaatccttcgccgcccgtttaacaggatgttttttgtttggttggactttgcgttttagtagccaaaaagaaaagcaaaataaatgaaaatcaaaaagaaaacgaacgaacgaaagcgacgagaaaataaaaagcgaaagaaaaatgggagggggtaaaaaagcaatgcaaaatgcaaagcgttaattattatttttcaattaattactcaattaattaccctattaattattacattaattaggcctaattgggtgggatggcctttttgggtcgccgtcccttgcgaatgttcacacatttttatgctttttacccattcaatgcgcggcgcactcagttcaccaaaaatacgacggtcgagcagctaaaaaacaatggaacaaagggaaagcgaaaagagagagaaaaagaaaaaaagacaaaggtcaaacattttcaggtgttttttgccgaaaaaagcggcggaacaaaagacaaaaaacgaacgaacacaaaaaagtgaaattcacaacaaaccaaaaaaaaggacattaataaataaaaaattaaaattagggcgtaaataacaattgaatttgtaaaatttaattattaaaaggaaaatatcacaaaagcattaattatttgtttaatcgatggccaaatcaatgaaaatctgagaaaaatgcaataataataattcagccattcttttgccctttatgcggcgaaaacattttccgtttttatgtcacatttttactttatcattcattcaccgcaaaaatgcaattattttactgggggtgttctgcctgcccccccccctccttttgctgattaatccgctaataaattccttattatttccaaactttgatcagaaattcaacccattggtccgttctctgatcataatcactttctcactctgatcagagttctcccgggctgatcagtgttttccgatggcgcccctctcacaaaactcaccggcgagtcgagcaattcgtagagccaacaaattgtgtcgttatgcgctatcactccattcattccg

SEQ ID NO: 35044 - DNA, 747 bp, Heterodera glycines
caattgtgctaattgccaaaaaatgaaccgacggtaaggtatttgaaaagtcacacaatttgtggattccttattcaaacaccacggatggccagcggatttgggatgtttttgttcgtgaaatttggccaattttttcggcaaatattcgccatttgtgcttttcccgtcgtgatcatttggacaatttgtgtcgtcgcacttcgccaacaattctcactgatctcaaccaattgacttcaatctattcctgtgatttgtcgcccgctgcgattggtgatggttttgatgcaacaatttctgctggccaagcattgtccaaatggttgcacattccgagaaaagatggccaacccaagcgattgcgttgcaatgataacaaggaacaagcggacttagattggatcaacaatttcaaggaggtgtggccccacattttcaacaaatcactgattttgagtgcctttttttccaaattgtttagcaatttctccgtgccaatgccatttcttcgatcagttaccaaattcatttttatgttcgcgtgccgtcaatgccaatgatgccatttgaatgtgtggtgaacgaatcgacaaaggaaaagctgacattcgccaaagcaaatgaatgggacaaccgatggataatgaaacgatgcaaaattattggggagactgcggcggttcagcagcaaaagaaatatgaaaatttggacaataattttaacaatgtgtccaatttggcttt

SEQ ID NO: 35045 - DNA, 1514 bp, Heterodera glycines
  misc_feature (948)..(949): n is a, c, g, or t
  misc_feature (1302)..(1302): n is a, c, g, or t
cttctgatgcgcgtgccattgttattgttgttgtggttttttcctccacttcttgcgacaacgccgaatttggctgcgtttcttgctgccgctgctgtttttccggttgttccgttggctgttggggtcgttccgactctttttcctcttccgcctcattcacttcttctttgtcgtggtggtcttctttttgttctacgatttcctcgttgtcagcagcagcaatttccaccgccgctgcactgctcgccgccgtcgtcggagagttttccgcttcggtgtgcgtcgtcgattccaagagaggccattgttgcggatttatgcggggtcgaaccttcaaaacaatttaaattttaaataggtagttgatcaaatgggtgcactcataaatctcgcctctttaatttatttttaaattttataacagaaatttttcaattaaaaaaatataagaaaacttttttaacgaaaatgtcataaaataaaatttaaaaaaagcgctgaaaatttttcaaaatttttaatcttgaaattctattacaaaaaaattttctaggatttttttcttgaaaaatttttaaattagaaaattgataaaaatgcggccgcgagattcgaacggcaagagtccgatgacgagatttgtcgcatccccgaaaaaattcaattaaattgcccgtctccccccaccgacctcctcttctgataaaccctgtcaattgtctgtaccttttggtggtcctcgttcagctccactttgtcactgtcacacaaactggagacaatgaaattctggtccagcgtcagtgaacgaacgcgcgggaagctggcaaccaaaccgagcggcaaaaagccgtcgatgtccattttccggcgcaggaagaagtccttctggaggttgtcagcggagaagtagtactcactgaagaaaacatattatggatgagnngatcagatggcccacagtaagatttaataatttataaataattaaataataaataattatataaatgagagtgcgttgtaagaatgaagatagaatatatttaggatttaattacacaaatattagatacttaatgaaataagtatatgctgaatttcgcattatctaatagaatgaatgtagcttgaattttagcgtacgactccaaccgatcaccagtcccaactgtcgcgaactattcgtaaataattcctctctctcccgaaatacttgtatttgctagttacatgattggttcgtcgcttgaagtcacccaccccgcccttctcgaaattcctttgccaacattagcntgcgctttgtttctttacattcatttgtttcattactaatcatatgtcacttttcctccgttttctgcccaactttcttgtccaagtaacccttaacgcaacagctggccaggctgtttgcgttcagtcaaagttcggccacccctccattcattcgtcattccattattcattaaacatttgataaacaattcgggaggacccaagttaag

SEQ ID NO: 35046 - DNA, 1602 bp, Heterodera glycines
  misc_feature (1103)..(1103): n is a, c, g, or t
tccaattaataattttttgttattgttcatcacgataaatttgacatggtgtaacatatttagatatatttaagttgaaaatgcatacaaatacggtaggaaaagaattcctcttattaaaataggaaaagcaggatttaagctagaacttaaaaatttgaaggaaatttgctgataaaattgacttaagtttcaaaaaataaggaatattgttttcaaaatactgaaaagcccaaaaaatataaaaattattttttaacatttttaaatttaaaaattgatgacaatcattgtatgttatggcatcgaagtaacaatcccatccgtggtataaaaaaaaatttcctaaattttttgtttatctcattaatgccaatgcacacgctttgacacttcatttttctcttgatgcctattaacagtcagatgttggcacggatgcccgctggcatagccattctaaataaaatattgtaaaatcaatttgaataattaaaaattcaccaaaattttaccccgtattgattggcttcttcttggtgttgctctcgtccgtcatcctctcccattttcactgtgccatagtccgtgccgtgccaatggtcatcatcgtaatgatggaccgtgtccggtaaggtttgcagcacatttttcagtcccagcgtcagaagcgcaattgtttcgccctcatttgtgctccgtcgcttcagtcccatgcttgggatttgtctccccgcagcaccgaacgacatggcattgatgaacatgctgcggatcgtcggcgtgttctgttggcaattcaagcgctgttttcgccgtctgacagccggaaaatttatttatttaatttgaaattctttatgtgtggacattaggattttgtcgataggaatggaatttttagacccgaaacccagcaaaatagctaagatgaaaagtgataataaaatcaaaaattttcaaaataaaattgtataaaattatttggtaaattaataatttttttttgaaaaggtgccaatttttagagggcaaaatttttttgaaaattaaaaaatcatttctaggtgtgcttttaacattttattgcagagttctgtagntttcaggtcctaagaatttatgaaaaaagtagcgtccctattcatacataactatacttcttataaatttatgtttaaaattttttaattaattttaaagactttagagatatttcaagaaatttactctcttctaatagaaagggctatgttttcgaatggattctcataaaaaataaactttgaattttttaactatgaaatttataaaaaaaaatttgctctaccattcaattaccgaatcacaatgacaacagtgatggccagtagatgaactgcagcaaatgcaagcagtaccatggcccataatattggtgatgatgtaatggtgtgaaaatttgtccatcgctggtataattctgctgttcaaaattattgcctgcttgatcaagttgatgggaaggaatggggcaccactgtttaaaaaaaaaaaacagtgccgaattaaaaaatgaaattttatggcattttttatttttttaaaattttcctttttttt

SEQ ID NO: 35047 - DNA, 752 bp, Heterodera glycines
agagaggagaaggggagataaaaagagctgcgggaaggccatggagaagagagaggtgttggagagaatggaacagatgtgcgtgagagagagatctgagggggctataccccccccccccccccctactaccgcatttgtgtagggactcatgcgaatataagcgaacataaagtcgtagagaatgactttctgcagccacaaatcgtacacggccacaataatctgtaaaatgaatgaaaaatttcacaaattttggcacttgccggaatggcaaagcacacgccaatcaccgccttcagagagcgaatgctcaactcgacgttttggcacacgtaagaggtattggtcaacgccaaggacggggaagaggaaatagaacacctaaaaaggagaggggcagggtaatcagagacgctaaaataacaaggaaatgacagagaaaaaggaagtgcagccgtgagtggtgttgtagagaccggtgtgctataaatcgctcataaacaaggacgagtctgactctgcaggtgagctgaggtttaaattatttaggtattaattgtccaatttgcttttgctctctgattttgtgcaattctccacacacagacgtaggaaaagaccgtgtatcgaatagtcaatgctgagaagaacgaaatccataccatcggaacagattggcactagtcattcccaaagtggggaatttgtctcgggaagtgatctgtcatggcctcagccccatgtaaagc

SEQ ID NO: 35048 - DNA, 979 bp, Heterodera glycines
ttggttgggcaatcttttcaccgaaattgacaacaatgacaaacaatccgcttcaaactcatcgtcgcaccacacatcactgcgcctaatactggaggacgatgacatggacattggacgtaatgagtgcagtcaagatgctgcaccatcatcctattggtgaaactgtgcaattttctacccacatattttattttccattcctcattttcaatatagattgcatcttcgcttgcttaattgtgcatttttcaacctaaaattgacttcttataatgcttaattattttaaaactttatcttcaattctttaattatgcattaatttttattaaaaacgaataaaatggtataaaatgtacacgtaggtacaaaagaatagtcatgtgtgtgtgtgtgagagagagagagagagacaatgtacaataaattacggtgtgtgtccaaaattcagcacattgaaatcagcgcctattatgccctttcccacaaacggacgatagcacttttgcataggcatggaaacgactcggcctccctccctgatgttaggtcgaaggaaatttgggtacgtgactattattggctcgtattcaccacttgtcgcctaccggaccacctcctctttgaagttctcatagcgcatcccttggttgttgatcacatcataattcagcgtcagtccgcgcactttgagcacatggtccatttgggctcccgcctccgcgcccttgcgtcgcagacacaggccgtactaatgcgcggaaaaattaaaaaaacaatttgcacagatggtaactttacttgttttgtcccaccactgcaaaattccacaatgtcgtggtctgggtactcgtccgtgaactggcccaggtgggtgccagttttcagtgggcaccgcttctccgggtggaccagaatgaggctgtcagtgtctaaaataattcgatttcatcatcggttttttgtgcattgttgc

SEQ ID NO: 35049 - DNA, 989 bp, Heterodera glycines
ttaggcacacataggtcactttttatttatggtcacaattttgaaattgtgtatgtcctcaaatagcgtttgggcccccgtttttgggcccccgcgtttggcccccgtttttgggccccgggatcgtttgggccccaacccaaaaatagaaaaatgtgcttttttaaaaattaagattctaaaaactaagcctgagggatccctcttaacattcgctcattttttacaattttacttattccaaatcctattattttttaatagttaaccaatttgatgtacattctgatttggacatttttcagaaatggctaacccaattgcaaccaaaaaacaaaaagtaaaattgtcttacgaaggccacctttacaccttcgctaaaatgagttctgatgggatgacaaaattttggagatgcgagttcaaaaacagcaccaacaaatgcaacggccgaatctggacggacctccacgaccaattcattcgcctcgcaactccgcacaccagggatgggccaaattgaaaaataaaaagcgaaatttgcgaaactgaaaaatgcgaaatgaaaaaaaaagcgaaatgcgaaaagctaaaatatgcgaaaatgcgaaaggcgaaatgcgaaagcgaaattttttctgcaactttttaatagttaaaatcataaagcaaaaattattttttttaattttattccaaatttaaaaatcaataaaacgcttttttgaggcgcgctttttccaaaaaaactttttggtaagagggggcaggcggcgccggcaggcgccgccgggaaaatttttgaaaatttgattaaaatttgttgacagattttcactaaaaaatgatcaaattttgtgatttttatataatttttctaaggagaaataagagttttggggcgccgctgaacaacggcttttcatcaaatttacaaatttttgcgaatttggggccattttctaaaaaaaaataaggagttttggggg

SEQ ID NO: 35050 - DNA, 865 bp, Heterodera glycines
aaaaagaaatagggatttttgggaactatttttcaaattttcacggacaaacccgtactggaaaattccaaggaagtattgggttcactgctatataatttcaagggccgactcagtccacaaggatagaaaaaagaaatagggattttggaaatatttttcaaattttcacggacaaacccgtactggaaaattccaagaaagtattgggttcactgctatataatttcaagggccgactcagtccacaaggatagaaaaaagaaatagggatttttggaaatatttttcaaattttcacggacaaacccgtactggaaaattccaagaaagtattgggttccctgatatataatttcaagggccgactcagtccacaaggatagaaaaaagaaatagggattttggaaatatttttcaaattttcacggacaaacccgtactggaaaattccaagaaagtgttgggttccctgatatataatttcaagggccgactcagtccacaaggatagaaaaaagaaaatgggatttttggaaatatttttcaaattttcacggacaaacccgtactggaaaattccaaggaagtattgggttccctgatatataatttcaagggccgactcagtccacaaggatagaaaaaagaaatagggattttggaaatatttttcaaattttcacggacaaccccgtactggaaaattccaaggaagtattgggttcactgctatataatttcaagggccgactcagtccacaaggatagaaaaaagaaatagggattttggaaatatttttcaaattttcacggacaaacccgtactggaaaatcccagaaagtattgggttcactgctatat

SEQ ID NO: 35051 - DNA, 624 bp, Heterodera glycines
  misc_feature (13)..(13): n is a, c, g, or t
aataaaattttancaatttgaaaaaaacagaattataaataaattttcaaggaatatttttttcaatgttaatttttttacaatatttattaaaaaatgataatttgtattgtaaatgttttgacatttttcctttcctacatttccccgtaattattgctgaaatggagaagttatgggaaaaaattatgatttaaaaaagtaatttaaatttaaaataatgattattattgtaattaaaagagagaatttgttcaacggattaaagaattttaaagaatatgcgaaaatgggtatccgaaattattagtgaaagagttaagcatttctataaatggaaaaagaattggcattaaattaagcaaaaggaaaattattttaaattcgattattataatgggcataaaaatatcgttgttttagcctcaaaacaattgtttcaatattaacatttcataataatctaatctgatcataggtcttcaaaaaatttctgttattttatgtctgaaaattcgcactttttcggtctgcctcgcctggtgatcaattgaagtgaaaagattttttacatatttttttaaataattcgaaaaaattgttttaaaatccttcaaatattta

SEQ ID NO: 35052 - DNA, 828 bp, Heterodera glycines
cagcttcgttttgcccttctccatttctcttcgtccatttcacaaaaaagcatttgcatttttttaaacctttgaattaatgtggtaacacaaaagaaattaatttgtttggcattttcacgtgccgtcaatgactcgtaaatttgggtcgcttccccttggtcgaattttggcattttccattcgccgtgccacccgtcgcacattcccttcccaaagtccttaattaattaattaattgcattttgccattaattaattatgagtccaatcgtcttcaccacactttaaaaaggatgtgcacaagtggtgcctttctcagcagtgtcgtccatttttcgctgctttttcgcatcgtttcgttagagtacaaaaacaacacaaatttgaacaataagaaaatttgcttttcaggtttcaaaataaggtccacattttggagcagttcgtcccaatgtttgcctaccgccgacgcctccgcaacaacggacggcgaaagtggcggaaattcaaatgccaaaatggacgcaagcaaaaccaattcttcgcagaccaaccgtaaccaccacagaacctatgaatttttgtcacaggctaatcattttgattcattaatttgtcagtgggaattgtccttcataattccccgccccccaaatgctaatttaaatttggcaaaatgccgacaaaatgtttgccaaatcccatagaattttctccctcccattttgtgccactttctcctcacttacccccaacattttgatggtcataacttttttagcgcttaccatcagatcaatttcgaattgtccatatcttccagaa

SEQ ID NO: 35053 - DNA, 1077 bp, Heterodera glycines
taaacagttcgaacccggaggacattgagtcacttaaacaagcattgaaaggagcactttacgaacaagaggaggagggacagtcggaccatttcaaggcggccatctgatgacagagggaaaaatggcaaaataaattaagacggttaattaacaatgggtagatcattaacataatatatcttttggttattttggcacatttcactatgaacatgtcaatttttaaaaaggacggacaataaagttaaacagcaacattgaaagcttaaggcgtacctaatcatacgaacaaacgttagcaacttggttgtggagtacacagctaaatttatatatcttattcttgtgctaattgatttagttatctaaaaaattattaggctctaacttagagcaaccaatactgctgttcttatccccgcctgattccaaccccggcgaattggggtcggttatgactagggagtccaattatatgcacatgcatatttttttcctggactgtgtggggcctgaaacgcacgaaaaacatgtttttagcgtgttttgaagcttctaggatgactttccatatgcatgttttgcatatttgtgcacatttcgcgatttatgtgcatattttggcatttcgtgcatattttatgtgcatattttggcgtttttccaaaaaacctctaatagatcggcccccaacagacaaattggcctttttgacctcaaaaaccggaaaattttccaaaaaataattttttagcaaaattttcacgaaaaatattgaataaataaattttctcaaaaatggttaatttatgtcaaaaataagcaaaattttgcttttcaggttgatttttcgctaaaatgagtaaattttaagctgtatcgtgtttttttctcctaaaatgatttttaataccacatttagccatttttgaagattttactttatgtttaacaaatttgaagaaattttgagaaattacaccctcaattggaaaattttatgtgcatatttttcactttttatgtgcatatttcacgatttttggtgcatattttatgcgcaatattttgcga

SEQ ID NO: 35054 - DNA, 1035 bp, Heterodera glycines
gattaccagcaaaaaatgtcggataatccaaacgaagcagagaaacaaatggacaaggcgatgtaatattcttaatttgaaatttccatggctaatcattttgcttttccgttttcagcttcatttctgccgattgttggttgggagtgttcgatttgcttccgctttctcagcttggactgggaattgcattgatcagtcaccgatttgactatttcgttgacgaacatttcaaaactcgcaaatggaaattgagaccaattgtaattcgacacaaaattggagaaaatggctcaaaggaaatgcaaaattgtcaattccgatgaaaaagctttgccaaatccacaaaatccgttgccgaacaaagtcatcggattcagtggcattcagatcatgtaaaaaaaattcaatttttaatgattggtaccaatcacactttcttatgttttcagcttcatcgaccaaaatgtgctcattttccttcgccgttttgactgttttttcgcctcttgtgcaacaaaattggcaattcgcactgaaaatattcgtatttcggagttccttctgctcagaatttggccaatgttcaaagacaccacttatctgttgtgtttctaccctatcgcttttcgtctaatccgtcaattggcctcgtccattctcaacgaatttccatcccttcgcattgttgctttccaaggcgccattttccccgcttttccgcctgatgacagtgccaatgcgttggatggccaagcggtggccaaatggctgtttactcctcatcccagcaatttgatgaaggcgttgtatgtcacaattgagaactcatcggttgaccaattgttggcaacatttgaacaaatcaaagcggtgattttttgtccaatttaattcattttttaaatattttttgtcttttcttaggcattttccatcgcttcttctcctgttgctttcgtcatttctattggtctttccgtcgtcctttccgattgactccattttgccatttaaactgaccaacgaaatgac

SEQ ID NO: 35055 - DNA, 927 bp, Heterodera glycines
ggggggggaatgagaaattcaatggttgaaaatgtgaaatttgtacaaaaatcattttttatataaaattaaatatttttttttttttgtaaaaataatgaaacttcataaaaaaacatattgaatgaaagacaatataaaatcattttattgacataaaataattaattggataattagttggagccattttatacttaatgttttaaaaaaaaagaattaaattgaacaaaaaattgaattcgttttcaatgctttagtgttttggctataaaaacgctggtcaatctatgaattaatcatttattgtttttcaagtaggctattttgattagtgattgattaatccatccactgattcaaaatttaatttttctttcaaatcataagtattgcttttattttttaattaaaatttgcttttaaatattgtaataattttcttcagcttcttcctaataattaataattaaaaaataaataataaatgattgactgactgactgacacaatggcaattttaaaaaaatatttttacattatgagaaacaatttcttcacacaatgtcatttggtttttctaccatttcagggcaaaatttgtagctttgttaggaaatgagattcaaatgtaattaattaaaattaaatcttaaaccaattattcggattgaatcttttcaaaagtttaaaacattgtcaaacaaaattcgtcgtgtttctttatttatttacttgcatttatttgtttattaataattttacaaaaatgttctgattgtggggggcgggtgaaggtacaaatgtggcaatgtaaaatttcaaaattttccgctcaattttatcaataggttgtttaataaacaataaaattaattgcaacaaaatcgtttatgcaacaagccaaaaatggcaccaacagatcaa

SEQ ID NO: 35056 - DNA, 1200 bp, Heterodera glycines
tttttgatttcctctagcctaactttttttaaacttcattaaattttttgaaattttggagacttatagagaacactaagggctatcgaatgatatcaagaattaaaaattcagttgcttttcagctaagttataaataatttttcatcaaatcataatgatggttttttaagtaacgactccgccccttttgcatgtatgtgtgatcatttaaaacataacgtgcagataataacgcaccgaatcggtgaaaaatggatcaaaaatcaaaaagaatgattggaacgtcggaaagccattcgcaaatgttgctggacgacctgatgaggaaaaaacaaataaattgttgcctaaaaatattttaaaacaaaaccactaaaattatttatatttcaaacaaccttaccaactgtgattgcggagtcactctttaaaaaggcccaatttttcagtatggcggcattcttgaataggtccgggtcaccaaaaccttcaatcctttcttgcagtatctccattaaattttccaagacttggctgctgttttcattatgccactctctaaaaaatttatgctaatttgaatatcaaatattattgttttaaaatacttatcttacaattcaatttgttaaaaaaatgcaactgattcgtcaaataaatttttaattgcctatttttagtagtaaaactcataaaaaattaacaaaagtttatacttcagttgtaaataaaattattaaatattttacagcaaaacccataaagaatcaagaagattaatttttttatatttcaatcgtaaatgaaattattataatttagttttttcgaataagaataattttcaaataaaaagctaggggtgtatttttcgttttttatttcagttttgttaaggatttttccaaaatcatataaagtcatcgtagaaatcccaaactgtttcaaaaaggttttaatttaaaactctttaagctaaataaaacaattttttctctttaagccaactaaaacttctatttcttttgttcaaactgctaggggtttaaaaaattatttttaatataattgcataaatttactctatgacgtttgcaatttccacaactttctcattgtaccagttgttagcacgttttgcccgttcgtactgattgacgaagtaccgaactgccaaaacgtttacttcattctgat

SEQ ID NO: 35057 - DNA, 461 bp, Heterodera glycines
tctctccccttttcctctctccctttctctctcagtctttcttttgtcggtggctttttctttttttggtcggttttttcgcgtaatgcgaaaacaaatgacgacggcatggacaatgaaaatgatacacacattaacagatgaaaatgtgatgcaatgaattaattaatggaaaatgcgggtaattaacggccgcgccagaaatgttacggtacagtacgcccttttaatcgcttgcccaatcctccgcccgccccctcagggcatggatttgttaccgacaaaaaaggagcccactaatgtaatgttacactggacaactaatgagcaattaaggtagtttatcaaacatacctcaggggatatatgataacttagtcaaagcactcaaaaaggggggggggggtattagagaggttttcgaaagtctgtcaaaacgggtaattagggaatatttggcc

SEQ ID NO: 35058 - DNA, 1315 bp, Heterodera glycines
acgtcttcagggtaaaaacatttaaaatcaaattgttacatttaaattactctatttttaattaaaattacttttttcagtgcaagaacgactgaccaagcaaatgctttcagcaattctccaagctgtgcacccgacgggcgtcggagttgtgattgaagcgaggtgaacatatatatttacattatataacgggctttggggaagggcacacaaaattcaagacggcatttgtttgctttttctattcaaaagcaattctcgaactcaattggctatacaaaaccaaaaaccatatttttacgctttaaaattgagccaggtttaattcatgtgagatttatagatttttttacaaaaaattttccaagtgtagacttatgcaatgctttagtatgatatgaaagttgaaaattgaggtgctttttaaaaattaaaaatgtaatttttatttgcacaaattatgtcgctattatttttcttggggaaatttatagcttttttggttactcaaatttggatatatattatattgtttgtatgaattcccattcttcagccacatgtgcatggtgatgaggggcgtgcagaagatcaatgccaccaccaccacctcgtgtatgatgggcgtttttcggtaattttttttttcaaaaattcagaaaatttattgttttagtacccccttatttttcagcgatgatccgaagacgcgcgaggagtttctcactctgatcaaaaaatgagcgggcaaaaaaaaacaattgtggacagagaatgttaccaattatagcttcttcgtttgattattttactattattgtaagtagcgattaaacttttcatttgaatttatttttatggaatttgattgaaaaaattagagttgagcggtaatcggtaattgtaaaaaaaccggtaccggtactgaccggtaatgcaaaaaccggtaccggtaccggtaccaactttttccaccggtaccggtaccggtaaaaaccggtaattttccaacgtaaaaatttttggacaaaatttttcaaatacaaaatttttattcagttttcgcgcgagtgcctgttttttagcattagaattgttcagaagtatatgtatattgagggtgaccaagtttttttttcaaattcaggataaagaacactaaaattcagatgtagacctcaaaattcagattattgcaaaacaaggggtcagcagccaattttccaattttgcgaaagggtctccggccatgtaaattaatgtaaatcaatgaccttttttgctttcaacaccgcttttttcgcggcacgtt

SEQ ID NO: 35059 - DNA, 415 bp, Heterodera glycines
ggggatgcctctagagtttaggtgctgccatatctggcgcatcccttcctcattcccttaagtccacttcacggagacgaagaagacggagccaaccttccagcctccccctccccccccccatcattttggcgtgactacgcgccacgagctcggacaacaatgacaaatggactctcggggactccggctttagaaaaatatttactttaggattatttcagttatttgaaataaatattcaaatagttaaaaggtaagttaattaaaatgtttaataagatttttttaaaagttttatgacgcagacgatctacagcttcaaactattagctgaattttatcatttagctaattataaatcttaaaattaaatttacttacattttttttgtctctttccggcaaaaacaaa

SEQ ID NO: 35060 - DNA, 890 bp, Heterodera glycines
aataaacagacaaatgaagtttctgctgtcattgttttcctctccgccgatgatcatctgtctctcacaaacattgaatttgaaatgagtgattttctagcagaattccgaattaatgagaagtgatcgatcaatcggacgaatgggggggggcgaagaatgtgaggaattttgccgcttgagaatgaatggcaaaagaaaatgtcggaatttgcgatggattaaccctttgggcgacaaatggccattgaacaaacgatcagcggaaaatcagcaccgacttatcagaacatgatcaactcgtcaaattctccaagttagcctcctccgataaattcttcgaattgctttttcggtccctttgtttggctaataattccatcctcccccctctcgcccaagtaaaatataaagagcaaagccacgacagatgagtaaaaaatgtgccggaaaagggtggcaatgatcggtttgagaaaaacgggaaaaacatacaacggttgaccgtagccgaaggaagaccaaaggataagcagaaggccgagtatcattaacaccatagtgatgataaacacaaagccgatcaaactgaaagaacggtccacccattaaatgtaaaatccacgaaatgacgaggtttttgagtaaaggaaattgatgaaatggataattgacttaaatgaatatgccttacacctccctcctcccgataaaattgtcctcaatttttgattgagttcaaaatgaaggagagagtaaaataattaatagatagaaaaatgatttagatatttatgtagaaaataaataaattttataaaaatttgaaaagaattaagcgaggaagcaaattggtgtgcccggaaatgtgattgttttttacgctcgcc

SEQ ID NO: 35061 - DNA, 411 bp, Heterodera glycines
tctagagactctatttccctggcgacttcttttcgcactgccccccttcttctgcctccaaaatgtttaggttatttaaaaaaatttcttattccgcacaataatttttttcttatttgtctatttaataaaacgatgtttttatttaaatttgagcattaaatttatttttgtgcatctccctttttaatctggcaactttcgtcccttttgctttgtcccctaattgcccctccccaattaatttgttgccaaacaaataaatacttatttgataattgtctcgcttcctcagcaaacaaaacactccttccgtcttctgttggtgcctttgtctttttgactttttgttacggacactctctcccccctctctctctccccctctctctctcccctgtctgtctccgg

SEQ ID NO: 35062 - DNA, 879 bp, Heterodera glycines
agtcaaatagtattagactcttcttaaaaaaattgcctctaaacctctaagttttaacattctttttaaacaaaatctcaaaaaataatttttccttggtaattgaaagagcctggaaaaaacatactttatgttcatagtttgaaaatttcgaatgctgcaccgaaacggcgtgtttacgaatggcattggcattttcatttcttcttcgcccagcaatggttggcgcacaaaaagttcggcgccggtgccattcttcgcccgttgcaaacgcaacgaataaatgtaccaatggggaaccctgaattaattatttaaaacaattaaaataacaattttcgagaattaagcaccatttactcgccagaaattggctgtcgaccagcgcatcaagacggcagctaatcagtgccaatataagtccaagtttagcatggctaagaaagccaaagacatcgaaccatacgtcgtcacaaacatagctaaaatgggagatacaaatatggcactgagtaatcattgattaatcccactgatcaaacttttatccatcagttgctgaccagagttaatcattaactcaaaagttcgcttacatgcatttatccttcattatctgtgctgggctggtcaacggatcaagcaatgatctgaccgagcattatctttcgctaagcttatccaaattgacaagtcactcgctgacctttttaacatgcactgatcatttaataattcagaattatatgctctgacccagactgatcaatcatttaccattggatgatctgatcagtctgactcatctcatggtccgacccggagtgattagttctgcgctcattagctttatcactgatcagatccggctgatttacc

SEQ ID NO: 35063 - DNA, 897 bp, Heterodera glycines
ttgagtcccagtgattggaatgctggtgggttgagtcccagtgattggaatgctggagggttgattccggcgattggaatgctggtgggttgagtcccagtgattggaatgctggtgggttggttcccggcgattggaatgccggagatttgagtcacagagattggaatgccggagatttgagtcccagtgattggaaagcttgagaattgagtcccagagattgaattgctgttgggttgagtcccagtgatttgaatgctggtgggttgagtcccactgattggaatgctggtgggttgagtcccggcgattggaacgatggtggattgagtcctggcgattgaaatcctgtgggttgagtcccagtgattggaatgctggtgggttgagtcccggcgattggaacgatggtggattgagtcccagtgattgaatgcaagtgggttgagtcccagtgattggaatgctggtggattgagtcctggcgattgaaatgctgtgggttgagtcccagtgattggaatgccgcagatttgagtcccaatgtttggaatgccggagatttgagtcccagagattggaatgccggagatttgagtcccagtgattggaatgctggtgggttgagtcccggcgattggaacgatggtggattgagtcctggcgattgaaatgctgtgggttgagtaccagtgattggaatgctggtggattgagtcctggcaattgaaatgctgtgggttgagtcccagcgattggaatgctggtgggttggttcccggcgattggaatgctggtgggttggttcccggcgattggaatgctggtggattgagtcctggcaattgaaatgctgtgggttgagtccccagtgattggaatgctggtgggttg

SEQ ID NO: 35064 - DNA, 952 bp, Heterodera glycines
  misc_feature (944)..(944): n is a, c, g, or t
cattttaatctacacaaaattacccatttttaatgctgtaatgggcgattgattttttaaaatcaattttgattaaagtgtgaaactaaaaaaaattttggattttcgactttttgttcgagtccgggtcgggtttcgaaattggtcgaaattaaatgtctaattcgtgtttagcaaccctgtaaaccttttggtatcatcccaaactgaccagttgaacgtggacaactcatgcgataaccaatgacgacttgttccaccacttccttgttgttcaattctttttaaaaaacgggacatgaaaattaattatttcgttaattagtacccggatatggagttgcacctcgggtgaagatctcgtacaacaaaacgccataagaccacacgtcggatttgactgtgaaagttccttgaactgcagattcaggagcagtcccttaacagattaagaaattgtgatgtgaatttgtaatggaatttttaatttacaatttgctttttcctggtcttaaaaaattttagaatagaagtttttatgaaaatttcaaaaaaaatgtattgaaaatttttttagcgtttttatcattttaaaatgaattaataaaacgctttttatcattttgaaatgaatttctaagtttttgcaaaaatttttcttataaaaaatcgcttatgtcaggaatttaaaaaataataaattttcggaggggggggggcgaactgcgcccgttattgagccttaaaattttaaattaataataaccaaattgacaaacattttaatggaaattttgcaccagcatgtgcctcgtaaatgtcctcctccataagctttcgtgccagaacaaaatcggcgaccttgacgaccggaaacacccgaattttgtcgcccaccaaacattacgagcggccaaatcgcgatgaaccaatttacgctcctnccagtatt

SEQ ID NO: 35065 - DNA, 1167 bp, Heterodera glycines
  misc_feature (48)..(48): n is a, c, g, or t
aaaaaattttcaataaaaaggctatttagataaatggtaatgatgttntaattgaaatgttaatgcccaaaaataagacaaataattttcctgtgcttgattattggcgctcatttgctgtgcttggaaaacagctggatcacgcgtcaattatttgatgaacttatgcatattttgtgccaggtaacaaaatggggagagagataagccaaggaaatgtcccaatatttcttttttcgcttgcttctctttcattctctcatttttgttgttgtaaatttaaaatttaaccaaattgttcatttttaagttcattttttcctaacaaataagaactcatttttaaacagattattatttgggctttattttaatttaaaatattaaaaaattacgcttttagaaaatcttcaaaaataattaagtagacaaatttatcgtgtcagatgctttcaagagtagcagcagtagaagtgaaatgtttgagaatggaacaactaaaaataaaatttccatcgcccgaggcggaagaattgaaaatgatcgcctcgaagacgtcatcatcactcatatcatattcttttaatatgatggaatgtgatgaagatgaatgtcagtggtaacggacggactaacagatgctttaaaaagaccaaataatcaaaacgccagagaaaggcatgacaaaaatggaccaccacaatgaaacaggtgggtgatgggcgattaggcaacattcgttttttgaatgccgttctttgctaataatcacttcagatcaaatgtccgtccgtctaaaaatgtgtctcgaatccacgccacagttggccatgtgttgaaccaatatttttggacgcaaattcatctgatcaatgatcaaatcagtccataaatttgtccttgaaaattttgggtataaaaggcgggaagaagtattccatcgaaacaaatattgtagcagccaaataaaaaattctattttttcaaacaaaaaagtttttgaatcatgatagtctcaatgttttattgttcacttattttttacagtgataattattttcccgttgaaaattaaaataaaaccgcaatgttagcatcagcaaaaacctatttcaaactcttatttaaactgcaccgactgagaatggtccaccgcagcagctcagc

SEQ ID NO: 35066 - DNA, 147 bp, Heterodera glycines
ccattgaatgttcagcagaatcccttcggtcagtgatgagtgtctctatgtattggtttttcatttgcttgtcattttctgtaggaattcgtttcagtggggaacaggccaaagaaatgacgtcggttgcaactgaacgaaacgaat

SEQ ID NO: 35067 - DNA, 874 bp, Heterodera glycines
gaaaagggcttttttttggggggggggggaggtacatctctcgattttaagccgattgccattcctcctggccgtcccttgtatggggcattcaacgcacctcagaggccgcctccattgatggatatgccggttgccccggtaggtactcttatcccatttccacgagtagccagaagatttttggagagggggtgttttcggggagattactgggcaaaatttttttcaaattcttctgcttggaaaaaatcaatcccccccccccgttttttggcggggaaaatttttctccatttccaacgagtctgatgctgttttttagggagcatttgcccctgtgcagccacaacaaagaagaggtcgtttcagaccgccgacaccagggggttggtaaaaaaaaataaaaatttctgaaaattctttcagtggcacttcgggacccgagacttcgagaccctagatttaggaggagagttttgcgtgaagtggaccatggtgctgataaaaaattttctattgaaagatggtttttgatttttagttgtcccgccaccgcaagagccgtggcgagagcgctggggagaccatgatgaacgcgagccgccgccaccgggggtcggggcttaagaattgatgtggatgtgtggaagaggagggaggaggggggggggcgaacgacgagacgtccttctgattttcggcgatcaattttgtttgttggaataaaaaatttttctctgcttcggtgttccaagaaaaaatcagttaaagctgatataattatctataaataatttaattttgatttacattgttttagttaaaatggaaaacaaaaccttttaaaagtttcaaaggaaaaaagacaaaa

SEQ ID NO: 35068 - DNA, 960 bp, Heterodera glycines
ttgattcagttgaaccccagaaaaactccatggctttttaaattttgtttttgtttacaactgtcctatacttttatttatatttctgtgttttttcttcttctggccggtgcttcgacggaattattcggttttatttaatgattgctttgtgacaaaactcgagtgttcagagcatacacagatcacttttcttttctttctacgataattaacgaatttcttccatttaaataatcactccataccaattgagataaaaataacactgaccaagtacagaattccgaataaaaaatcgtataattttttatggaatatattaattatattggcatgtttcccttatcttaagggtcattggaactgtagaaggactttgacttaaaacgcacggtttttgagaaaaattttggcacaaatttggaattttctaataacaagagtgcactcaattttttgctgaggtatttttggttattctatggaattttttaaaaaggcgccggataatattatcaatttttgcaattataaacaaaagtttgattcagttgaaccccagaaaaactccatggctttttaaaattttgtttttgtttacaactgtcctatacttttatttatatttctgtgttttttctttttctggccggtgcttcgacggaattattcggttttatttaatgattgctttgtgacaaaactcgagtgttcagagcatacacagatcacttttcttttctttctacgataattaacgaatttcttccatttaaataatcactccataccaattgagataaaaataacactgaccaagtacagaattccgaataaaaaatcgtataattttttatggaatatattaattatattggcatgtttcccttatcttaagggtcattggaactgtaaaaagaactttgacttaaaacgcacggtttttgagaaaaattt

SEQ ID NO: 35069 - DNA, 1170 bp, Heterodera glycines
  misc_feature (1098)..(1098): n is a, c, g, or t
  misc_feature (1107)..(1107): n is a, c, g, or t
aaatccaggtccaggaaaaatccaggctcctcgagacctggatccaggcctggacctggatttttttaaactcattttaaaaatcaaaaaaatgtttgaaaaattcaattaattgcttgggaacatctaaaaatatctaatttacaataataatttgtttttaaatatatttaatcattttttgaaaacttgaaaaaatatcggtcacttgaaataataaattctaaaattttgtccaggaaaatccaggttttttcgtgttttgcctggacctggattttttttcacattagacctggacctggatttcctggacaaaaatccaggaaaatccaggtccaggaaaaatccaggttgtaaaaaatgacctggacctggatccaggaaaaatccaggcctggatccaggtccaggtcgaactctagtttttactaatttttattttagatttaaaaaagatgattgaatgaaacgaaattgacaatttttgggtgatttttagtaagaatcaaaagtaagactgttaaaccctgatgatttttcatcattattttagcagtttttagtttaaaaataaatacatactttctcaaatgcgctccaattttcttcaaggaactctttggccttctctgtcgcttcgtcgatggtctcgcggaccgctctgtcaagagccctcttttccctcttcctcccgcgttccctcctccgtcccctctttttcagcaactaaatttcaattatgctacctataatggaacattccaactttaattgttcaaaaaggagttcattgatcctgaatttcggatttctttttcgccatggccccaaaatgatcagaaaattgttctaaattctaaaaaagaatgcgaaaaggaccctttttagagcttttttgcgtgttttccctgtgagcaacggtgagctttgacggcaaaaatgaaacctccggcgcattggcggtcgccgcttccaaatcgccctcatggccatgactctccccggtcagtagcaattccgccgctcttccggccatgtcggcgatgagacgggcttccagctccgcgattgagcagtcccttgggttaactgttngtgaaagangtacccatcatttccctggctttaattcatttcaaaaaaaattttattttcgaatatactttt

SEQ ID NO: 35070 - DNA, 890 bp, Heterodera glycines
atagagtgctcatttttcagcacaaaaaatcaccgattaagcacagtaaaaagcaccaaattggagatgaaattttgagaaagtttttcatttctttggtgtatttttttgaaaatttttggatcgtttcttatgtgtgtatttttcgtttttattatatttttgttaataaattttaggcaaaacgccaaaatcggtttttcaaaatttttagacttttaggctctaaaaataaaaacctagaaaataggctccattaactcaaaaagtagcttaacaatcaccaaaaaaaaaaaattaaacgaatatttttattttttatttattaaaatgtgtacaaataattgataatcaggccctgggtttattatttttacattgtgcatattttatcgcataaaaagttcgaataacaatattttactgaagttcatatcaattagagcgaagttttcatattaataaagctgattaattagcagcatttttttaagaaattaaatttttaaaaataattttggggaacttttacgttatgccgccgcccccccccacccataaaatgccatatcctgaacaaagaagggcacttttctagggttatttttgttcactgatcaagaatatggcttcaaaactgctgtaacggatgaaaaattatactttaatcataaattcaaatttaaaacaaaatctcaaccaaaaacaaaaaataatttgaaattttcgcattttttttctttttcattgcaatttttccccaaatattcttctataataaaaagggttcaagccccgccccccccccccgccccccggggacggaaaggttttttggcctccccccccggccgcccccgaaaatcaaatccccgcaaatccccgccccc

SEQ ID NO: 35071 - DNA, 843 bp, Heterodera glycines
atagggaagctattcccgaaggattcggtctccccattatctgggcgcatcggttcggggggactgccccgaaaatttaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaaattttttagagcaagctagctcggcgctcatttcagtgtaagttagtcctttaccggggagtatccctgcaaagtttggtatgcttctgctcaattagcaaaaaatatgagtgatcaaactttcactaaaaagttaagcctaaattttttggcatatttaaaaagcaattaaaaaatttttaaaattttattcacctccattattgatagaaaagcatcatagagccttattaacttgtaaataaaatttggtgcgtttcagaa

SEQ ID NO: 35072 - DNA, 967 bp, Heterodera glycines
aggcgcgcgcagtatttttacctttggggaaggcggagaagggcataacctttgtaaatagctaatttattcatgcgctgatacaattttgatcttttccctcgcccttttgcaatactgcgtccgtctttgttgactttaaaaacaaaattaattttgcggtcacataacaggaaagtacctgattatataaccacagatcattagcatagcagtgaaattttctaatattttgcattttaaaaaaatcagatttttccattcagccattctcgagatatataattttaaaaaatcaagtgaaaaatcgagtaaaaataggacttgatgccaaaatcgagtgcggcactcgattttttactcgatttaattgaaaaacaatttttgcagtcgatgtcgcaaaaaatcaagtcatcaagtcgaggacttgatccgtgaaataggtccctgatttgaaatctctttctctactttttactcatttaatttttacattttgttgaaaaatttaggagttttaaaatccataaaatttccaaattttatcacatattaactctgaccctgtgaaagttaatctatatcacttgattcattttatctgaatgtaattttcattcatttatatttgttttatgtttttaaatatttatgattagtgctggcaaatatggataatctcgaaatatttgatgaaatatagaccaaaaatctagaaatatggacataaaatacaaaaatatagacatatattttccaaatttatgtgggccgttcgaattgagcttttttattagaaaatgatcaaaaatagatttctatataactggcagctctatttatgataatgttttttcaaagctttcacaactttgaaaatttaattttctaacttttcatttttctactttttcaaaaaaataaaaaacaaaagataaaacactcttttggcattttcatacattta

SEQ ID NO: 35073 - DNA, 892 bp, Heterodera glycines
aaaaataaatgaaaatgtgtacgaaaaaattgcaaaattttggattttttggggcatctaaaaaattttctttaaaaaaccctcaaaaattgcaaaatatgtacaaaaaaatgcgaaaaagtccaaaatatgtataaaaatatgtgcatatgtaatatgtagaaaaaccccgaaatatgtaaaaatatgtaaataaaagtcccaacttttgttcgtaaacacaaaaaagaaagtgtttttcctactaattaggctatggagaatccaggaaaaatatttatttacataaaattagcagccctacccattactaattaactaaattctgcattaattggatttgatttgttagagttttggtcgaacacaatccatatttttggggtttttaaaaaatgatatcgacctttagtatttaaaaaattccaaaatacacaaatgtaaagtttgcatgaaaatttgtaaaaatcaaaaatgttttcatttagccatattcattttttttgtcaaattatgtatatttatgtttttatttcagtattttatcgaaaatattaaattcttattcaattatgcgcagattgctttctccgcctttgtgtttgtgttcctcgccaacttggtcatgtttgccaccatcttcggcattttcaattacttccattccacggaagaaatggcacttttctaaccaaccaaaatgaatggattggtttgatcattttattaattgcatactattttttattcatgttatgaatgtagcccatttgccagttttataatagacatcaaatttaaattcacaaatttatttgtgttttgaatttttgggtgcgcacaaagaccgaaaggcttaattttattattaaaaaacacattgattattaac

SEQ ID NO: 35074 - DNA, 1008 bp, Heterodera glycines
  misc_feature (804)..(805): n is a, c, g, or t
  misc_feature (818)..(818): n is a, c, g, or t
  misc_feature (875)..(877): n is a, c, g, or t
  misc_feature (931)..(931): n is a, c, g, or t
aatgtaattagttgtaccttattccgtatttgatggtgtacatttggttaaatgcacttccattaggatcagtccatgaaagtcgaatttgtgaggacgaaactgtctccgcaactacgccaactggagccgataaaccgttggaattgcttggcggctgttgttgttgtccgccaaatcccccaaaagttgactgtggttcagagaacgggacttgagtggccgcaacaacattcactggcgcagaaaacccgttgaaatttcttgcaggttgttgtccaccaaaagcggaactcggttcagggaatgaaacttgcgtgccaatgtcttttgtttcaagttgaggtccacgcacaataatgtccgaaaattcgaacaaatccacaagaggaggaggaggcgttccgagaaaaccagctttcggtgcgtccagaggttgcactttgctcatcaactcctattttgatactttgttatggaatatttttcagaaaatagtaccttttctttttcctcaacagttaagatatcttcatccacagcaaacgaattcgtttttctgcctgtctccggctctcggtgtcgaaatggcttaatcggtccctgtcgcgctaacggcgtagcaataatgtcaacaagtgaaggctgcgtaatttccgtatcgatggatcttgctgatggcatcggacaacgcctgaaattgtgaaagtgtgtcaattataagtttaaggtcaaaaccttcgtcacaagttattcccagttaacaactataacaataccgaatttaaatagtcaaactaaccnnaatatggttttcntcgtttcacggtcctccgctgtgccgacaaataaattgaagtctttgattgtgttannnattgacggacgaggcgggtcccgaagtgtctgcctggtcagaatcgacccgtgngctaaaccaacgctcactttcgtaagcccttttcatgtgtagcgacgatgatgacttaaaagaaaatgatttctatc

SEQ ID NO: 35075 - DNA, 731 bp, Heterodera glycines
  misc_feature (44)..(44): n is a, c, g, or t
aataaatattttgatgcggattttctgtataggcaaaatttttncggcccaaagacttagtaaacaatttcctaaattttgacccaatatactcatgaatatttttggtgcataatctattaacaattgatttaaattgaagaaattttcgaccataataattcttaaaatatcaaaaacaaagcacattaatgcaagcaaaatttgaatatgtagacctgggttcgaaattggactagattaacatgatactcaatagtcataacaagcgaatttttttcgattttttcttttttggacttaattgaactaattaccagttttgatcagtgatcacacacagttcaagaaagaacgagaatcataaataacacaaatattttcatgcgaataaaaaaggtaaaaaaatttctgaaggatttgccaaccaatttaataaatattttatgtttttaccattgttttgttctgttgcgactgtttctccgcccgttttgtcattccttttgacatttaacagattcggtttttgttcaatagttctattcgcagttgattttgagatttctctgcaggctaaaacgtttttattataaagacaatttttaaaattttattttgagtgtatttccccccccccccccactccacccaaaaataatattctcaaacaatctaaaaaacagaaattgtctttaaaatcaaatattgcgacgggtggaaacgaaatg

SEQ ID NO: 35076 - DNA, 891 bp, Heterodera glycines
atgcgcccagatttatggggagaccgaatctttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagactgaatccttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacagacactcacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagtctgtactttaatt

SEQ ID NO: 35077 - DNA, 1028 bp, Heterodera glycines
  misc_feature (45)..(45): n is a, c, g, or t
gcagaaatcggcagaaaattgtaataaaaacaaaacagcaattanatattaaaagtatttgccagagatgcaaacaaaaataaaaaaaatacaatcaattgaagcgaaaaaatgcgcgaaatttacagaatcagaaatggatacagtaatgaagagatcagatgcttctgctaattcattccaacaaagcgcgaatccgagccgcgtttcgatccctgaaaattaaattcatttgatggaaacattttttttttacatttaaactgactttgcggcagattttggtcggaaattcggcttcacacttgctgaaaacgaagtggaagctgatgaagccgacgatgagactgtcgacggtaagcccaacacatcggcataagagaggaacaacggcttcatctgcgggtcctgggactgaaaaacaaaaacaaaaattacaatttggaagcggacggaataaaaatgcaaattatcggagtaataattttcctttggtgctcatttaagtgcccgcaccttttgaggaaagttaactgtcgaagaatggatcatatttcggtgttctcgaatgttgttcccggcatatgcctgaaatttatgcaaattgcaagtttttttttgccaattttcgtcaaatacccaaacacttacgatgcatctgagttgccagtcgccgatctcctcgttccaatgcacaaatttctcaatgtaacgcacccgctcctccggaatgaattgatcgatgacctagccaaaaagggggaattacaaatttgatagattttgttttgtttccagaatttttatttaaaaaatgtgaccaatttagtggaaaacactcacaatcagaatttttttaataaaagatcgggtctcttgagaaaatttctaaatcgaagccgcctggactggaacaaaaataaacattgtatttctaatagatcatgtgcatttcctcgcaacatttcgccccccccgccccgctcgaagtcctcacgagcatggagtagagcagttcccgttggagt

SEQ ID NO: 35078 - DNA, 1029 bp, Heterodera glycines
atattagacatgaaaattttcaaaaactaaaataggcgcgaaaaaggtgaaagatcgcacaaaaaatgtactaaaatgttgaaaaaagaaaataaattttaaaaaagcaagatttcaaatgcttttttccagaaaagatgaaaaattaataaaatttaaaaagaaaaattatttttagggattttaagaattaaaatttagatcgattgttgggggtcaatttggtttattgaattgtagtaaggaattttccagaaatcaagtaaaatacgtttaaaaccaaattcaaaattgcacgatatttatactttaaaattttttttattcaatctggagactgatccagggcaaaaatttttcaagaaacaaattgttcttaggaaatatactaaatctaatacctttctatttgatgcatatttatcctcatttctcccacaactactacaaaaattttatacaattgaggataaatatgctgttttctttagtactgttcgaaaaaatcttgaaattaatattcccgaaactactttatctattaagtccgccaaaaacttttacccaccgcatttattatcttcaattagagaaaaagcacgtctatataagctaatgaaagaaaatagagacaaatatgaacctttatataaaagtatctccttacatattaagactcaaataagaaatattcaatcacgtaaagagaataaaatactatccggtgataagaacagattattttcctatgttaggaaatactttaaaccattcgaagatctacctgttattcaatataattcttcttttatttctgactcaatttcgaaagctgaaatttttgcaaaaattttttctgaaaactatattgtaaataatgtttctcttgattttgatatttcttcttcttcttcaacaataaacgatgttgaatttagcaatatttctgttggtaaagttcttagaactttaccaacagaaataacacatcatcggacggtattacctatagactattaaaaaattgtt

SEQ ID NO: 35079 - DNA, 659 bp, Heterodera glycines
  misc_feature (577)..(577): n is a, c, g, or t
aggcgcagaaacggccgcctaatgagtttgctaattagttgagactaattaattaatgaattaattgcaatcaattaaaatggcataaaatgattaatttttaagagtaagtcaaacgattttttgatatattataagctaccaaattaaacacattaattcaagagattctttcatcatttcaattaaaaataaaaatttcgtttttacgcataaattaaataaattttcatttttacggttaatttaaattaaaatttcccattttttacggttgctgtcgcgtggacatagtgcgcgttgatatttgccaaaagcatggacagaacggcgggcacgccaacgcacatgtatttggtgcacaaacagggaaatgagtcagggcctaacagaaaaaaatatatatttaaatttgaaattttaaaaaaatgtttctatgcttttttattaatgcaataaaaataaattgatgatttttttaaataaaatttttatgtgaaaatttcctttttcccttggtgttgtgccatccctccctctctgtttttctctctctctctctgtctctctcctcccntctctctctcctctctccctctttcttacaatagtgattagaagaggtacaaaagtgattagaagaggtacaacagtgatta

SEQ ID NO: 35080 - DNA, 552 bp, Heterodera glycines
ataattgcaataaactcacctttacaatttttaaaaacacaaacaattacaaaacacgcaaacactacaacaaacatagaacaatacaaaacaaacaaaataattgcaacaaacaattaaaattttcaatgaacacacattgacaattacaaaacacacaaaaattgcatcaaacatatcacaaacactacaacaacacatattgacaattagaaaacacacaaacaattacaaaacacgcaaacactacaacaaacatagaacaatacaaaacaaacaaacactgcaacaaatatattcacgaatattgcaacaaacaattataaagtagaaaacacttaatattcctcactcattctagatttctttaaaaaaatctcatgagtttgcagaagttatgaatttttgagggtttacaacatatattttggcagtttagttcttatttggccatttttgagctttttagtccatatatcgtgcttttttagtctacattttatgccatatttcgcgtttattagtccatataatttacagccctagtgatta

SEQ ID NO: 35081 - DNA, 687 bp, Heterodera glycines
  misc_feature (604)..(604): n is a, c, g, or t
attttagttacaaatattgtccccaaaatgacaaaaatttgtctttttttttcttgcaaaaaccactacaaattcctttttttctccctgcgctgaaaaaaggaagcaacttttgatgaaatagacgattttaagaaaacaaatccttttaaaataggggatttcggggtcgcttccacgaatcccataccaatcttgacgaaacccgaacccaaactcgaagacagcgaaagattgagttttcgcaaatccgggtttggggttcggaaggaatgagttgagatgggtgtcagaattgtaatcaacaacctcaaaaacccttgaaaagaagctttcacggttttttttgattaaaatttttttgaaaaagcactcctatcttaataaaattccaacggccggcaagcgcagaagtgtaaatgaaaaatcccaatttttgttcgcaaacacaaaaaataaagttttaattttaaagcaaatggaaaaataataaaaaatgaacgattttggtaaaatcataaaaaataatattctttacttcggctcgggattaactctctgaatatgttatgtaatttttttaaatttgcatcttaattaatcnatcagggatgtgcgaaaatttcatcagaaaccgataaattttaaatgaaatgacaaagttttatgaacaaaaaaatggataaa

SEQ ID NO: 35082 - DNA, 1729 bp, Heterodera glycines
  misc_feature (1236)..(1236): n is a, c, g, or t
  misc_feature (1369)..(1369): n is a, c, g, or t
  misc_feature (1376)..(1377): n is a, c, g, or t
  misc_feature (1386)..(1386): n is a, c, g, or t
  misc_feature (1406)..(1407): n is a, c, g, or t
  misc_feature (1439)..(1439): n is a, c, g, or t
ggggggggggggggggccccccccccaaaaaaaaacccccccccccccccccccccccgttgtgggggggggggggggggggggggggagaaaacaacccccccccccctcttttttatttgttgggggggggggggggggaaaaaaaaaacaaaaacaaaaaggtggggggtggggtggggggcgggggggggccgccccaaaaaaaaaaaaaaaaaaaaaaaaaacccccaaacattttttttttttttttttttttaattaaaaaaaaaacccccccccccccccgagagaaagaaaaaaaaaaacacccccccccgcccccccccccccccccctttttttttttttttttttttatgtagaagaaaaaaaaaaaaaaaaaaaatttttttttttttttttttttttgtttcgcccccccccccccccccccccccccccccccccccccccccctggggggggggaggggggggggggggggggggggccccgccactccctccccccctccttttctttttatttttttttatttttttttttctcttttttttcttttctttttttgcccccgcccccccccccccacaaacaaaaacaaaaaatattttttttttttttttttgtgccccccgcccccccccccccccccccccccctctcttagaggggggggagggcgcaccccgcccgggcgaaaccccccccccctccccccacaggagggtgtttattaggggtgtgtttttttttttctccctctattttgttgtgggcgcccaccaccaaccccccacaaaaaaaaaaaattttttttttttttttgtggggcgcctcccccccccccccccccccccccccccccttttatttggggggagaggaaacccttggggagaaaaaaaccccccccaacccccgcctttttttattggggggggtgttttctcccccccaaaattttggggggccccccacaggcgcccctaaaaaaaaaatttttttttttttttgggggggctcccccccaacccaatgcccccccattttttgggggaggcgaaatcttttgcgaaaaattttcccctaaaccccggttttttatttttgtttggggtttttgcccccccaaattttttggggttcccccaacggccccttagaaaaaatggatttttttgttttgggggcaattcccccgaaccaatcggccaagttttatggggaagncggattcttctgggaatagctttcctatagcctgtactttaattctgcgttggatttttgctccccataattgtttgagtacccaaaacggacactgaaaaaaaatcgattttttgttttcggggcattcccncgaacgnnatgcgccangatttatggggagaccgatnncctcgggaatagcttccctatagcctgtactntaattctgcgttggatttttgctccccataaatgtttgagtaccccaaacggacacttgaaaaaatcgatttttttgtttcataaatatttttttcagaaagtgctctaaagtgcaccaaaattttatttacaacttaattttagcactctgatgctttagtatcaaaaaggaagatggagaaaaaatttttccttatattttggttatatcgttttgcttttggtggggtgcttggaacagtggaatcatgcgcacccgtccgatctggcaagttaagcaacgattgct

SEQ ID NO: 35083 - DNA, 940 bp, Heterodera glycines
aatttccaattgcctaaaattgtttgtttattagttgtttgttctgtaactgttcagtttggttacttcgctccattcgtttctcactgtgttcacttccaattcgtggtacaccgtctgaacgggtcggcacaattcccgcgacagttcggcatcgtccggccttaaaaaggcattttgaaattgttttgccagatggacctcaccttagacagacaatgtgaatgcttcccagtgggtacggttttattctgagcaaaatgcccttcggctcatcggctgaatgttcggctggcacatttatgctgaacccgtcgatttccgacccttcggggtcggacagacgacggacgaacccattcagaacaccgctggcattaaaaagctgggaaaaacggaaattaattaaaaaatatatattgtggcaaatattacggtaatattgagaagagaatttgagaagcgatcgatgagctgaaaattgagggttaattaagggaaagttgccaaattagtggccgaccattagggcgaagaagtcgcccaattgggaggaattgtgaacaaaaacaatcggactttggcccgggggctgtccatcttcgctttcgtcgcttcgcggcttcgtggccattgtcacttcaagcgaaacgccctcccgcgcacggaccaacgcaattcgctggtacgcatcgaacacgcgggccgatcggatccatttgtgcaccaaattgagcgggtcggccagccgaaattggctcgtctcctgaaacattgacagttaatgatcagatggtttggcaaaatgatggggcaatggccgatcagagaattcgcaaattgatcatttgaattagtccagcagaatccttcccccatcccctcacattattgcctccgttcacgtagtaactcccgtccagcaccgatcggaagcgct

SEQ ID NO: 35084 - DNA, 1363 bp, Heterodera glycines
ccaagggattttattgtattggataaaaaaaatatttggcctaaagtattttgatgatgttgagaaattgtctttaaaaatagtgtttttttatgcgacaaaattttttgtttattttttttacaaaccgtgaagtcgtccatttttggtgtaaaaaacctgtcgggtggcccaattaatgccacgtccaacagtatcggttttcgtcgaatgaatcaacttccatcgcttcgccattgatgttaaaattgccttggcttacgtatgaaataaattcccaaagtcggaaggatcaattgtctcttcccattttatctgctgtttgactgcgaatccgaagaagatctgtccgaaatagtacctaaaatagaattcggaatattcaaatttatccttacttctccttgtgataaatttaccatttaggattgctgtacttacgaatacatagttttaaatgaagagtcaacgtagcaatatccaaaggaatcctcgatgcgcctgacaaaaatttttacaattatacctgataaatgaataaattgtttttaatcttttggtaataattgtgaattcagaatttcacattttctttgccttttcagtaatctcttctgtcaagaattaacaaattcacaaaaaaatggttgaaaatgttttaaaaaatgaggttttttcttattttgttcatgccaaccgaacatttccaactctgccatttcgctggtcaatttgtcgtttcgccatgacatttccaccacaaatcgcatcagaatctctcgtataaaatgaatgcttatcgtccaaaaagatgtttgttgaacgcagttcgataatccgaactgaatttcaattgtttctgcaaattaaaaggtcgaattgcccaccacctgaagagataaagtgttaatgggttgctaattgccgaaatgcaggtgaaaatgccgaggatgtaagtgccaaacacaatttggacttggctcagcgaaagttttcggagtaaaattaaaaagccggcgttcagaaagtaaccggtagacacaaaaagcacattgaccagcaatgccttgaaaatgcgcttagtgtagtcaatttggtctaaattatattgttttaaaaacattttgccaaaatttgaagaattcatttattattttttacattttgccatgttaaatttgttggttttgaaacggagcattggccaaatgatggcatagcaaagaatggtcagtcccgtgaagaccatgcagtttctgaacagttccaaggccactttccccttggtaaaaggtcggtcatcacacagggaaaaaagccgaaaaaaaaagtaatggggaattaaataaaaccaaatttttaa

SEQ ID NO: 35085 - DNA, 1521 bp, Heterodera glycines
gttaattgtttagccgccaattccatggcacttttcactttggccacaatttggacgtcatttaactcgtcgtatttgatagccaacatttctttggtcacttcattacgagcatggtgctgcactttccacgcgtcaatctgaaatggatttaccaattttcttgcgctttttcaaattttatgacgaattactaagtttttccaaaaaatagaagaaaaatttacccaaaaaaaaaatctttttattttttcttgaaattacttacaaaataattttacaggattttttgtttttgaaatttctaagatggaaaatttgttttttaattttacatttttgttcattaattaattcagttttccactcaaattacattgcaaaattgatcatttttcaaacaaaaatttttgaatttgaattcaaaatcgaagtacttatttggctccattttttttagtgaaaatgatgaattttttttttttgaaaaaaccacactaatttttatataagaacaaaattttttcattttttcattaaagaaataattttgagaaaaaaaaaattctacctcctctttatattcgcgcactttctggctcttaacttcattgtacagctaaaattaaataaaaattgttgttttttaaattaaatttaaattttttcattttttaaaataaaattttcaattttaattttaatttttctattttaactttattgaacagttaaaaatgaatttatttctaattaaatttttccattttaaattcattgaaagctaaaagttaaatacatttttcaattttaattaaaattttcaaattaaaatttttcaattttaatttcatggaatagacaaaaattaaaaaacaatttcttttttttataatcattgagcagctaaagtataaattaacattttcgtttttaattaaaatttttcaattttaattaaaattttattttttattttaaatttatgattttaattaaattcttattttaaattttttgattttaaaatgccttgcgcttgtagcgacgaaaaatttcgaacgttgcctttggaacatcctgttcacgcaaatctttaatcaactgttcatccgcgcttagtgtttcatatccagggctgcaatggggctgtgattttattggttttaaaacattttttgattttcatttaaaagggcggaggttcgaatccgttcatcgacattaaaaatcttagtttttttttttaaatgcgatttatttaaattatttttgaaaattttataactaaattagacaatcttggtattatgcaaaggcaatagaaatccggcagctcaaaaaatttctggagccgaaaatcggaagatggctcaaaaaatttgggaaatcggaaatccagcggcacaaaacatttgtgtaatcggaattccgatggctcaaaaaatttcggactatcgaaaataggaattccgacggttcaaaaaaaaaaaaatttgggcaatggaattcgacggctca

SEQ ID NO: 35086 - DNA, 1061 bp, Heterodera glycines
caaagaaaaatgggaagaactcaaaaagtggagggaaatcgctggcggtgagaaatggctgggctttttcctattgtacgacgctccaaaagacggtaaatgaaaattaattgggcaattaaaagtgctaattaagtgattaattggtttgaagactccaatttcggcagcctttgttcggcaacccttcgaattgtctcacaaaagagcgaagtgcgcgatttccagcacaaattcagtggcgtaacaatgaaaccgagcaactgctggggatacgccaattttatttcttttgcagtgaatcccaatgaataaaatttttgggattattaagctcaattggtaggattttcatttaaaaaatgataaaatatgtatcaatttaaaaaaaacaatgaggaatcatattttttagagcccggaattttgaaagtaccgggaccgggcccgggaccgggcttcgaaaattgaccggggcgagccgcccgttcaaaaaaagcccgttttaccgggcgtcccgggcccggtccaaaattttgaccgggcgcccgtactggaccgggcttttttcaaaatttttggaattttgattaaaaattcgaaaaaattttatagtcctttattttagcttagaaatgtcaagccattgtaaatcgaccttttttactcttcaaaagaattttaaggtgtattttttcaaaaagattttgacgacattggaggggggggggtccggcagtgccgacaggccgccgggtaaatttttgaaaatttgagtttggtttgttaacagatttacacgaaaaaatgacaaaactttgctattttgagctacattttagaaaaaaatttagctttttgtactaggcgacgctgaagaaaaactttgacttttaatgaaatttataaagaaaatttttggtttttcatgaaatttgaattttttttttgtaaaaagaaagttatgaaaatgttgttcaatttcgtatggattttggggtctttttgacagttgataaaggggcaaaaatttcaaaaatccgaaagttctatcttgaaat

SEQ ID NO: 35087 - DNA, 1313 bp, Heterodera glycines
  misc_feature (1287)..(1288): n is a, c, g, or t
taaactgaaaaaatcatctggtaggtctagattcttaacgatgtatagacaagtacaacatatcagctagaaatatgaattagagcccgtcctgtaattcttcaagttaacttagaacaatccaaagtattataaccccttttagaatataaaatgtacctcacgatctgctgtgcacattttcccatctcgtatgtgctcaaagataggagatgcatgaggcacaagcaaacaaaatatctccaaattatacagttacataatattaacagcattaggtaagcaaatgacaaacagttttccttaaaacgcaaatagaccatcgtctgcctaatcaatggttgctcgaagaatcttctttggtgatctccatcccacccaccaacacattgtgcaaagacaggaactggacattggcgcacgagctgtccaacgtccaattgcccgggtgccgccggcatttcgtcaaggccctgttcgccgcccctttccaccacttctactaccacgtcaggtcagaaaccaaaggcttttgagctttctttgcccagattcacagctttgggtcttagggtccacaaatgccacatcgtgtattcccagtcccgcaccaccatgtccaacaccctcttctccacgtccgaccacttcctatgccccgtcaggtcgaaatcgaaatcgttttttttgctttgccacaaattgtcaaatttgggctttagggtccaccaatgccatacaacgccctccgtgccccacaacaccccatccggtttccaattgtgaatgttccgccacttccgctgccccctcaggttgggtattgttttttgaccctattttgtgccaacatttctcaaacttttgagttcttagggacaaccaatgctgcgtaatgttgttcctgttcaccaccaccaacatccaatcaacggcctaccacttccactgccccatcaggtcaaaactcatgaccttttttcgccttctcttgaccaacatttcccatctttgatttgttaggggccactgttgttgcgtcatgttgttcctgttccacatcaccatgtccaacctccaccgaatggtctaccgcttccattgcctcatcaggtcaaaaaatgaccttttttcgccttctcttgaccaacatttctcatctttgatttgttaggggccaccgttgttgcgtcctgttgtacctgttccgcatcaccatgttcatcatccaatgaaacgcctaccacttccactgccccatcaggtcaaaactttgaattcttttgnnaccaattctcatctttgatttgtta

SEQ ID NO: 35088 - DNA, 198 bp, Heterodera glycines
tttttttttgccccccccccccccccccccccccccgctctttttttttttttttttttaaaaaaaaaaaaaaaaaaaaaaaaaaaaaacccccccccccccccccccccccccccaccacacaaaaaaaaaaaaaaaaaaattttttttttttttttttttttttttttgggggggggggggggggggggggggggg

SEQ ID NO: 35089 - DNA, 245 bp, Heterodera glycines
aaaattcatattttatgcataaaatcgcttcaattgtttcaaattggctaaatggatgtcagaatcggttttcccggcccggaaaacccctaaaaatcgattttgagcgatgaacgtgaatttggtgaaaaaagaattttcaaattttgttcggatccgggttcggggttcgaattgggtcaaaacagatgccagaatcggttttcccgaccccgaaaactcaatgcgtctatggtaaaaagtag

SEQ ID NO: 35090 - DNA, 885 bp, Heterodera glycines
ctgtttttctcgacagttaaaaattggggcaaaagcacaataatgacaaatttcttgccattttggtgccgcgtgcaatactttttttttggcactgagtgaaattttttgtgatttttgacagctaaatacagtgcatgtaatagtgattaaaaaacaaaataaatatgattgtcagctataattttaatcattttaattttgtatgtaaaaaactcattacaaaattattggcgaaatcctctcagatgatgttgaaaaattattaattgcaaacaaatttgtgaaaaaatgttaaacgactaaatattttaaatataattcagaaatatttggctcttttttccagggccgaatttgcggaattaataatgcaacacacaattcgcaaaaaatctagcttctgggttcgtacccaaaatccggcatgggaagcgtcccatgccgggctctaataatccaattgctaaataaatttatcgaagtccttccatccttaaaatatatgttcataatttattttttattttcatttcataatcaatcaatcaaaattccttaattatctcaaattattttctgttactgatctgataattcatttctgcattaaattaatatcggaatttctgctggcttttccatcgcttttatttttactttttttttgtgatgattcattcattttgtccatcaaatcgtgatcagaaaaaaactgacttttgaatatggaaagataaatatgttaattaaaaaatataatattcacataacaattttatctttaagaaaaggcaaatgaaaataaaagaaaaataaaatttgagttgtcgataagaataatattttcagaaaatgatcataaaaatggtgaaaggtgatcag

SEQ ID NO: 35091 - DNA, 1087 bp, Heterodera glycines
  misc_feature (962)..(962): n is a, c, g, or t
ggtctccccataaatctggggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtatggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaaattttttagagcaagctagctcggcgctcatttcagtgtaagttagtcctttaccggggagtatccctgcaaagtttggtatgcttctgctcaattagcaaaaaatatgagtgatcaaactttcactaaaaagttaagcctaaattttttggcatatttaaaaagcaattaaaaaatttttaaaattttattcacctccattattgatagaaaaagcatcagagagccttattaacttgtaaataaaatttggtgcgtttcagaaccctttctgaaaaaatatttatgaattaattttgcaaaaaataaataaaaacgaaagactcagattttcgaaaattttttttgagccagctagctcggcgctcatttcagtgtaagttagtcctttaccggggagtatccntgcatagtttggtacgcttctgctcattagcaaaaatatgagtgatcgaatttcactaaaaaagtagcctacattttttgcatatttaaaagcaataaaaattttaaattttatatttccctgca

SEQ ID NO: 35092 - DNA, 1155 bp, Heterodera glycines
  misc_feature (71)..(71): n is a, c, g, or t
  misc_feature (126)..(126): n is a, c, g, or t
  misc_feature (146)..(146): n is a, c, g, or t
  misc_feature (1104)..(1104): n is a, c, g, or t
aactgatcagaagcgaaccagattttgcgaggcatcaaaagacaaaggaaagcactgatatgatgctactncagtattctgatttaagattttgattaattttaaagcttcactattttatttttntagcaaaattaattcataantattttttcagaaactgctctgaaacgcaccaaatgttaattaaaagttaaataaggctctctgatgctttttctatcaaaaagggagatgaataaaatttttaaaaatttttaattcctttttaaatatgccaaaaagtttaggcttatattttaaaaagtttcatcgaacctagcgcaccaaaagcgatataatctctccaaattttgcgagaccttcaaaaagaaaaggaaaaacttaacctgaaaaaatgccaacgcctgtaattctgaatttaaaatttttcaataattctgaaagcttcactacttatttatttttagcaaaattaattcataaatattttttcagaaactgctctgaaacgcaccaaatgttaattaaaagttaaataaggctctctgatgctttttctatcaaaagggagatgaataaaaattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacacacaaaactttatttaaaggttagtttaggcactcagatgctttcactatcaaaaagggagatgaataaaaatctaaaaatttttaattgctttttaaatatgcgaaaaattttaggcttaactttttttttataaactgatcagaagcgaaccagattttgcgagggcatcaaaaagacaaggaaaagcactgctatgatgctaactccagtaattctgaaatttaaattttttataaatttttaagcttcactnatttattttttagcaaaattatttcataatattttttcacaactgctctga

SEQ ID NO: 35093 - DNA, 833 bp, Heterodera glycines
aaagcaaaaaaattaagccaaattaataattgagatatatcatttttaaaatcaaaaataagcctaataataaggttttcaaaatggcaaataaaacacttgaaattttaggcattgacctttttattggccaacaatcgcaacacattggcagctaaaggagtaacaaattgacattttccatctctgttcaaatcccgcccaccaaatttgctccatgccgcttggtgcagcggcgtacggccgtgcgcgtcgcgcacgtccactggcagctcccactgctcgctgagcaactgctcacagcaggcggcacttccggctgcagccgcgtgatgcagagggttcatgccgtcctggtcggtggccacactgagcaggtcggccaagccaagctcaccaagcagtatctatccaagaggtcgagaatgaagctgccaagatttaatagacaaacatttaacacgcgtgccgattcttgcgtcgctgccaaatgaatgggcgttatgccgcgattgtcccctgccaatgcccactcgcgggccgcgccctgctgcagcgtgaacagctccgaaatgcactccatcgacttgcgctgcaccgcccaatgcattgggcactgaccacgcgagtcgcggacagccaacaacggaatgccccaactgtgccaaaaagaatgaatgctggggcgggaagcaaacaacagaattttaatgagtgccttccgctgatcagtgattactcactgacttttgcaacagtgtcaaatagccggtccgatcggtgcccaaaatagcggcgaacagcaccgcgtgtgcgcatccgttgtccgccac

SEQ ID NO: 35094 - DNA, 1107 bp, Heterodera glycines
ggagggcattcccgctaatgaccagcgtttgatctttgccggcaaacagctcgaggacggacgaacgttagccgactacggcgtgcagaaggaggcaaaaattcatttggtcagaaaacataattaaaatatttaactaatttttacaagaatttttatattatttatttacaaaaaataaaaataatttttttttctaagtaaataattaatctttaaaatatgtttctttttttctcaaatattttacgcaaaattaaaaaaaaattaattctagaaaaagaaatatatattatttttttcgctccttcaaagctttaacttttaactcctctaccgggtgtttgatataaaataataattctttttattattgtatttaaattgtattgcctaattccactcaacaatttttcatcgaataaaattcacctaaaataaggggggttttaaattttttttttttaaaatttgaataggtcctccgtcttcggggcggaatgcaaattttcatcaaaactttgaccggcaaagtcatcacgctggaggtggacagcatggacagtgtcgagaatgtgaagcggaagatcactgacaaggagggcattcccgctgatcatcagcgattggtttttgccggcaaacagctcgaggacggccgaacgttggctgactacggtgtgcagaaggaggccactgtacaccttgtgctgcgcctacggggcggcggatcgatgatgaactttgatgatgatgtgctctgatgatcagcagaattgatcaataccttgacaattatacaaacatatagctcggtttgatcgaaatcaaatcaataatttaataataaacctaacaggtagcagaaatgaatgattttgaagacaataataatttttgatggaacttaatcaaaagagagtttttctaagtggtcatatgagaaaaaaataaaattgattttgccggcaaaatttcggtgtcatgacaactcgttcataaaatttttttaattcaagtaaaaccgaaaaaaaaaagttaaaatgaatttttttctagaatgaaaaattgttaaaaaaattttaatgaaaaactaaacaattgcaa

SEQ ID NO: 35095 - DNA, 304 bp, Heterodera glycines
ttaaattacagaaaatcaaaagcaaaaattctaaaaaattccattgggggtattcattcattcacacaaaatgtttcattagtttctgatattaactacatttcctcttcattccattctcccatcaaacaatctcaatccccaaaaaaactgggggcattcaatctcggcacagatggcaaaaacggaagacaagtggtgccaaaaaattaggaggaaaatccgttggaggcaataccaataggcgcatcagcacccccacaaaggggcggggatggtactggtactgaacattacaaatttt

SEQ ID NO: 35096 - DNA, 920 bp, Heterodera glycines
ccccattataaaaaaggtgttctccaaaatgattaaatatttatttaggggcgattaaataaaccatttcccttattacgacgaatatcgcccaaattagtcccaaattatgactaagtgcgccgttgagaaggcgtccccctcctccgcctcctcccccccgccggcgttactctctccgatgatggcggtgtatttgacgcatagagaccaaaaggccaacaacagaagcagtgagtgccaagtgccaaacgaaccaaaagcataaaagcaccgcttttccctcgagggaccaacaaaaaaagttaaaccccgcggggaaagaaagggcaaaacgatcgaaaattatgacgcaattatgatcattttctttctttttttattgtgtatatcgatttttcagagtttttcgaacctcatctgatgtccaacccaccgccgatggcggaacaggtaaaattattaaattaataaaaaaaaataataataaatggacaaaaaaaggggggagagggggggggagcatttgttgatcaaattttacgacgaaattacaaaatggggagggatttttctgattaatgttaatagttgtttttttaaattttgtttaaattgctccgttttccgttcagtttctttacgacttgcgcaaaatggtcgcaatggcacgcgaaagaattcgcacgcgacggcacagtaagcaaattgggagagccggaaaaactgcgattttctttgttttagttccacgactgcatgcaattgtggaaagcgatgacgaggggggcacaaatggagggaatgagagagaacagcaaaaatacggaaaaattggtagagaagcagacagagagagggacgagagacaatggaaaaagtgcgagaagatagagagagaagcttacagtgaattggag

SEQ ID NO: 35097 - DNA, 1414 bp, Heterodera glycines
tcatttctattttattttttaatgcttaaattgttccattttaaaaaaaaattttattacaatatttttcttttgaagtttgtttatatattacctagcctcatagactcagaacttcacattatgttttttcaataattcaatttcatctcataaatttattttcaatatcaaaaatttcatttctgtcttttccattttctctaatttacacgcactattttcatcgcaatttctctttctatctctccaattagcactctctcactttctgaaatattttcgtaaatttcttttcatctttcccattatttatcagttaatctgaattatttcatccaaaattgcccatttctgtcctctctgatctcccattttcttgcactttttcaccccaaatttttcattttcaagcctctcatccccccccccttttttactgcactattttcacccaaaattttcgtttccgtccctcagaaagctcccttttcctgcactatttccatcgtaattttcctttttagccctcacatacctctctttttactgcactattttcaaccaaaattttccctttcttcccttctaaaattaccattttcctatattcacccaaacaaaattttcctttccgtccctcacaaagctcccatttccctgcactatttctatcccagcttttcctttccagccctcgcatacctcccactttacagcactatttttcatcccaaattttgcttttcaccccttctctcattacctctcattttgttgcactgttttccgccccgtcatgcacttcacagccaaatttttgtcactaaaatggtctcagggagcagcaccgatgacgtcaaatgagcccgtaaaacaccggcggggcggtcccccgccgccactttcatttatcacaccgatcactttttggtcgtctaacgttcgtcgatcaaacacaaatgtgaccaaacacattatctaatcacacacactttttcactaattacatgtgttctctaccctatcccaaaatgttttttcttttctttcgccgttcctcgcgagtttcgttttctctgttttcttcgcaaattttgtgtctgtcgttgtctttacagctctctgtttattattaaatatgttttagtaaattaattaattttattttttgtttccattcattcaaaattttttcaggaattatttgtccctaaaatttgccaatttattttattttcatcttaaattaatattttgctttcaattccatttaaaagttttttctgttttgacaaaatttcacaatttttcaccttttttcttttctgctttatgtatgttttttctaatattttaaatttggaatttgttttcatatttatctccttcttctccaatttcctttattttt

SEQ ID NO: 35098 - DNA, 1056 bp, Heterodera glycines
  misc_feature (84)..(84): n is a, c, g, or t
tcccatcgtcataagtaatttgcctttgagttcaggccgggtataccattttgtgtgaaagtatgagcaatatccattgttcanccgacccggctctttccgaactttgagctaataaataggaacaaaaaattgaaatgatgtcattttttgtggacttgagacattttttgtgaatccaattaattccaaacttaaggaacggggaggggagtgggtccgacggtgcctataggcgccaaatacaatttttcctagtgtcgtcccattttttttaaagcgcaccaaaaaatgtgtaaaaactaaaaatgtcatcgttaaaattccagcctgatttttttggggtaagaatttcgttaacaatggttatgaccgtttgtttattttcttccgacctcttaccatttcgaatgtgtcgctacaatcttttgttttccataatatccatccatgagtggcttcgtggacacaggtccttgcgcgggtcgattttcttccccttctcatccgcgccctttcaagactttcgtcaaatttgcgttcttgctgtcgccttttttgctgagcaattattcgtctattcattaagttgcttttgataataacctgaaattgcatgagtaaataatgatttttaaaaaatagcagaaggctaaaggttattatttctgacgatggaatgcaggcgccaagtcaggttttagggtataactcctttttcgagttaaagttggtttagaggtttttagggttggagaacccgcgtctgatatccatttaggcaccgaactagaacaaaaattcgaaaagccaaaagtttttgtttttcgttttcaattaaaatataactcattttcgggatggtgtgtaaagccagtttttctacgacctgaaaatatcaaaaaaaaaattatagatcgtgctctcgagcgattcgtggtggaaccgtcctgcaaatagggtgacacttagacacaaagaagtggcgaaaaaaagagatcgaaaatgcattcaaaaaaggcaaagacgatcgtgagaaacaacaaggcaaagata

SEQ ID NO: 35099 - DNA, 1264 bp, Heterodera glycines
aggaaaccgaatccccccgtggtactgctcccgacaaaatattgtttctgtcctcttccatgttggggagtaaaaaaagatgaccaatcgaccgactcgggatcgaaaaatacgtgtgtcatttttaaaatatacttttcttaaaatgtaatgtaagaatacaacttccccagtgaaatttaacgaattcaccaaacggtgtgtgaatttcaattgtaatttctgaaattcgtttcgactgtagacgatgaaaatactcggtgctatatataacttcactaatcgatcctgggtcatcgacgacgttaactattcttaagagtggggccatctggttgccgataattgtgttttcgattaaatttggtgcataaatgtatagctgccttacgccgccagtcaaatctggcatataattcgcttcttccgcatgaaatagccttgtgttcttaaaaccgagcacataggcgaggtgttttgacaaatctatgtgggagacagcagcggaaagatagacaataaatttttgatcaatgctgtcatattgaaattgaacatcctcattggctagtctttctcttttttgtggtcctttctcagcttcagatacttgtatattttcaatatctttacgtttaatatgctcaccgagcgcctcattaagcctattcactatcccgctaaaacccttttccgatttatcattatatccctcgagagttgatgtatatttggtctttgcctgtctggcgattccctttgcgacgtcggctgatttctttgcttttttcaagtcattcttttccacatgctccaatgttatgtttttggctttatctacttcttcttgaaaagccttaagttcatttcgtgatgtttgaatttcggttcccatctcaaccattttgtcaaaccaaatttttatatcaggctcttctaaaatttgaggatttgtttctcgtagtgtgtttagttgggtttggatggaattcgagatattgttgatctgattaaaatgtctttctacgtctctcccggcgcgttctgcggccctctttgcgacatcaatttttgagtctttggtatcttcagccttggcttctctccttccacgttgttttttgattttgtaatgatggctgaatgcctcgttaattttatttcccaggcccccggcggttttaaaattcatgtccggtaaataaacttgagtcgggacactgatgtcgttttccccatactttaataaactcttgaccgttta

SEQ ID NO: 35100 - DNA, 1056 bp, Heterodera glycines
catcaacgatctgtttttatacaaaatgaaataatagtcatttcatcttttagttttatttcttcgaacctgacaatattccgccacctgtcattatggtccagcatgtctctttccgatacaatccggaatcagtaattgagttatggtaatttttcaatatattttacaatttagccatacatttacaagaatttggactttggtatcgacttggacacacggggtttgtttcccggattttactttctaaccaactaacaaataaagtggcacttgttggtccgaacggggctggcaaatcgacactcctcaagctgttcagcagagatgttgagccaactgatgggatgatccgacggcatttgcactgcaaaattggcaaatatcatcaagtaattgcaatggacattttttcactatttaattatttctagcatctcgttgaagaacttccactcgaactctccgcgttggaatacatgcaaagagagtttccggacgtaagagagaaggaggaaatgcgaaaaatcatcggccgatacggtcttacgggtcgtgagcaggcaattaaacggatactcacttttattgacacaatgccatgctaattataggtgtgtccgatgaagcaactgtccgatggtcagcgctgtcgtgtggcgttcgcttggttggcatggcagcaaccacatttgttgctcctcgacgagcccacgaatcatttggacatggagtcaatcgacgcgcttgctgaggccattaataacttcgccggtggaatgattctcgtttctcacgacttccgactggtccagcaagtcacggaagagatttgggcaagcaaattttacttttgttttctttacaatgacgtatttaataggtttgcgacaaacaaacaattactaaatgggacggcgatatattttcctacaaagagcatcttcggaaaaagattgaatcgaacgaccggaagggcacgatgacagaacgttgatcccttcttttatcacgttaaaggtgagtaatagaaagttggctcccccgcaacct

SEQ ID NO: 35101 - DNA, 339 bp, Heterodera glycines
ttcgtctaaatagcgcaaaattcggtcgttttttacacaaaatctgttatcaaagtgcactgattgtgagattcgattcaaaaaatttccccgacggcgcctatcggcaccgcaggacccccaccccccccccaagttcctcaatttttttggaaaaaacgtcgcaaaaaatttgatttggaaattaaaaaaaagcgaaaaagtagtgtgaaaaaagtgatgtgaaaagtgaaaagcaaaaaaaaaaccgtagaaaaattcttgagcgtttttttcaatttcgtaaattttggcctcagagggggggggggggtcagggacggtcccaggggggggggg

SEQ ID NO: 35102 - DNA, 986 bp, Heterodera glycines
taaatagcaaaatttttatttagaaatattttctgattaatttaatttgcattaatttgtattgtattaaaggaatcgcatcaccgtttggcttccgaattggtcaccggaatggtcagcgggtcgaagctgtggcagtacgcaaaagtcaagaaggtgcaggagcggctggagcaacgattgaccgacacttttttgggcctcacggaagaagtcgaaaagaattggggcacggcgttggccaccattgttcgtcatcattttgtcagtttaatcattagtaattatttcttcgtttagttcggtgcgtgtgagccgcgcgtcactaattggcttatccaaatgcttttcggactcgcaaagcgacccacagaaataagcacacaaattaaaacgtaatttgtttgctttcctcacaaattcgttcctttttttaatatttatttaccgtttaggcgtttatatttgctagaatcgggccttaaccaggtgcggtaaaagacgacattctgtcattttttaaatgccatttgtcttacattgtttagtatgaatggcgaattccgaacgaatggcgccgattgtttgaactttgcatggatcatgtcaacggattgggctgttcctatcaaaatgtccgcttgcgcatcggaaggtgaacaaaatgatcaatgaaatttgggataaatggtgggcccataaaaattaatttggcattccattgaccgaaaaatgtccgaaaatggacccttaagaaactgaccgcaaatttccgattttcagcaggccgcaaatttcatataacattttaatttcctttcttcagctgccttgccaccatttcatcgtccgatttcaagaaagcgcttgtcgaggcgaacggaggagaagcgaacgccgacgacgacagccaattgaaacatgtcaccgttgaggaagtgatctcgcgcataaatgccatggtaacgtttgttgattgaatttgg

SEQ ID NO: 35103 - DNA, 1144 bp, Heterodera glycines
aattcacaaaaaaagggggggagggggggggggggggggcaattccccacaaatggccaattaattaatcacctgaacgtaaaacttgcgaaagaaattgaaggcgacgacagtgtaaaggtaaacgaccacgagagtcatctgaatttggccgagttccaattctctcccgtaactctcgaacttcggtgtgcaattaattaccataattgtgaggatgagctgctggaggttgtgggtgaccgactgaagaatggccttgagcatggggaaggagagaacgacgtcgatgagaaggaaagcgtagaaaaagggggagaagagaacgccggaggcggagcacagcaaatagcagacgcggtaaaggaactgccgattggtcagaatgacgccggtccaaagccaacagttgtaactgaacagccggggataatggggggggggggagggggaagaatgacagggaagaagaatgaatggcaatttataaaccacggaatttcgggggttttgggtctcggtcccgactaccggggacaattctaggtcttgagtctcggaaatttcgactcttgagcagccctaatgcccccggccccaccgttcgtcccgattgagtattcggatgtgtcagcactcaccgatagtcaaacgacgtgtccccgggactccgttccgtgcccaaaagggcgttcagcgtttcctcgtcgacttgttcccggtacttttgcttggttttccggcgaacaaatttgtcccaatatttcatcgggaaagactttgagctaatcacaattcggtccaaatacctgaaagtgaacgcgtcaatcagtcgcttttgccccccctccccgcccaccaaaagcacgtgtccgtcagtcccctgtcctctccgcccgcttcgtcctccgttatccaacaaccgtcgaacattaatttccgcgcgacttccttctcccgtttgaaggtgatcaatgggattttcagctgatagaaggaaatgagcagcgcgaaagaagcgatcgcatggaaaacactcagccaataaagtgcctgaggggaaatgaagcaaaagcgaagggacatttgccgacctggccgagaagccaaccggtgatttggtagctgaggtaaggcacggtca

SEQ ID NO: 35104 - DNA, 673 bp, Heterodera glycines
atttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgcctatctctttttttgagaaattttatacctcacaaatgctcttgagcatgagacggagggctgtgcacaatcgccattttatttcacagaggatttttatatttatacgttatcccagaaaaatggctatctctttttttgataaattttatacacatacaaatgctctcgagcatgatagggagggcggtgcgcaatagaccttttatttttgagggaatttttatatttatactctatcccagaaaaatggctatctctttttttgataaattttatacacatacaaatgctctcgagcatgatagggagggcggtgcgcaatataccttttatttttgagggaattttaaatttatactctatcccagaaaaatggctatctctttttttg

SEQ ID NO: 35105 - DNA, 981 bp, Heterodera glycines
cctcttttaatcactgttcttcctcttttaatcactattgtacctcttttaattacagttgtacctcttctaatcacttttcttcctcaattaatcacttttgtacctcttctattcactgttcttcctcttttaatcacttttgtacctcttctcatcaccgttgtacctcttctgaccaatgttgtgcctcttctgatcactggtgtacctcttatgatcaaacgggcgcgaagcgcccgccagagcccaacacaatttaaaaacgggcacgaagcgcccgtctaaggcatcgaagcggccgagaacgcccacaaaatttaaataacgggcgcgagcgcccgtctgaggccgcgaagcggcctaaaaatcccagataaaaatttaaaaaacgggcgcgaggcgcccgtctgaggccgcgaagcggcctaaaaatcccagataatcttttaaaaaatccaaatctcttcacaacgcaatagcatatctaggtagcgaagctcccaaagcgcgaagcgctttttcccagctaaatagccgacggttcacgcacccgctagttaatatatacgttatattgacaaggagtttcgttgctaaaaccattttctcccggccgaaggccgggagcgccctgaaagtagtggaagggtcttacaactttttgaggagcatccgggaaaactatagagaaaaattcagcgcggacgactgagtcccggggaccgatttttcactttttcttgcagtttagggcccctaactttttttctaaaacccgaatcaaaaagcgcccgctgtgagggcactccccacaactgtccctctacatgctggtattttttatttttttattagagccacccccctggcctgcaccgcttggctaactgcagtgtgctcaaaaagtacacttctataccaggcgattaactcgccaggggttgctttgatcgaaaaattgttcctgagcaaaaatgt

SEQ ID NO: 35106 - DNA, 666 bp, Heterodera glycines
tttcgattttttaaaaattttattatatcaatttgtgtaataaattagtggggaattggccgaaatgatttctactaaatgtgattttcattttcatttcttcggtctaacaaaaatcattatctttattcaattatgcttaactattgtgataatttaattcataattttttttcatgcaatttagaaattcccatttaattttgataaaaaatgttaaatatttacatatttttttcataaaattgagtgaaattgattataattattatttttaatttgcaaataatttttttatgtgcatgtcaatggtaaatgttgacaatgattaacgttacttattgaatatttgatggatttaatatttaatgacaaattctccaaaactaatgcaatttttcattttttacatttatgaattttatttattgtgaaataattattatatatattgctcattttttcgtttaagtaaatataaattgcagggtttaaaaaattaattaatagttcattatgctgatgaatttgctcattttgttttatttttttcgctttatgccggcattctcaacaaaattatggacaaataataaaaatgattcgctaattaactcttctaatcgttctgctgctgctggtgctaatttggaaaatgttttgcca

SEQ ID NO: 35107 - DNA, 627 bp, Heterodera glycines
ttgaatttttttgatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagatcatgaatgctgctgtcctgtgctgtcaatttctgttttttgttctctttggtcacattttttttcttttgatttaagtttttaataaaaattaaatttaaaataaaattaaagaaataaaaaaaaaatcgaaatatgcctaaatcaaggtaaattcatgaatcatttattacaattaaaggcattttttattttgcctctaatcaaaatagtagtagcatgatttgattcggattttccgagctagaaacacaaaaatccgagactttctcgtgtcgagagccctatactggtacatttaaaattatatttgat

SEQ ID NO: 35108 - DNA, 1308 bp, Heterodera glycines
  misc_feature (21)..(21): n is a, c, g, or t
tgagccgacacagtggagaanatattttgagagatttcctcggtgagtaaaacattttccatttgattagtggtgcgaatttgaacgtggagcagtggaaggagctcatttacaaccaaatcaaggacttcgaagtttattagatgatttcaactcacaatctcttgcttattttcagcggactcatgacattttcggcatcggcgtaacaatgaatggggacggcgaaatgctggacgaaacctgagcacttttttgggcgacttccttaatatttccgttctgtcatgttctcaaattacacccttcagccaattcccattttactgaatagtcaaacattttttttgaaaatatattccaaatttgtgtatatatttttttgtattaaaaagcattgctggttcatggaatgacaaaacgtaacttaaagggagaagaggaccccccccccccctccccctatcggtcgcaaaaaggataagaattaagaatgattattttttgactccacaatcattgtcaatctctgccccttttttgtataaattgtgatgtttcaatgttccagcattgtctgcagtatcgtcagagatgtgccgaaaattggtttttaatgagaaaaattggtgcatcccttttccgtttttcattgccattttaaatagttattcaaacaaataaatcatgataataataactgactattttatgatgcgttatttactgtaaatgcaaaatttaatttattttggcaaataaattcactgttatattaatttgtgcgttttctttcagatgaaagtcaaagtgatctccagacatccggatgaataccaacgcgagacaaaacatgacatattcaagggttaggagctttatgaagatatttttggtgatttttcgcatccgaaattagtgcctcggaattacgccgccccgcccgacccatttcagcagcaggtggagtacacgcgagcactgaacgcggcaaagttggagcgcatgttcgcgaagccatttctggctgcctttgatgggcacaatgaggcggtcagttggtgttggcatttcattttttattggcatttcgtatccccatttacctacatttcttcgtatattttcaaattgtttaatccatacgttcgcaggtcaatttgttggtcaaacatcccactcgtctgtccaccgttctgtccggtgcgcgtgatggccaagtccgagtgtggcatttggccactcgccgctgtttgcacgtcctccaggcacattccggccccatcaacggtctctctgttgatgcat

SEQ ID NO: 35109 - DNA, 1208 bp, Heterodera glycines
taacttttctcattatcaaccaaattaaatatttttggtagcattcgatagctcttaacattctctattagaatgcaaaatttcaaaaaaactttgtcatttgacgaaaaagttatgaccaaaaacctcaacaattgactttttcatggctttttaggcgccgtttgccataactttttttcacttgtatgattttttttcgcatgaaaatgttaagcacaaagatagggctttcaaataatgccagatttgataaatttaactgacaaagaaaaaagttataatatttattggtggcgccgaaacagtcagcgccgaactgactccgaccctgcccgcaaatatataaggaccaggccgttttcgcgtcggcgagtttttaactataactttttttgtcaaccaaatccaacaatcttagtatcattcgatagccctaagtgtcttctattagcttgcaaaatttttaaaaaatttcgctttcaaaattttcaattttttgtagtctaatcttctcaaaacggttgagaattcaataaaaataacattcacggtgcgaaaaatggggtatgaaaagtttattggggaaaaaagactctttacaaaataatacccctgggagaagggagtgggaaacatgatttcaaaattttcaattttttgtagtctaatcttctcaaaacggttgagaattcaataaaaataacattcacggtgcgaaaaatggggtatgaaaagtttattggggaaaaaaagactctttacaaaataatacccctgggagaagggagtgggaaaaatgatttcaaaattttcaattttttgtactctaatctactcaaagcggttcagaattcaatttaaataacattcacggtgcgaaaaatggggtatgaaaagttaattggggaaaaaaagactttttacaaaataatacccctgggagaagggagtgggaaacatgatttcaaaattttcaattttttgtagtctaatctactcaaaccggttcagaattcaataaaaataacattcacggtgcgaaaaacggggtatgaaaagtttattggggaaaaaaagactttttacaaaataatacccctgggagaagggagtgggaaacatgatttcaaaattttcaattttttctagtctaatcttctcaaaagggttgagaattcaataaaaataacattcacggtgcgaaa

SEQ ID NO: 35110 - DNA, 955 bp, Heterodera glycines
  misc_feature (242)..(242): n is a, c, g, or t
  misc_feature (273)..(273): n is a, c, g, or t
gcgggggggggaaggcccaccacgaggccgcgaagcggccgagtgagtaccttcggtgcaggaaaatattaaggaagagagttcattatttatttgttttttgcaaaattaattcataaatattttttagaacgtgctctgaaacacacaaaactttatttacaggttagtttaggcactcagatgctttcactatcaaaaagggagatgaataaaatttttaaaaatttttaattcctttntaaacaggccaaaaagtttaggcttatattntaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattttttgcaaaattaattcataagtattttttcagaaagtgctctgaaacacacaaaactttatttacaggttaattaaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgctttttaaaggtgcgaaaaattttaggcttaactttttttttataaact

SEQ ID NO: 35111 - DNA, 202 bp, Heterodera glycines
tctcgacaaactctcgctttcgtctttttgggattctcgcctctcgccaaactctcgctctcgcctttttggtgactctcgccaaaccctcgctctcgtctttttggggactctcgccaaactctcgctctcgtctttttggggactctcgcctctcgccaaactctcgctctcgtcttttctgagacaagtcacacccctg

SEQ ID NO: 35112 - DNA, 704 bp, Heterodera glycines
aatgatcacaaaaaagggaaaactctcttctattcatttgttcatctctcgtttttttcggatggtgggtattaaaaaggatttaccgtattatctctaattataaccccgggggattattgttcaaaaaaatggtaaaactcaactcgtttttgccttaacatttttattaccccacttttttttcaaatttttcttgaatttgcttaaaaaatttaaaaaacatatgctgaaacgtgcagcaaaacacaataattgtttcattttaaaatttacgcatgcaaaattcaggccttttggagttttttcaatttaatttttttggtattttacaattttatatatttttatatttttaaaattgagtccggcaaaatcctaccaaattttgattaaatcatcggacgaaggataggacaaaaataaaagagaagaacagctgatggagtaaaccactaatttgtcgaatgaacgaatattatattcaaaatattgtcaaaaatggtcaaaaaactaggaacgaagaaccaaatgatcaaaagaaatgagaaacaattcaaaaatttgaagcaattaaagaaaagttcaagcaaaaaggaaaacatcaatggaaaaacagagaaaaaattgaaaggaaaattggaaaaacattaggggttggtccctataaaaatataaatatatcaaaaaatatttttcctttt

SEQ ID NO: 35113 - DNA, 1034 bp, Heterodera glycines
  misc_feature (907)..(907): n is a, c, g, or t
  misc_feature (1000)..(1000): n is a, c, g, or t
  misc_feature (1018)..(1018): n is a, c, g, or t
attagggttataagttgtatgcactaaaaaatgcaaaatatgcgcataaaatatgcactaaaaatcacccaaatatgccctaaaacccccgaaaaatgcccaaatatgcactaaaatatgccttgaaaattactcaaaatggcttttaaccctcaaaaaatgccaaaattgtgtaaaaatacagaattgactttaaaaacatcaaaagaatggctaatgagtgtttttagacaattgcaaaacattttaattttaaaactttatatagaaatttagaattttttaaaatttttattaggtatatgccaaaataatattgcattttttgtatgaacaaattttttaaaaaaattctcacaataagtttaaaaattttcgggttttaagggtgtatttttaaaaaattcccaaaaagtcgatccttagggtgtatttttcgcttatttcgcatgttttttgggggtgtgtttttgaactaaattttccggcacaattattagtagggctcgaaattatatggactaaaaaacgtcaaatatggacataaaatatggactaaaaagttcaaaaatagccaaatatagaccaaaatatggactaaaaactgccaaaatatatgttttaaaccctcaaaaatttcaaaaaaggtttatatattcaatatttgcttaaataaatttaaaaagtacaataaacaaccaaaaaatggatttaaaacttaaaaatgcatatttttattgtcgtccattgtataaaaaatatttccaagtttgccaaaatttcgaaaaaaattttaatttaaaaaaaagaaaagttcgcaaaaaatggcgaaaatatttattaaaaatgccaaaatgacctacgaaaactcaaatttttcgtttttttgggggggtgtaacttttanaaattttcaaaaagactatctttaagggtgtatttttcgctttttgcatttttcttgtgaaaatttgccaaaaatggccaaaatatggactanaaaggcaaaaatgacganatatggatttattccc

SEQ ID NO: 35114 - DNA, 995 bp, Heterodera glycines
tttgtaacatgcaacatgccaatttaaagatatttcattataagtgtattttttcagcgttttcatgtgattatcaaattaataaatcaattgttttaaattgtcctcataaatacattagctgaataatgtaacgattagaccttttattatatctgatctatcccgggatgaatttgtgataaagcaggtgagttaaaatgctttcttttattttcgttttatcaacactatcgctcacaaaatttgaatatttccggaacaaaaacaaggtctaggaaggaacctaaattttctgtccatataaatggtcaggaacttacagaggaatgcatctcctaggcaagctaattccgaaatgttgcgcaaacatcatagaaaatgaagggaataccgattttcagaatatcgcgtggcttcctccgatccagtcgggcaactgtggattcaggcttttagcaactgaaattctcaaagccgttagaatttgcctagaaaggctgttatttgaaatggaaacgtatctttacaggtttcgtagcaaagaaaaagcgatttctatccatccctcgtgctttgtatcaaaacacgtggacttaagactatgtgctatggttcgcttgttaggtttaacctgcataaaatctcttttgtaacatgcaacatgccaatttaaagatatttcattataagtgtatttttttagcgttttcatgtgattatcaaattaataaatcaattgttttaaattgtcctcataaatccattagctgaataatgtaacaattagaccttttattatatctgatctatccgcggggtgaatttgtgataaagtcaggggagttcaaatgctttctttttattttcgttttatcaacactatcgctcacaaatttgaatatttccgaacaaaaacaggtctaggaaaaacccaaatttctgttcatatagatgggcaggaacttacagaggaatgcatctcctaggcaagc

SEQ ID NO: 35115 - DNA, 841 bp, Heterodera glycines
aagtttggtagctttacaataaagttataagcaaaattgtttgcttttgatggctttgttttctaaagaacgcacacataatgatgatttttaaataacgaccccaattttccgatcacgtccgggagccgttgtaaaagaaggtggttatggttaaataaccactgatgagggggctaaagcccccccgaaacccaaaaagtacaaaattctcagtaaatttttttgaaattttaagcaattttattaacaaaattgtattaaaatactcaaaaaattttcccggcggcgcctgtcggcactgtcggacccctccctattttaccatatttttgaaaaatggaggacaaaatggcaaaaaatattaatttttggcgaaaaacggcgaaaaattttgtaaaatacaccccctaattcgggatttcaaaaaaccaaaaatacacccctaaaaatcgacttaaaaaggaaaaatacacccctaaaaatggctacgcccttggttggtgggtggttcgtgaacgcacagcaaaagaaggtggttactggttacctaaccccatgtaaccatggtaaagcgcctgccctgcccctccctctctacccatggtagcagtcgtaaccaccaacctttaaaaatctgccaaaaaaaaaccaatgtaaagttttaatcgaattaaatgccgaaatatcttaaataataataaaaaaatttacaaaaaattaatccataaataataataattattattttcatttattctaccaattttctaggtactttaaacattattttgcccattatattaaaaaaatcagtgcaaattttactaagttcatggta

SEQ ID NO: 35116 - DNA, 1032 bp, Heterodera glycines
atattggcaataagacggttctgagtatccgtatcagaaacgatgctatttatgatcagagtgatttgatggctgacaaatgcggtgatcagattgcgggcagccgaactgatcagccagccgatcagcaagacgaacagaaccagaaacaccgagcgcaacattttgcgcattgaccgatcagcagccgctaaaatatggcaattagaatttaaatttaaaacaaattatttgcgacattttgcagccgattgttgcgtttgattcattggttcctttgtttatttgatggcgccataaaataagaccaaaaattactgcataatttaaggtgcacaacaaaaggatggcatatgatggaacggtattcggtacgtccgaataaatcccactgttacagtacaccaaactaaatgtgcggtaaatgcatagaatatttacaattttcagtaacatattattgtgcaattatttatcattgatcaaaggtatcgctcaaatggaaggttgataattgtccacatatcgaatatgtttaaatttatcagaatgccaaaaagtgagcagaaaaccaccgaaaccattgaacaccagcgaaccgtcgattttttattcgaattcattcgaaaaatgaaagataatttataaaaaattttttattaattaaatatggaatttacttgatttggtacattatgatcaacaggcgttcaactgagatcagatacattgccatgattgaggcgtacgatgctacggtagctgccatgagagtggccaggcagaaacggtagtcaatggtactgtattggaaaatgacgccaatcaaattgacgccaaacggcgcaaccacaaaaagttggcacagagaatcaaaggcgatcagccaattgcacactttgtgatcagtccttggagcaaaattaaatttaattttaaattaagagtataattcacatttttgtgcatgtgaccaaaatgagagacaaattgaacagaatcgaaatcggagtgaaaatatttggaagacaa

SEQ ID NO: 35117 - DNA, 1029 bp, Heterodera glycines
  misc_feature (8)..(8): n is a, c, g, or t
aggagatntattttgaaattttccgtgaatttgagtttggccaaggacacctgaaatttggccataagggtctgccctgaaatctcacgattttgaattaaaaatttctctttttgcttaatcttctagaacatattgaattttacaaactggccaagtttaatgttatttcactaaacattcattacgttatggtcattggtgtaaaggggtagtcaaattttctcaaccatatcataatattcgtacaagttttaaaaagtatcctaaaaacgagaaaaataatcattttgaagtggaaggttagggctttcaaaaaaaaaaaaagtttttaatgtaagtaaaaatgcttttttttgtgctgtctggtaataggcctacgacgggagagagagagagagagagagagagagaggagagagagagaggatagagagagaaagagagaagcaatagaggaaggttggacggggggagggggtttgagttagggtggaaatttgaaaaattttatgttaggggagccactacattttaaatttaatttattttttttaataatgaatcaaaatttcaagtaattatttcaacatttaaatgaggacaaattaatggcttatgacgggaaagagagagagagaggtaggccatgtcaatgttcagcaggggcaccggacgggtgggattgtcttggatggagtgatgtgtgaatggattttggggcgccttatatacggcaatattgttgccgtgtatccagttttttggcataaaaatgcatacggcaaggcaaattacccaatgacagcctcgacaattgtgccataaactagtaaaattagttattacatcatgtccacattgttaaatccagccgccctccctcccatttctataggcattcaatcatatttatttatttatatgttcattttacttaactttgcacatttgcccccccccccataattacctcacggcaaaaaacacacctcccaaaatcccaaaatctttatttttttgcacgtt

SEQ ID NO: 35118 - DNA, 1358 bp, Heterodera glycines
  misc_feature (22)..(22): n is a, c, g, or t
  misc_feature (1344)..(1344): n is a, c, g, or t
tgtaaatgattaaatgttttgntggctctgtcttacatataattattttcacgaaaaattattgtggctgagagtgtgagtgatttttgttgtacaaaaataaattcattatttatgtgcaaattcatcattaaaaaacgaaaaaaaaataatggaaataaaagcgctaattaatatttaatattttaaaacaattttgctacaattttcagaaatagaatcatttaaaaattatttttttggcatattccgttatcccctaaaaacttttttcaaattttgctggactaatttaatgcgctgaaaatgaacccggctttgtttttttgattcgatccagcttcattcgcctgagatgcattaactcttaagtggaaacttaaaactggtttttgagcgcatgattaaaataagcttaatgtaggtctaattaccaacgagaaatgtgaattttgaaaatatttaaaaggttttcagttaatttatgtatttaagtgtgccattaattgagtctcaaaaatccttaaatttatggcacagttgagagaaaagacgagaattggatgactctttcttgaacattttgcatcaaagttggtaatagattttccagatctattctagtaaatttgaggtgtggtcaagaaaaaagagagtttttggcaaaatcattttaaaaatttttacattttaggatcgttattctttttttttataaatttgatgcatattcctcgaaataattttctttatttcaaaatttaagctgaataaacattaaaattaaaaacgttttgatcactaaactgaaaaaatgccaaatcttcggtataaatttttttaaattgtcatattcgaaaatcaatggttaataaaaattcatttgttttaggaatttgatgacttccacaatttcactatttacctgaacaaataataaaattcaaatttttgatgattaaactgaaaaagtgccaaattttcggtgattctgtttgctcatctgctgtcatactttcttttttgtactggtctcacaaactacagtcaaaagttggcatatttaagtcagaatttgccaatcccttcaccaattcctctgtttaaagcccttttacaaatcggaaatgaatcccaacggttttttctttgttttagcggtactttttcttgtgaaagtcgactttttacatggcgtttacaatggtatgtcaataaaatatttctgatttttaaacaaaaataaaaaattcagaaccaatggcacgacaggtgctgcaaaagcatgcatcacaatttcagcagcattgtaaaaatcccgcagaggaagtgccgtggccaaantgttgcagtgccat

SEQ ID NO: 35119 - DNA, 888 bp, Heterodera glycines
  misc_feature (10)..(11): n is a, c, g, or t
  misc_feature (25)..(25): n is a, c, g, or t
atgcctgcannggtcaatcgaaatntcaattgaaagaacactgaacattctatcagttatttcgccttttgtccttccattctgttcccaatttctttgactatgttttccaatccttctgcatattttccggaacggaataaatttttctaaaatggcattaaaattaataactaattaattaatgacattgtccggaagtattttttggagtgcaatcgacgacttttgcaattctccaaatcggttctgggattttagttttttggccaaaaaatgcgacagtgaaatgccacatttcctccgagagacaaattattcattacatcaattcccattagtcccttcttaatggaaaattatgcgctaattagcgagttgttaatcacataatttatgtctcctggtattacatattttttcaagtgccacctgatcagtgaacattcgagtaaattccgtgcccacaattggcacccctttcatgcgcgatgtccagaattttttatcccccactgccacaagcatcacaatggccttgccgcattcgtcgtccaaatgccatcggcgcattaatccgtccgccatttttttggctgcctaaatatgttttcaacatatttttcttttttttaatttaatgccaaaaacatatcaatttcaaagttacactctctcacattcgattgatcagtggctgttttgctgatgtgattggcaatggccaacacagcagtgagtcctttcttgtcgcactttgactctccgcggcccaacttaaatggattaaaaatgtaattttaatgccaaaattaaaaatatttatttttatttcctaatcctcaaattgcccaccccaaatgcttttgaccatttcggccaatgctt

SEQ ID NO: 35120 - DNA, 864 bp, Heterodera glycines
cggaggggcgggcggaagattttgtgcaattaagaccattttacattgtatctaagtaattagctacaaacatacaaaaagccatcccaattttgtcccattcgcattaacaaatggcaaaaatatatggccttaatgaaaaagaagcattttatatttttactgacaatttggccagtccaatctcaatttcaaatttgtattctctcttatcaattcattcattcattcatccattgcataatattctttttcgttttgtttgttttcctcaaaattgctttttgagatgctttgtcccttctttgggatgctttgtccccccccccccccccgctttttttgcttttcattcgtaatttttctttctctctgtccgtcgtattcctttccttttccttttttgtttgtgttatttatttatacactttcttgggttttaaatgtgcattaatttttatcattttgttcaattgcaaaacgatgaaaacggagaaaagcacagaaaacaaacggcggacggacggacgacgaattttgggcattcgccgccgccccctccccaatcacagcaccttttagtccgtcaatcaacacaaacacaaagccaatcaagcaaataaaattgcataatcacttgattaaatcattcatatgcccataaaattctgaaattcatttgttgccattgtgccacaattaacccataagaaatgccatgggaatttggaaagtaaacccatcggtataactcggaactcactggtactatagaaccccggtagtcctaacggatccccgttcccgggcctccctcccggtcattttttacgagttcaggtcccggactttcaagctctactg

SEQ ID NO: 35121 - DNA, 1181 bp, Heterodera glycines
  misc_feature (43)..(43): n is a, c, g, or t
  misc_feature (51)..(51): n is a, c, g, or t
  misc_feature (94)..(94): n is a, c, g, or t
  misc_feature (105)..(105): n is a, c, g, or t
  misc_feature (977)..(977): n is a, c, g, or t
  misc_feature (990)..(990): n is a, c, g, or t
  misc_feature (1075)..(1075): n is a, c, g, or t
ctcagatttttgaattgagaaagttgtaaataagtaataagantagctgtnccataagaaagctccgctcgactgcccatttctgatcgcttcngatgcctttgnctatgccatcactcggttcccctatttcctctcatttttgctcgtttgcattcgtcacccgattcgactaatcgattgctctttcctaatgaccgttgcgctaattggcaatcggacttccatctttatgatgctttttctcggcatcgaacggtgcgtcgctgtgctcttcccaatttggtaatcaattagataattgactaattattatcaattttaagtgaaaaaaaattctcaggtcaaggagtcgcaaccaacgcaaatatgctttttggacttgcatattttctgtgcttctccatgcaccgttcagtatttaccaatgcttatctgttgggttcaacgcaccgaaaaggcgccgatttatttttatttaatattttaattttaattttagattacttttgtgctcctcaattgatgttgtggcgggaggtggaaacaattttatcatcacaattttgaacaacggagtgatgggcggcacaataattgtgtacactttgttgtggttgaaaattaaatttgcgtcttctccaaatggtaaggcaaaggcaaaggtcgaaaattgagtgtcaccaaattacagtattccgagggaaattgaccaatttccaaaatggcaattttaaaaatattatgactagggtagcaacttttcgtgacgaaaaatcccgaaatagttaactaaaatagtgagtaaaaatgccaaaatagtgaagaaatagtgacaaaaagtccgaaatagtgacgaatagtgacataattttcagccaaaaattaagcaaaaataatttttattcactgattgcattgcaaatgagtagggctgggatttttaagggcaaaaaaacaaaataggtacataaaanaataatttttaanattaaattcttgcgacgaaaaacctttttgagaaaattttttcatttcttaggagtgctttttgaaatttttttgtcgatcttangagtgtattttttgttttattgcattttgttaagaattttccaaaaatgtcgaaatagtgaaaaatagtgacaaacgccaaaatagtgatttttactattttagtg

SEQ ID NO: 35122 - DNA, 822 bp, Heterodera glycines
actgttcccactcgccccgtcgaggcccgtcgctggccttttttgcgggttttctttctcataccgttggagtgtgaaatgtgtggtcattacacgcttaataaatgaccaaatttactaattgatgctttttcgggggactcactgtgctgtggatggaatagaggtggaaggcaaggcaagaggagatcatcagttggatggttttgagtcgattccgaatggaaatggcagcactcgacgaactcaacgttttgctgttcttgaaagatgcccaagaagagctaaaaatgatttgagggtattatgaaaataattggcaaaacattactttaaaaaattgactacgtcagtcaatgatgagtgcattttttcgggctttgagttgagtgaagacgctgtcattatgtaaaaagcgacggattcgaagtaaagcagaatctgatgcaccttatccctctaaatgcaaatgtttttgggttcatccgtcctattcagtccgcctttgcctcgcctacctcattatttccactttttttaagttcacgagcgcggcttgcaaaatgatccacggacaaattttttccgttttcaaaacggggagcaaaagtggcgacggcactttgacccgaagacttatgcaacagaatgtgtaatcagaaaaagactggtgtgggtattgtaccagctttccatctgaatgttgagttggctcttccgccaaatttgacgacggtgccctcggcgtattggcactttcgctcatgccggaagatgtgctgctgtccatattgtctctctgatccgcctttttgtcttgct

SEQ ID NO: 35123 - DNA, 1566 bp, Heterodera glycines
aaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggtccgcttctgatcagtttataaaaaaaaagttaagcctaaaatctttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttgg

SEQ ID NO: 35124 - DNA, 1191 bp, Heterodera glycines
atgcccaacgcgacaatccgcgcgccggccaaggccaactgttggtagtgcgagtcgtagtcagacggtggattcgagaactgaaaagggactgacttttcaattccaattacggcggttttggcactattttttcaaaatgccattcatccgttgctcaagcatttctcccacctcttccacttcccttagcattccctcaccgaccattggcttaagcacttcgggcgcccccttgacgctgacaatgtgaaaagtgtcgttggagccggcaaccggctgatagcccgccacgacagtcatccgtttcatttggctggtgaagtgaaagcggcggaagattttcagcggcgccattttgggcattcgccggttcggcatcacagcgtcttctgagaatggagaaatttatttttataaaaaaattctaaagattggcactgaattccgccccttagagccaaaaataactctcacgtttcgtgacgttccagtccaaccatttgagaatggccttctccagcggatcgcccaccaattcgttctcaaaacggaccaacgagtggcaggaggccaacgcgttgattgtgttgggtccgcactcggcaacattttgaacaacagttactgtggtgtcgcttggcgtcgtgtcattttctgtggagcggctgtcagaggccatcgcatcgtttgaagtacttctacaaacagtttggatgaaggaataatcttaaactggatttgaaactccgacccatcccaaatagtttgattgttttcggaggattcccaaatccgatccccgagattatcttcttcaaaatcgtcgttcccctaatttcatcttgtattttttaggtttccaatttgctgacaaatgtcaatgatcgttcatcggctgaaaggggcgttcgagttcgaattgtgctcacccgttgctgttcggggagtctgcctttgttgtgggcagtccggcaacgccctccatcaccaactcgtccttagtcagagtgcccgtcttgtcgaagcagcacatgtccactttgccggcgaacggaattcgaaagggttcggtgcagaaaatgtcgagccgttgcagagcaaccagcgaattgttcaccttgaaatgcatttaaattaattcacttggagggaattcattttccggggaaattgcatttttatatgcaa

SEQ ID NO: 35125 - DNA, 1119 bp, Heterodera glycines
atacagtatttcaaaaaattttttgggggataataaaagagggaggggttcaattcgagggtgggaagtacggtaaaatagtaaaaaatatgtgcattttggttcccagattgtctggaggacaaaaatataaaaaaagaataaatgtttatttatttatttattatttgattgttacttaaaaatgataaaattttatggctttttacgtcatattatgatgatgcaataaaaacatatttacgaaagaaatgtttttattggtggctctatttaagaagaagccccacttggacagaaagcatacattttgttttgcgaatcggaaaatgtttttcccaatttcacttttcataaattttgcgatgctttacaaattgctaaaaattgaaagctctccaaatttggcaagaacaattgctaataatactgctaatttgacccaaaatccttttgtcttgttaaaaaataatgctcaacaaaatgcgaggcatttcaaaggtttgacattttaaaaattaattactagggttcgaagttgtatgcactaaaatatgcactaaaaaatgccaaatatgcactaaaaatcacccaaatatgccctaaaaacccgaaaaatgcccaaatatgcactaaaatatgccttaaaaatcacagcaaaatggcttttaacactcaaaaaaatgccaaaaattgtgtataaattaagaattgactaaaaagaccaaaacaaggactaaggagcatttttagacaattgcaaaaatttttattatatgctaaaacaaaattacatttttaatatacctaaattattttttccaaaagttcttgcagaaaatttttcgatttttaagggtgtattttttaaaaaattcccaaaaagtcggtccttaagggtgtatttttcgcttttttcgcatttttcttgtgaaaatttgccaaaaatgaccgaaatatgctctaaaagcccaaaaatggcaaaatatgcttttatctcgaaaattccaaaataggcttttatatgcactaaaaaccttcaaaaaatttaacgtagaaatgctatttttgagcccctttcttcatagcatatgcgcagaaaaaatatgcaaaatcata

SEQ ID NO: 35126 - DNA, 782 bp, Heterodera glycines
  misc_feature (704)..(704): n is a, c, g, or t
  misc_feature (766)..(766): n is a, c, g, or t
  misc_feature (777)..(777): n is a, c, g, or t
aaagtcacagaacaatcgctaaaattttatcaaaaacataacgcacattattgtgactcaccaaagtcacagaacaatcgctaaagttttatcaaaaacataacgcacattattgtgactcaccaaagtcacagaacaatcgctaaagttttatcaaaaacataacgcacattattgtgacacactaaaatcacagaacaaacactaatgttttatcaaaaacatgacgcacattattctgactcaccaaagtcacagaacaatcactaaagttttatctaaaacataacgcacattattgtgactcactaaaatcacagaacaaacactaatgttttatcaaaaacatgacgcacattattgtgactcaccaaagtcacagaacaatcactaaagttttatctaaaacataacgcacattattgtgacacaccaaagtcacagaacaatcactaaagttttatcaaaaacataacgcacattattgtgactcaccaaagtcacaaaacaatcactaaaattttatcaaaaacataacgcacattattgtgacacacaaaagtcacaaaacaatcactaaaattttatcaaaaacataacgcacattattgtgactcaccaaagtcacagaacaatcactaaagttttatcaaaaacataacgcacattattgtgacacacaaaagtcacaaaacaatcactanaattttatcaaaaacataacgcacattattgtgacacacaaaagtcacaaaacaatcactanaattttatcanaaaca

SEQ ID NO: 35127 - DNA, 1079 bp, Heterodera glycines
atcagccaaagtttaattgctggaagttgctcacggccgaactttacacaaatagatgcttcgagagcgcaaattgccaagtaaagccttgaaaaccaaatgacaatttattgaaagcccaaaactaaagtgaattgactgaccaacattgcattcccattcgcttaattttcggatcagtcacgtacaaataatattgtctaaaagattcaacaacaaataaactaaaagtcaaatataattaaattaccgaattgtgggggcagcgatcagtccgatgaaaataatgtgccaaaagacgataggatgggaagtgtcgatggctaaaacgtgtttcaggaaaaacacgttcagctcggtggccaaccagaccattatgaaggcgtaaatggcaatgcacctcttaaggcccacgagtgtctgaaatgaattttgccgccaatttcaacgagtcagtttgttaccatatgcgccttccccggaccgtttttgtggtcggtgtttggcttgtctaccatcaaatcgctgccctgcagccaattgacggttatccaagattcgggtgtgaattgaagaacgacccgcttcaatttgccacgcaaagttcgaatatttctaaaaagtgagtgcacaatttaatggatttttgttagaatgcaaagaaattcaaaaggcacttgatgctctcccaatgaaactgctgcatctccaaacaacgacaaatccaaagaccgcaacaaatacccaatccgttgcacagcaaaacatccaaaatgatggcatcccaccaacattcttggaaattgggcaacaaatgggagaagacaatctgagggactccgtttcatttgatggcaatgcaaaaaccaacctcagtcaattcccaccaaatgctaatgtaccaaccttaaacaatgattaactgaaagcaaaatatgtgcaaatgttcacagatgatgctgtgccgaatgagcagtgctttcattgcccagccgaggaaatgtccgaccgcaaaaatgtccatgtaccccaaagacgctccaaatcacatccgagcaattcacgcgtacatctgtaca

SEQ ID NO: 35128 - DNA, 507 bp, Heterodera glycines
taacagcttctcacctgtggctgtttttctgcttatcagttcatttcttcacattctcccatctcaattacgtggaatgcgtcattcagcttattttgtggaaagaaaattccgactcatttcctttcattttttacatcgttttctgtcaacttcggcaatgccaactaaacccagcagacattcgccatcaaaaatcgtccatggagcgggaaaaagcatttggtttgttttttgatttgttttcccatttaaccaatgtaattttgctcaaagggttgaatttactgctttggctgtcgaatgcaatgcggtcaatttgggacaggtcgtacttttcatattttcttttattcttttcattttagggtattactgattctccaatgccggattttctcgcgcgacatttggccgatatcggaaaaagttccgaaaggaccgatatccacaaggtgaaacccacccattcaattcatatgatattttcccttacttggctttact

SEQ ID NO: 35129 - DNA, 862 bp, Heterodera glycines
actttgcttttttgtccatttattccaatcgactagtgctttaaggttttgtctttgactttgcttttttgtccatttattccaatcgaccacgttaattcattctctatacatttagtgtcttatttcatgaaattatatataatttaattttaaataaagaggcaaatttttacagaaaataaatagacgctgactaattagctaacatttataaagaaagtagaaatttgattaaatgcatatacaaaatattacttttttaaaatttgtataaagttcctagtcgtatgtgctttgcgttggttggttggcgtgggtgagtgtggtggttggaccgtttttgcgatattgtggctggaaaaaagatgcgatttcgctatggggagcgcggccgtctgggttcaagtgcttgcttgcgcttgtgctcggcattgaacggtgatggctgctgctggggtgccacctttgtcgtggcctcagtttccccagcgattggcagctgtcgaaatgaataaaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctctggcctgaggaagtgtcctaaccgggaaatccggaatgctcgtgtgagtgcctgtgcactgccctcggagctgtgtccagcggcgaga

SEQ ID NO: 35130 - DNA, 952 bp, Heterodera glycines
  misc_feature (899)..(899): n is a, c, g, or t
tgccattccggcccagtccccatgccaatttggccatgttcagtcccgccctgctgtttatgccaattccgacccagtccccatgccaatttggccatgttcagtcccgccctgctgtttatgccaattccggcccagtccccatgccaatttggccatgttcagtcccgccctgctgtttatgccaattccggcccagtccccatgccaatttggccttgttcagttccgccctgctgtttatgccaattccgacccagtccccatgccaatttggccatgttcagtcccgccctgctgtttatgccaattccggcccagtccccatgccaatttggccatgttcagtcccgccctgctgtttatgccaattccggcccagtccccatgccaatttgaccatgttcagtcccgccctgctgtttatgccaattccggcccagtccccatgccaatttggccttgttcagtcccgccctgctgtttatgccaattccggcccagtccccatgccaatttggccttgttcagtcccgccctgctgtttatgccaattccggcccagttcccatgccaatttggccatgttcagttccgttgcgtttgtgccaactcaccgtcttccgttttcttatttttcttccgcctctgctgctctgtcctgctgctcagtttggttttgttctgctcaattttgctttcgatctgctccatctcttccttcgccaattcttcgatttcttccaattcataaattttattttcgtattcattttgctgattttcaaaaatttctttgatttctctttgaagtttgcccatctttttttcgaattgttctctccgatttcgtagtgattcaaatattaatttttgcttcgctgtacggaactttttcnaattttttaaaaatcacgcagccatttgaacagaaaattcgctctatgtgatt

SEQ ID NO: 35131 - DNA, 1134 bp, Heterodera glycines
aaattcgaaaaatttgatttttcgactttttgttcgagtccgggattcggatttggttgaaacgggtgccggattcgtgatcagcgactccgaaaacccatggaaacatgttttcatattttcttataaatttcgttaaaaatttttcccagtggcgcctcggcaccccagactattaatttcccgtattttcaatctctccccggattagccatttatgagttttgtgaaacaccaggttgttctctctccccggattagccatttatgagttttgtgggtcataaaattatcggccctaataagttattcaaattttgtaattctgattattgttagctgtgatcgccgcgtcaattttttaaaatttaaaataaataaaaccttgtatatattgcaaacaatgtttttttgtgtcaaatttatccgattattaatcatcctaattatcaataattacacgaatttacaatttttaattggctaaaaagaataaaaggggtttgaagcattttagaaaatggtttaattgattggtaaaggatgaatgcagcagaaagcgaatcaaaaaattgttaattggttaacttgaggggacccgcgatcgaatggctgggtttaatctaattggagtaatggggtgctctgattgtacattcaatacgttttctcgttgtcaaagataaatatgttggaaaaacatagaaggctgatattatggataaattcgtttatgacatatctgtagcgatgaagatcgataaggaagtaacggaggaaaatgaaaaagacaaattgcaatgtaataaatagatagctaacgataaaataacgagcaaatgtatcaaaaaacgaacagaataggcaaatggggttaacggtttcgtaaatttacaattttcggtcaaagtgtacggacatttgccgaaaggtaactcatgtcaaacaatcatcggcatctatgcaagaacgtccgtcttattctattccctaacgaccatctcaaatgatgttccgattgggctggtgcgcgcactcctccaattcgctctcattgtcagcacgggttgcattttttggatgttggtcttcgtcgaggcatgaaagtttgccgtctggtccctgtgagagagt

SEQ ID NO: 35132 - DNA, 1380 bp, Heterodera glycines
gcccgttttttaaatttggttgggaccagacgggcgcttcgcgcccgttttttaaatttgtttgggccagacgggcgcttcgcgcccgttttttaatttggtgatttttaggccgctcgcggcctcgtacgggcgcttcgcgaccgttttttaaatttgtttggaccagacgggcgcttcgcgcccgttttttaaatttgtttgggccagacgggcgcttcgcgcccgttttttaatttggtgatttttaaaccgctcgcggcctcgtacgggcgcttcgcgcccgttttttaaatttagttggggccagacgggcgcttcgcgcccgttttttaggggcacaacagtgattagaagaggtgcaacagtgattattaaattcattaaattaaaatgaaaatattttttaacaaatttaattaaaaaaatacatgaaattctatcaattaaaaaaataattaatttaaacttataaaatttatttatcaaaaaaaattaaatataattttttatttattaactcaacaaaatattttaaattaattaaaatcattgaaaataacgtaaaaatacaaagaaaaataatgtacaccgcccggcttcgaacttggcccccccccctcaaaatgatgcctcagaatccccaatcacacagggattctgaggtcttgactatgtcaaaagtacaatctgattacgtattcgtgatcagcaccctaaaatagccctaaagacatattttttgaagatttttggtgaaaaaatttttcaactcaaaaatcctatgctcacccctttggtcccgaatgccaaaatcacttttatttttgtatctttttttaaaaatgtgataaaaatgtaaaataaaatttatattatagagaaaaaaattgcggatttttgtagtattttacttttcccgaatagcttttcagaaggcagctacgaatttttttctgaaaaatcgaaaatttccagaaattctggaataactttttttttttttctgataaaaaactcaaataaatcccataaaattctcctgatttttctctatttttaaagctttattatagttaaatcgatgaaaccatcaccgagttatgaattttccaatattaacccaaatttccaagggccaaaaaattgccaaaaaataaagaatttttaaaaaattccaaaaattatgaaacttaaaatagacattatattcgtactcagcaccttattttaccccagaaaaatatttttcacccccattttcgtccgaaaaaaaatttccgaaaatttctagggggcctagctcgaaaatttttgaaattttccagtcatgaagcacaccattcgatagcatttaaaattctctacaaaaatgttcta

SEQ ID NO: 35133 - DNA, 1186 bp, Heterodera glycines
  misc_feature (114)..(114): n is a, c, g, or t
cttggaaaatcaaacacaactccgcttaaaagacagatttctgtctgcaaaagaaatagaaatgtgaaaaaagatttgtctttcttatttagcttattttatcagtttcttttnggtagttattgagatttgattcgtttttatcaagtgtctctattttaaattaacacccctttttcgggaaaaaattcataaaattttttattattttcgaaacaaatcgacaatttttaaatttaaaatttaaacaaaattatttgtttttgaagaaaaacatatttatcattattattttattataaaaaataattttaaaaaaacaattaatccaattaattgcgttgctttatttgggcattttattatttttgaaacaaatcgacaatttttaaatttaaaatttaaacaaaattttgagaatatatttctaaaaatgatgttttcggacaatttccgatctttgggggtcaatagtctaatttagctgatgggagccgttctattagatcttttttggaaagctgccaaaatatgtacataaaatatgtaaatatggatataaatcgcggattacggaaaaatatggatatagaaatccatcctagaagcttcaaaccaaactaaaaaaatgtttttcgtgcgtttcagggctcgcacattccaattccatataattccaagccctaattataacttcacaggtgttggatacaaacaatggctgatggcaacgaatggaaacgagaaccgcttttccattttgctagaattgtttgtttggatttgatgaaagcggtgagttttaggtcaagggcgtagccagacccttggcttctgagggggtgggaggggggctcaagtcaaaaactcgatttttggtgtatttttctgtttttattcgattttagggggtgtatttttcgttttttgaaatcccgaagtagcgagggtgtattacagaatttttagctttttttcgccaaaaaattactgttttttgcatggtttttcacacgtaattaatttcttttatgatgaatttagtctttgatcgcgtcacattgtgccaatgttatttatgcgggcaaacaaaaagatattgatattgaccataggaacatcaaattaaggctgcaagaaattactacccatatggctgattggatagccaaaatgctggtaaaaa

SEQ ID NO: 35134 - DNA, 849 bp, Heterodera glycines
  misc_feature (747)..(747): n is a, c, g, or t
gagcattttcgaaacacagcaatgccatgtggtcaactgcaccactcacacacccacgtataatttaagagaaatttcctccccgatgcccacttttctctcgccgaagatcagcaaggagaaagcttactttattggtgaattgccaaaattgataccaaaatataaataattaaagcactatcaaagttaataaacatgttttgcgtgcatttccggccttacagccgtttaaaaaaaattatgaattgtcctatatttccgatccaagtcataaatatgttggcaaattataacacatcattataaaatctgtatcaaattaattttgctgcataattacaaaaaattcctaccaataaaaaagtcctgacatcgacagagacattttgaattaaataattgcttaagacaatttcctctcacccaaccgtaaaaatggcattaatttgtcatattcattcgagatcggacaaggagttcagttgggttttcgtttataaagcccaaaaaccaaagaaaaactgataatttcttggacaaaaaagccaacagtactcgactcaattatttttcaagtccgtattagctcaaaaaatatccaccgattcctagttttaactttaataaagtgccctgatagtaatggaaactcctgtttataatgcagagctaatagattggggattatcacaataccaattacagagagagagagcctaatttcatcagttacagataattatnttgtgaatggtccaattcttggtcaatttgatgcgcaccgttctcagcctaattatcgtctcgacatggattttgcccaatattgtggcaactgagacagtc

SEQ ID NO: 35135 - DNA, 861 bp, Heterodera glycines
ttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttatttcataaatattttttcagaaaatgctctgaaacgcaccaaattttatttacatgttagtttaggcactctgatgcttttctatcgaaagggagatgaataaattttttaaaattttaatccttttaaacaggcaaaaagttaggcttaactttttttcagaactgatcagagcgccccaactttgcaggatactgaagggaaagaataacctgttttacccttagcttgcatcagttttataaaaattttcaaaatctgagttcctataatttattttttttcaaatttgaggggggg

SEQ ID NO: 35136 - DNA, 1291 bp, Heterodera glycines
attcataaatattttttagaacgtgctctgaaacgcaccctttgttaattaaaagttaaataaggctctctgatgctttcactatcaaaaagggagatgaataaaaaatctaaaaatttttaattgctttttaaatttgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccatatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtacattaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctcccctataattgtttgagtacccctaaacggaccact

SEQ ID NO: 35137 - DNA, 924 bp, Heterodera glycines
  misc_feature (904)..(904): n is a, c, g, or t
tgaaaattaacaaattgaaccatcaaaaatggaaaaataaaaataaagaaaattcattttaaaaatagctatagctaaattcaacaagaattgcaacatgattaaatacatatagtgggattccaatcctcaatagaattacaaatttaaaacaaaaagctatttgtaatacaaaagtatgcacatgttaaaaatatataattgttgttcaagcaattaaaaatgaaattaattagtgcagagataaatgaataatcaagtaaaatgaaaaattaaaaaggaaaagcacatcgattgttattcaagaaatgaaaattcaataataaaaattaaaatacaagactaattatgacgaacattttgtttcattgaaaataaaattaaaatgttgaatgagataaatacgtaatatttataatttgtaattgaaccctattgtctgttagggagattctttgatcatgacaataaatttcgatacaaaattcttcttataaattagttcactgaaaattttataaaatcagcaaatagaaaaatttaggtgacgcagtggccggtgaaaataaactcacaaccatcgagtaagaaataatgcaaatacgtttgaatattgacaacatttctatgactaacatttctgacaaaattaaagtattaaattaataggaatataaatttggcagcatcggcagaataaattattaaattgatagaaaaagataaataatgtgaagaaaaaatgctccacgagttatgagaaaaaacaagatgcagtataattttgactaattgatgtgatgtagaacataaaaggtaactcgcccggtgggactcgaacccacgaccccagcaatccgtgccgtgctctaaccactgagctacgggcgcttcttttagaggntctctcaggtcctttatccc

SEQ ID NO: 35138 - DNA, 952 bp, Heterodera glycines
tttccaaacatttattagaacacaaccttttttaaaaaacggaaaattttttcaattttaaccttttagcaaggtttaataaacgatttttaggcctatcggatcatatcaaattccatccaattcggacaattatgaaaggagttatagtcgaaaaacagggacggtcccagggggggggggtacgtaccagggggtgggataactctcgcctctcgtctctcgcctctcgccaactctcgccatttttggtactctcgcctctcgtctctcgcctctcgttttttgtgacgagaggcgagagttgaaaatacacccctaaagattgaacttttgagcagccagaaaaattttcaaatttacgcgaaaaaaaatcttaaatctctttctttccttccttaatgttttctctatttttggatagctccaattcaaatatggtctgctggctaaaccttctgcctttcattatttttctcttgggttcaattccccaacggtacagaatttttttaataatttctttaaattattttcaattgaaattttaattaataaaaaatatttcaatttaaaaattattattttttctttttttaaacagcctaaaactgcaaaattaaccaaaactttgatcattttttgacaagttctgttaatatattacactcaaaattttagaatttttccggcggcgcctatcggcggtgccgattcggcaccgccggaccccgcacccaatgttccaaaaaaattttttttggaaaaacagcgccacaaaaaaagcgacttaaaaacaaaaaatttaaaaaacaagttttggtcattttttgaataaaatctgttaacaaatccgaagacaattttcaaaattttttcggcggcgcctaccggcaccgcccgaccccaactgtccccgaagttttaaaaaacgcaccgcaaaaaaaaggtg

SEQ ID NO: 35139 - DNA, 922 bp, Heterodera glycines
tttccccttccactttctcttcctttctctaccttttttcttcctctttctcgtctccttcctctgccattttctcagcccctttctcttcctctaaaatcttccactttctattaactttcctggttttcttcctcttacactttctcttcccttctctttttcttctctttccgcttccactttctcttctcttaactcttccacattctcttcaacttcctctatcggtccctctttccattccactttctcttccctttcctcttcctttttatctttctcttcgtcttgctctcatcttcctatttctgttacccgtcctctttctcttcctctcctctttgttttcctattttgaattattgcacaattcacgtaagtaagaatttataaaaatttatttgttttcataaaataataataatataacttaaaaacgtttatgaactcaaaaaattatttttcttattaattatatagatttgtatttgtatttgtattttttatttaattaattcaaatctaattagaaatacaatattattatttattttaataaatttaattaatgaaaaaactaaaattaaataaataaaattaaaaatggcaaacaaaaaaggtgaacggaaaacaaaagtgaacagaaaacaaaaataagaaatcgaaccaatgacacacagaaatcgcgaccaaagtgcttgtcgcttgtcctccctttttagggcacttcccgggtccggacccaaacaaccctgggtcattcgaaagccaagagtttgtagatgtgcacaaacacattaattttttgatttgacccattttaagagaaatgccaaaataaggggaaaaaaattattttaggggcaaacactcaaaatagggatttttagcgtgaacattcaaatatagattcctgaat

SEQ ID NO: 35140 - DNA, 1001 bp, Heterodera glycines
  misc_feature (989)..(989): n is a, c, g, or t
tttcaagccattccttttttattttattctttttgcaattttagtatgaaatttcatgccgtttatttttgtttaccccccttttttgcattttccgcccataggtggcaaaagatttgtgcaaaaaatttaaaaccaaaatggcgaatttttatattattcttttttaatgtgtatttaaatattaatcataaaatttaaattcattgagactgattaatataattaaatttaattattttatcaatcactgagttttttttggattgactcagcacgattcccttcagtctgtaattcataaatcagaaaaatttttggaggaaaaaaagacattaaaaatagaatttttattttgtcatattttattgggatcgatccatttttttcttaaaaaattggcttaaaagcgcaaaatttagtcatttttggataaaatctgttaacaaatcgcattaaaaaataaaaaattttcccgaaccccctggttccccaaaaattttggaaaaaacgcgccgcgaaaaaaacggtgttgaaagcaaaaaaataccggtaccggtggaaaagttggtaccggtaccggttttttgcagtactaccggtaccggcatttttacaattacctattaccgctctaccatagtttaaggctttaagctcgaagaataaaagccggaagggaagttagttattatgattaattgaagtcaacttaagagtcgaaaaagaaaagtgaaatggaacaaatgaaattcaaagaaagttcttaggaaattgtactttttgaattgaaaaaatatgggaacgttttttatagttaaataaagagggagggcttaataaaatcgaattgaattttgttcattttaaaaacctttagattatctaattataatttgtcgaatattttttttctaaactcccattaatttttttattttcctcacccatggcacatccgcccgattgcatttcgtggatatccgctnattatttgcttt

SEQ ID NO: 35141 - DNA, 941 bp, Heterodera glycines
aatatccatctgcgcgttttgaaatgttcgtccactcggctgtcaaatcggcgactgatcagtgtgattccaagtccaagctgagaaggcgcaagaaaagcgaacacttcgagccaacaatcggctgagatgaagctgaaaaaataattttctaattttattaatttttattgttttttttacatttcttttttgggagggcgtcgtccttttttgacgtggtcccaaaagaaccaaagaatggtgccacatccgaccaacagaacagtcacaacgtagcaactgaagaaaaaaaaaaagaattttggggaatgagtgaaaatgaatggaatggtacagcaaaaaagggcaaagccaggaaagccaaatgtggaaagaattagtggttgaaaaaaatttcatctttgcaaccttggccaacttttttggtaaagaaaatgtgatacgatgtaaaaaaacgtacggaattctcgaaggcattacgggaacaaaaaaaaaaagacgcgaaatttgagcgaatgaatgagagtggagggaggagaaaaaagatcaatttatagccaaactgattcgtttcattcaaaagttttttttttgatcatatctttttagtagagtagagcgggaccgggaattttgggcttaaccgggaccgggaccttttcgggttgaaaaaccgggaatttttggctgggaaaaccgagaaaaaacccgggtctggtcccggtcaaaaccgggacctcggtactcagttgtccgtgttttggtcccggtcccgctctactctactttttagaataacgaaaaaattttaaaattttacgagctaataaattccggaacgaaatattccgatttcgggaaatcgcgaaaatttatcttagaaacgaaaaataaatcgagcgttatccgttacgaccgagaagaagtttttaaagaaa

SEQ ID NO: 35142 - DNA, 963 bp, Heterodera glycines
tttccttctgaaaagcttgaataaagtcaatctgaaccagaggatttgagattacaaaacaattacataaagtcaatttgtgattttgccgtaaaaataagaaaagtccgagtattctttattaatgttatccgacaccatcatagaccattttttacttaatactaactaatgaaataattattaattaaacagttaaattggtagaaaattgtattgatttaaaatttaattaaaatctttaatgtttaaacatatgtaatgattgaaatatcttattgaaaattgtcttcatttaaagaaatttcatgaatttcttaaattaaaatacaagtatctaccgttgatacaacgcaaggacatgaatcttctctagccgagttagtaaaattaaattaataaaatttcattaattaaacatttattcgtatgcgattaaattgtcaactaattcttgatttataaactaaaataacaaggcagaatatacataaaagcattctttaaattaaaaattcattaattatacgaaaagcagactaaatatttatttattatttttcaaaatttatttttcaacttaatgttttgggattaattaccacgatttgagcatttaatgcgtttccaaataaactaaaaaataaaaaaatttgttttattataaaaaaaattcacgaaaagaagcaataatgaaatgcctgaataaatatgattttaggtcattagcttttgaagaacaattgagtttattttccatgaattattgtgaagcaatgccatagatcaaacatatggcaattgaaacgtttcttaatatttaaatataagttcataaaaattaaaactttcactgaaatacctatatgggcgcaaatgacggttgcgtcacatgcctcacagcaatgtccaaccctatgataccaccgccaaaactaatatagaaaaaacttagaaaaaatc

SEQ ID NO: 35143 - DNA, 1433 bp, Heterodera glycines
ctgcaaaatttaaactcatcctgacaactataaagtgaatattaaaatcagctttttcaaacttcatgatctatatgacttaaattcccgtccataatgatctgcattagatactcatttaaaattttaaattattataattcttaagcatttataaaaatattttaataaaataaaaaaaaccaacaatttttgtccaccaatttcgccggcacaaattcattgttggccatcaaattgtccaactcatcgccccccatcagcaaattcagtgtgtgcagtgcgcccaccgtttgccgaatgcgtttcagcagcggatcattggccggaaaattgggcaaataatgggcgaagaattggccgtgccattgggctgacatttcccgctgatcggcgaaggtttgccgctcaatgttttgtatgtcgttgtcgagacacttttcgactagttggctaatggtggtgccccgtatggcattccgttgccttttccccttgggcgtcgtctctttggcacttggcaatgccatgcaaagcattcgcgcagtccgccgggccggcacttcgtcgtcgaacagatccaacacactcaaaaccatgaacaaatacataatgtggggctcgtccttttgcctttgactttgtaccgccgtcttttcacgctgatcatttagcaaaatgtgttggatggcacggatcagtgccaattccatctctttggcacgtgccgcttcggtgttttgagcgtcaaaaatattttcataaaaactggccacctttttttcttcagctgaatattttttatttttttatttaattaaagaatttttttttaattttggataatttttaattaattaaagaaaaaatgtttaattttggatatatttttaattaattaaataaatattttttaattttagataattatgtttaattaattaaataaataattttttaattttggttaattatttttataattaataaataattttttaattttggttaattatttttataattaataaatgtttttttaattttggctaattatttttataattaataaatgtttttttaattttggctaattatttttaattgtaaaattattttcaatttcgatatttttattcccctttttcgccttttcttacataattttttaattgttgcaaattcattcgctttttctttcgaaaaagtgtaaaaatccggaagaacatcaatgaggtttaaaagaattgacatatgtagttttagaattttatttccttttgtttcttgctcaaaaactttgtcataattttccgcattttcacagtccattttatgccaaacaaaatcagaatcactgggctggacattttcagccttaaaatggtgccaattagcgcgccaattaggcaattatgccacacacactctca

SEQ ID NO: 35144 - DNA, 876 bp, Heterodera glycines
tctccaatttacaattttcatgatcactttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtggggtcgcgaaaatagtaaatctgaggttattggcgcttatcaacctgatccgtctgcaacacttaaacagtttatatttaaagcctaattagcagaatgtgaaattctctcatttgttactttatgatcatttttgtctaattcgcaaaattacagctcattcttcgcgaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaatcgatccttccggaacactgatgctgtttatatttagagcgtaatgagctgaaaatgtcagaattcaaaaagtggggtcgcgaaaatagtaaatctgagggtattggcgcttatcaacctgattcgtctgacacacttaaacagtttatatttacagcctaattagcagaatgtgaaattctctcatttggtactttatgatcattttt

SEQ ID NO: 35145 - DNA, 873 bp, Heterodera glycines
cataactaagaatagatattctcagaaaaatggctatctcttttttctacagccttccacatgaggttttccccgaaaacgcattactatatacggttgagccctacaaatggtcggttggaaaatggctccataactaagaatagatattctcagaaaaatggctatctcttttttctacagccttcaacatgaggttttccccgaaaacgcattactatatacggttgagccctacaaatggtcggttggaaaatggctccataactaagaatagatattctcagaaaaatggctatctcttttttctacagccttccacatgaggttttccccgaaaacgcattactatatacggttgagccctacaaatggtcggttggaaaatggctccataactaagaatagatattctcagaaaaatggctatctcttttttctacagccttccacatgaggttttccccgaaaacgcattactatatacggttgagccctacaaatggtcggttggaaaatggctccataactaagaatagatattctcagaaaaatggctatctcttttttctacagccttccacatgaggttttccccgaaaacgcattactatatacggttgagcccaacaaatggtcggttggaaaatggctccataactaagaatagatattctcagaaaaatggctatctcttttttctacagcattccacatgaggttttccccgaaaacgcattactatatacggttgagccctacaaatggtcggttggaaaatggctccataactaagaatagatattctcagaaaaatggctatctcttttttctaaagccttccacatgaggttttccccgaaaacgcattac

SEQ ID NO: 35146 - DNA, 620 bp, Heterodera glycines
agcaataagtgtggcctctctcaacttacatgtcgtctgttactttggcacgcacagtccgttcaattccaaattacggcacgagttgcacgcgccgttgtcgttggaccgcgtgcacccgccgatgcattccctgtgacacaactgagcatcctcggtgcaaccggcatcggttttaagtgcgttcaaacaggctgaagaaaatgggaattatacaaacaattaaaattatatcattaaacagctacaaattcctgcttgttctccacggcactggaaaagttatttttctatttaattatttttacttctttggcaatgcgtcgcattccaacacgccactcgatcagtgtttgaaatccgtgcacattgtctcggctcctccatgccggaacattcgtttttacaaatggcgacctcacttaaatacgaaaaaaatcgttaattgttgaatgcccacacaacgccaaacggacgaaagacttactcaatgattctgtcgcgaattgtacccaccaaaattgagtcccagtcgaggtcatgcgcatagcaaagaccttaagggccaaacggacggggaagcaattcaatggaaattcaaagtgtggaagggaatggat

SEQ ID NO: 35147 - DNA, 541 bp, Heterodera glycines
ttccataatttttcagcgtataaaaatctctaaaatcgcgtttttttgcattagctgctcattctgctctacctgtaacagtccatgccgagccgtgcatccaattgtttgatgggcggcgtgccaaaatcgtccgttgtcgccacaacggcgggcgacgcattgtcattgtcgcgctttttcaacgattttttgaagacgggcattttgccaaagaaaatgcaaattcaaagagaaaaatagaggatgctaaaagagagttgaaattggaatgcgtgagaaaatgtaagcccaacgaaacgaaacaaaggaaatgcgagtggaaaaggagggagggggggggggggtcattaatgattaaaaggatcatttgcgaaggaatggacaaagcgaagagccggggaaaaggcaccttctccctaaacagaaaagaaaaattaatgcagaggttttcatttaatatttgttttaataaattccgctggtggtatatttattcggcaccgcttcaaaaaagatgaaaaaatgccataaaagggct

SEQ ID NO: 35148 - DNA, 737 bp, Heterodera glycines
  misc_feature (642)..(642): n is a, c, g, or t
aaataaagccgtaaataaggggggaaaaaattccaaatttaggggtataatttttaaattgctgttttttctatgtaaataagttaaaagcaaaagcaaacaatcttattcattgaatacagttgcaaataagatacatttcaaaattttcaggaataaaggaggttttattttctaataagaatttcaggctactttaattaaattaattattttctgattcttaggggtgtattttttgaaattttttaggtcgattcttaggggtgtatttttagaaattttttaggtcgattcttaggggtgtattttttgaaattttttaggttgattcttaggggtgtatttttttgaaattttttaggtcgattcttaggggtgtatttttttgaaattttttaggtcgattcttaggggtgtatttttctgaaatttttttggtcaattcttatgggtgtatttttcgttttttattgcattcttgttgataaatttcccaaaaatcgcgaaataagtgcgaaaataagggcgaaacgccaaaatatgggcaaaaaacttattttaagggcgatgatgtaaaataaggatttttaagggcgaacacccaaaataaggatttctaaggtcgaataagggtgttanaacgcaaaattttcgaacaaaaaatgtgtttttcgtgcatttctcgtcgagttaaagccgcagaaaaataaaggaaaactttataatccgggccc

SEQ ID NO: 35149 - DNA, 397 bp, Heterodera glycines
cgcgaagcgcccgtcctgaggccgcgaagcggccgaattcttcccacaaaattaaaaacgggcgcgaagcgcccgtcttgagaccgcgaagcggccaaatgcttcccacaaaattaaaacgggcgctaagcgcccgtcctgaggccgcgaagcggccgaattcttctcaacaaaattaaaaacgggcgcgaagcgcccgtcctgaggccgcgaagcggccgaattcttcccaaaaaattaaaaacgggcgcgaagcgcccgtcttgagaccgcgaagcggccaaatgcttcccacaaaattaaaacgggcgcgaagcgcccgtcctgaggccgcgaagcggccgaatgttctcaacaaaattaaaagacgggcgcaaaccgcccgtcctgaggccgc

SEQ ID NO: 35150 - DNA, 1277 bp, Heterodera glycines
actccgtacaaaaagtcctgtcttaacaagactccggtcctgtggcattttccgaaacattaaccggactatatcagttgcccatctccgtctagaaaacaatacagttttatttttaagatttgaaacttaacctaaatcagcacagagcatacatttagcatttgtttattagctgtattattttaattaacgttttttcttctttccatcacttttcctcctccattattttgttcatccttttttttccattacattggcaaaaaacttcccgtcggtgaatcatttcttccattccaattggccacttttggccaatccttcgtttttcattttcattgattcattttacatccgcataaattgttgcataatattaaatgacatttttccgaaccaaagtcttcaaaaatgttcaatttcttttttctgctgatcttcgcttcttctgcccaaaatgcgtttcaacaaaatgtaaaatattgtaaattcgacattattttgtttaatattttattttttttgtctttatttttgatttagaattttacattttagcctcaaaatttgtccatatatttatattttaataaaatttttttttttattttgcagataatagatgcttcgtggggggtatcgaacgataccaagaatgtcaatcgatcactttgtcaatccgttcatccgtcccatctccttaatccatccatcaattaggcccattcgccgtgccgttgttgtgctgttttggtacatttggtgttgccatttcttaatttaaagaaaatggaggacgaatttatttgcataggccaattcatgacaagtttcacgatcgtttttaaaataatttacccatatttaaattatttttaccgataaacaattccgaaatgcctcaaaacgagatcaagcattaatttgcataatcggaaaataaatcggtaatattttattgaaaattataaattcattaaggtcttaccacggcggcatattggacatgttttatgtccgcttcttaacctataaaagattttttcttcatatatgcacatgtatgaaaacatagacccgaaaagccttaaaaataccgagttttcaatgcaatggttgtggaaaatgtgctgaaaatagcgtcattaatttcatgtatttaattatatgattttatcttacgttacacggcaacggtctgacaaatgtctccaaaggaatttgatcgagacgggttgcgcaatcaacacgttgctgatcaatggccataaaat

SEQ ID NO: 35151 - DNA, 1014 bp, Heterodera glycines
taaagtagcggggaaaagcattttatagtacgttggatttggcggccggattttggcaaataccccttgacaaacagacagcacataaatgtggaataataaccgaaaagggagtctacacaatgagaaagctaccatttgggcttaaaaacagccccgccatttttcagcgaattatgaatgaagttttgtcggacattggacatacatgtgcatatatagacgatatcattgtgtatacggacacatttgaagagcacatgtttattttggagaaaatttttgaccgaatacgtaattttaaattgaaattgaagcctcaaaaatgtgaattttgtaagagcgaaattgtttatttggggcataaactaaactgtaaggggtacgagccgtccatcagcaacaaagaagccatacagcatttcccagaaccaggaaatgttaaggaaataaaaagatttcttggactggttggattttttaggaaattcataccaaattacgctgcaaaagctgccccattgacattattgttaagaggaaaggaaaacgagacgaattttaagtgggagacagaacaacaaaaagcatttttggctctaaaaactgagctgacaaagtccccaagcttacgacccccaaattataaaaaagagtttcatttatttactgacgcttcacaaatcgcttggggaggggctttgatgcaaaaagataacgaagggacactgtacgcagttgcatactgcagcaaaatattaagccaaactgaggcacgttacccacccacccatggggagctggcagcaattgttcacgcgattggtgttttccattcaattttttacgaatgtgacattaccatttataacgatcacaaacctttgactttcctgttatccaaaggaaagaccaatcccaaattgaacagatggcttctaattttccaggatatcaacccaacaattaattaagtggaagggaagaataatgtggtggctgatgctttgtcga

SEQ ID NO: 35152 - DNA, 776 bp, Heterodera glycines
  misc_feature (5)..(6): n is a, c, g, or t
tctanngagtcactttacaaaataatacccctggggagaagggagtgggaaatatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaatttttgttgaaatatttgtcgtgctctgaagggcgtgggaggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactatgcagggatactccccggtaaaggactaacttacactgaaatgagcgccgagctagctggctcaaaaaaaattttcgaaaatctgagtctttcgtttttatttattttttgcaaaattaattcataaatattttttcagaaagggttctgaaacgcaccaaattttatttacaagttaataaggctctctgatgctttttctatcaataatggaggggaataaaattttaaaaattttttaattgctttttaaaatatgccaaaaaatttaagcttaactttttagtgaaagttggatccctcatattttttgctatttgag

SEQ ID NO: 35153 - DNA, 1168 bp, Heterodera glycines
cattaaaaaaagaattctgaaaaagtagcaaaatatttctatgtgtgtgttttgagttttcctcccctattttttttacatttttcattgggtaaaagtggcactgatcaagaatctgacatttattttttgcaaaaaattttgctacccctcccccataaaaatgccgattccgataaagaaaagcacttttctaggatagtattgcgtagcaaaacccacaagtaccaaaagtttattgttagaatatatgccgattttaatgcatttataacccatggaagcacaaattctattttccatttttaggcccggatccccgattcccaatttcttgaaaaaaattttcattgcagaattctaatacaaaactcatagtttcgatttctaaggtagttcttatcatttttcaaggacaatttgtttaatataaatgaaaaattgaacattacgttgacggtctgtttcacccaaaacttcggcacccattggctccagtacattgacaggccgtgcaatgccacggcttttttcgtacttttttgtactagattttttccactgacagccaattgaccatagggcggttgagtgacagcttgggtcatcggacagtgatcagtgatcagaatgagcacaaaaaacagcaaaaacccaggacaaatccaagcggacatttttattgattttgaataaaataaaattgaataattaatgaaatatgaattttcgagcatttgacgtgccttttatttcagaaaaaaccaaacttcgagggcaaattttgtattcttttgtcataaataaaatatgaacaaatattgaaagctgatgctgttaaattttggttagattgtatgaaatgttcacttcaataaagctgaacaaatgatgatcttaaattgccggtattctgctatatttttggttagattgtttgaaatgttcacttctataaagctgagcaaatgaggattttaaattggtggtaatctgttaaattgttggtgagatagtttgaaatgttcaattaaataaagctgagcaaatgatggatttaaaatgctggcagtttgtagttagaagcacaaaatatgaaatagcaattttgttaatttggcaaattttgacaataggttcattttaccaaaaaatttatgtgaaagca

SEQ ID NO: 35154 - DNA, 1204 bp, Heterodera glycines
  misc_feature (1196)..(1197): n is a, c, g, or t
aaaaaatcgatttttttgttttcggggcagtccccccgaaccgatgcgcccagatttatgggggagaccgaatccttcgggagtagtttccctatagcctgtactttaattttgcgttggatttttgctccccataaatgtttgagtaccccaaacggacacttgaaaaaatcgatttttttgtttcataaatattttttttcagaaagtgctctaaagcgcaccaaattttattttacaacttaattttagcactctgatgctttagtatcaaaaaggaagatggagaaaaattttttaaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgccccaaactttgcagggatactgaaaggaaaagaattaacctgttttatcaccattagcttgtcatccccagtttttataaaannaattttc

SEQ ID NO: 35155 - DNA, 371 bp, Heterodera glycines
atttggtataacttatactgccaagtaaatacaggctcttatatgtctctttccttttgggcctgatgacgacctccatttcattgttagcgccagatctttcttccctttgcttaagtgcctgatcactcttccctttgctttaatggctgatccgacttccctttgctttagcgtgtgatcaaccttccctttgctttaacgtcggatcagacttccctttgctgaacatgactgatctggcttccctttgctataatgccagatcagacttccctttgctttagtggcagatcatgctaccctttgtcttacagtatgaatcgacttccctttcctttagtgactgatcgagcttccctttcctgtag

SEQ ID NO: 35156 - DNA, 473 bp, Heterodera glycines
ttaataaaacggaaaatttatatagaaacggacggacggacgaaagatgaaagaagcgccggcggacggagaaaagcggcagagaatccaaagcgagaaaatcaatgggagggattataaaatttaattttacatttaatttattcgagatttttagggctgagaaaaggcaaatggaaaagggaaaataaaagagaaaaaagagaggaaattaaattcaaaagaaaagaaaaaaagggaaaaagaggaaattgaaaggaaaaagcaaaaacagattttggaatttgaaaataaaattggaaaaagcagcacacatttgtcgtttgtgagatgggagaaaagagagagaaatttgggcacaaagaaatttaaaatggcacagatgtgaattttggtttttaatattaattttgcacaatgcatttgccatttacaccaagtttcttaataataaaatattttattttattttt

SEQ ID NO: 35157 - DNA, 909 bp, Heterodera glycines
aattggatgcgctaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcatatgcgattttcggcactctgataattttagcgctcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgctcataatgggatgtataaaggcgatt

SEQ ID NO: 35158 - DNA, 657 bp, Heterodera glycines
atacatgaaaaagggggggggggtgggtcaaccgaacttttgctggcatttgtagccgttttttgccaaaacaatgactgactaatttgtccattttagggtcaaatgttttcaaaaatatggtaaaatgccgttagtcgtcgccgtttttttttgaaattttaattcaatttattaagaaaattaattttcctaaatgtgccaatttcttatttaatttatttattaatgtttcccttggctttattaggtggaggaactgcttgaaaaggcacagacacagagccgggagtggaaaagcgcgttgaagcagcgggatgtggcactgcaggactacgagcagacaaatgccgagttggcggacacgcgggcacggctggccaaggcggagggcgcactgcgggaacaggagcagcgcaccagacagttcgaggtgtgtgacaatttgaatttcaaataaatccgaatccgactctagaatttgcgacaattttctttcgatccaaattcgaaaaaaaaagaagaagcactttttcaacgaaataaagctgaaagctgcaatcgcaatgaaaaaatcaacacttttaaacaataataataataaattattaagagttttatgaaattggtaggaaaaatgggtgcaccccaaaattt

SEQ ID NO: 35159 - DNA, 1012 bp, Heterodera glycines
tgaaaatatttattttattattttcataattataaaaacatagctttacgactcgctaccccatctgggcacccaagagtgcatgtgctgaacgaagaggtggaatggtcagcatcggcagacaacccctacgatctctcgcttctgaaagtttgggtcattcccccgcgaaactgtgatgtgccggttctcccagtgagagtgggtgaacggctttgctttccgctttgcatgaagtgtgccagcgatcacccgacaggcggagttgatgaaaattaccactgcacacataacgattcacaacgtggttgggtcagcacttgcacatctttggaactgaatgctgccctggacgagggttatcgggtcaccaaacttttccgcgtattggaataccaaagcagcgatgatcaattgttcaaatcgtacattgcggaatttatggcgctcaaaatccaagcatccggctttgacaccagtatcaaaggcaatcctgagcttgaggaagcgtttgtgagggagtgttatgagaagtttggcattacaatcgatccaacaaagatggagccgaacaaagggaaacgatcgatagcaaagctctgcttgaataacttatgtatgttgtctttaaatatattatttttaaataaatttctagggggtcgattctctcttcgcaactttgggctgtcgcaaacactcatcacagatgaccctgtggttctcgctgaatatttggacaaccgatcgctcgaggtcacagcgatcgacgaattggacgctgaacacatactgatcagttatgagaaaaagaaggagtgggtcgaggaacatgcatgttccaatattggtataataatttatgaaaacaaaattcataattaatttagtaatatctctttggacaacttcggcggctcggctggtattactaaaggcaatgcagaaggtgaaaagggaaccaggctgtgagctactttataccggtaataaaaaataaataatttaaaaa

SEQ ID NO: 35160 - DNA, 434 bp, Heterodera glycines
aattattatgtttttgaatatattataccttttattaataatggatgttgttcgcgtttccgggatgtcaatccaaagaatcataaaatttcttcacttttttatcttcagatgctctcattggtaggtgttgccatttcaactcttcccatggatgccattcaattggcaatggaaggaactaattaagtcaaaatttaaattaaaaaaataaatcaactattaaatagagcaaagaacgacttataaatgaacccaaatatatcataatcagaaaaccatggaatgaatggaaattgaatgcctcaaaatttaaaaaatgtttcatttcacattatttcgatttgtaactgtttcttctttttgccgatatgcttgaggattgtcccgtggctctgtgtaattcagtcatcgcttatcaatggattttctgc

SEQ ID NO: 35161 - DNA, 998 bp, Heterodera glycines
ttagttatgtgaacgttatttttcgtcgctgagaagagatgatttctttttttaacttgttattgactacaaaaattaataattaatatttcttttgtatgtagcaatatagaataaattttttattaaattgtatcatcatttttcgttttttattttaaaatagttttctttttattactatttttcaaaacttttttatattgtcattttgttttattaggcacattttgcagataaataaaaattttctcatcatctatcaattatcatttaataattataattttaatttattaaagaatttaatttgtcaataatcctttcacttttaactgtttaattttaaaatttttcttgtattaaaattgatatagaatttaaaaaaaaataaaattataaagaaaaaaattgtaatatttttttacttcgtcagcattataatttatagttttaataaattaattataaaaaattgattttatccaaaatttatttaaaaagcattcaaaatggttcatcgaattttgcaaaccgggactatagttccttaacaaatttaaaaagactttaaattagggtccctccccgagccgttaattacttcattacaaaacccgaacatatatttacttggggtatttaataatatattcaattatgagatgaataattagttattaaattcttttattaataaatttaaaattaatcgttttttttacgtttacaaatatttcgttttatttgtatttttttcatattcttttttctttaaaccatgcttgctcttaaatgcttgtaataatttattaaaatctttttcaaataattatttataaaaatataaataatttaataaagaaaaattaattataatgctattaaatattttttattatacattttaaaaaattctttttgatttgaatttataaaataatgttttcattcaataaatatattcatttttttggtatattatttacaaaaatttt

SEQ ID NO: 35162 - DNA, 365 bp, Heterodera glycines
cgccatgagatgggccaaggtctgctgatctatctctaccgccttactctcctgaagccaaatgaacaccttgtatgcaaggacgtctcccaaacatactgctaagaggtgtgatatgcattgctcaaccctacactcgcaccagaacaccaaatcaacgacctgattcaaatgacagctgccaaatttcacttacataaactctgtgagcaactccagaagctgaaccggtcgaggttttggattacatcctaccgacttaccttgaaaatttagcctcaagacttctgaactcttgtatggaaatgccaggacatgaatggaatcataaacagcaaacccatattttactggaaaagatctac

SEQ ID NO: 35163 - DNA, 329 bp, Heterodera glycines
tcattgccatgcagatcttaaagaggtgaacatccttgcttatttccagtgaagcatcccacgctaccagtaatctctaattgcctaaaatacaaattgagctgcactacctattgtagaccctcccatacatgaagaatgacggagattcttttgaagatgtgtgaacgaatgagaaatcacttatattagccatttcaatctatacatcaatctcgatgccgattacgtcgatatattatgtcataatattgtgaatagtcctgaaagccctctcatttacgtgatctgcttgctaccaatgaagcgatgcgaatatatgacccatg

SEQ ID NO: 35164 - DNA, 911 bp, Heterodera glycines
  misc_feature (865)..(865): n is a, c, g, or t
aatttcaaaaaaccgtaaaaaaataaaaacttgctttctcaattcattcaatagctcattggaaaggctcttttaaacctctacaacatctgtatatgagttttttgcgccgacaaattttcttaaaattttgaaaaaattcacaagtgtttgatgaaaagtcatagataaaatcaatgatttttcaaaatcagagttcagatttgtgatcagcacatttttttaccctaggaaaaatgctttttgaaattttactatttttcccatcgggaccacaattctacacctttgcctaaaattgcaatttctccctttcgtatcccccaggacagaaatgtggccactcctcgcgactattattttggtaagccttcggattgggaaaaaaagacggcaaaacgacgcatcattagccgaaaccgagggaattggcccacttttgtcctttttcagccctcgcccacaccgtccgcgaccatttggtcagccgatggattcgcacccaacagcactattacgagaaggacccgaaggtaaggccattcattcccacgttcgattgcatcgttttcaattggtttcagcgcgtttattacctttcgttggaattttacatgggccggactttgtccaacacaatgctcaatttgggaatgcaagcgacggtggacgaagcgctttaccaggcgaacgaccgcattttatattacgaattaagtttatttggcattccatttcagctgggcctcaacattgaagagctgcaagagattgaggaggacgccggccttggcaacggcggactcggccgactcgccgcctgctttttggactcaatggccacgctcggcattcccgcctatgngtacggactgcgctatgagtacggcattttcaagcaactgatccgc

SEQ ID NO: 35165 - DNA, 1075 bp, Heterodera glycines
  misc_feature (893)..(893): n is a, c, g, or t
  misc_feature (983)..(983): n is a, c, g, or t
  misc_feature (1035)..(1035): n is a, c, g, or t
ttcgtttaaaagagtctatacaaaagaaaatagcatcctccatacatttattaaaaaataaacctatctaaaaatcaattgttgaattccattttattaaatgcgtataaatatattagttagaaaaggaaattttgactccgataaattcaattgaaactgcgaaaattttggacttattaccattggacaaaagaaaattgaaaggacccaaaaattgacacaaaataaacgtatttatcaaagcagaatgtttttattaatgcccctatttccgtaagatgaataaagtcaggtgaataatgaaaatattcgaccaaaattatatttcaagaaatgcaaaattaaatgaagtatttttttataaatcgttgccctccttaagaaaaaataaacatctgttttttcggattaaaaatcgagccaaacaattatatgaccgtaaaacaattactaccatttaaataaacatgattgtcgccaattttttcattggtgacgagaaggcgggtcaatccccgcctattgcacaaatgaacgggacaggactcaatcgaagcaaaaagaatgagggatgttcttggagaagatcggggcgagtcctgattcatcaattcattcaaaattgatcattcctaatttttgcccctttttcatccaatttctcatatgcatttctccatttcgtaccattcacattttgcccgttcctttgtcccatttttgccccatcgaatcccttcacaattcaaatcttttctcatcggttggctcatcttcggcgaactttgtgctcagattttctttcacaatttctcactttttacatctgccaattcacattcaatttttgtgcgcccatttcctttgttcgcaattcgcttctagaattntctgtccattttttgtctctctcacaatttgtccacgtgcatggccttttgcccgcccccttcgaaaattgtctatttaagcgccccggncaaggggtcgctctcttctcctctcttctcttctcttcccctctccttcgcnttcatatcggtctgcctgtgaccaaatcctccaattcccc

SEQ ID NO: 35166 - DNA, 1172 bp, Heterodera glycines
  misc_feature (1150)..(1150): n is a, c, g, or t
ttcatgtcttgttccacgtacacttgcttacgctttatgccctttcccatgattccatttgcgggattgtttataaattttttgagatggtcaaaaaagggcatacaaataagcatgaatatcatatgcatactttagatagattttataacaataaaaatatttattttaaataattaagtattgtaacttatattatatgtattttaattctaactcaaacaatcaaaaatgctttttaaaattagtaaattagtttcgaaattcaagtgtcggaatttccgctagtgtcggattttccagtgtcggattttccggtgtcggattttccagtgtcggattttcctagagccatttagattcatataaacatttatttagaattatatcaaaattgagattgttgccgttggcacgggtcattacattctaattttttttgatcatatctattaatataatagcaattttattttgcttataaaggaaggtccccatgtgtccgtgggatttccgaatgaaacttggtgggtggatagagcacccatgggttcttaagaaaaatgtttttattttctgccaaataagcacgagtgccgagttatgacgtgcctaacttttctagtgataaataaattaaataaatattcattcactcttgtgctgtcaagtggtgtagcggtagtacgctagtcagcaccttttaagccctagattcgggtaaataattatttaaaaaataatttgaatacttaaaaaatcgattaaatttaatagagacatgcgagacaaacgcaaaaaaggattctagaacatgagtgataaaaagaatattaaacattaaaacacaatttcagagaatgtaaaacaattcaaaatttagaggaaaagaaaagtcagaagttaaaaataaaatggataataaaaatttagtataatcaatacaaaatatcaaatttattaagcatgtataattaattagtaattttatttgaatttataaaagtcaaaaatgaagcaacagaacacggaaggcttaaaagaagagaatcaaaaaacaaatcatcaacataacaaaaaaaattgattaaaaaataaaagatataaatctaaaataaaatttctagaaagtgagaataaaccaaaatgntatgtggtgtggataaccaagt

SEQ ID NO: 35167 - DNA, 468 bp, Heterodera glycines
ataacctgggacctagaatcaggaaaatccaggcctggatcatagcacaacccgaactctagaaaaaaaaaaatgttttttagtccattttcaattttttgtctccaaggcaaagccaactgaggtattttgccaaattatgaaagaatcgaagggagctcattcggcctagattacgaatgaatcactgtgttcgggtgtcttttttttgtgggactcaaatataaggccgcaaatataggaatcggattctccgaccgtgaaaacctctaaaatgacttcactttgtgaaaaaaattgaaaaatttttttgagtagggtttggggtactatcggcactattacctttttaagtttttttaaaaatttcacgtaactcacgttgtagctaaaattaaacgtcagattcgtgatcagcaccaaaaattagcctagaaaaaattattagaaaaaaatttcagggggggg

SEQ ID NO: 35168 - DNA, 1022 bp, Heterodera glycines
  misc_feature (894)..(894): n is a, c, g, or t
  misc_feature (959)..(959): n is a, c, g, or t
tcgtctgagtcttgaggttccctctcctcctttttgtctcctgattcttgagttttcaaattttacagccgaatataagtctcgatcttctattagaaattatgattcatttaatttatatttcttgccagagttttggtataggttttgcctcgcttgattcatcacatttacccatgtttcttgggtttttaaatttgaaactgtctaaacaggagctccgggctcattgaagttatgatgattttttggaatctaagcaatgaaacagcactaattacccagcgttcttgatacagacaaaatctttgtgacaattatgggcagatgatttggtttgttaatgaattcagggcccataatcttagtttcgtgagcactcagaagtttcggggcccatttataaaaaaaaattcaattaaaacccaattaagaatccattgtttttctacttatcgaaaaacctccgctcggtgccggtggtggtccaccgccgccaccgcctgcgcaattaacgatgattggccctccaccgccgccgccgccgccgccaccaccgcaacaacatggcaccggagggggcgctgctggtggtggaccgccaccgcaacagcaacaggtgttaccgccaccgccgaagaaaaatgtgttggatggtgacgggaaaaggaggcaaaatgccaataaaaatgatggcaaaaatgccaaagatgaagcagctgcacgaacaaagcacgtcattggcagaaattagcttttatttgctaaaaatgtaacaaacaaataaaaacaaatcaaaaattcacaaagcccaaaaatataaaagctgcattaatatgggatctcgtcaaattattttgtcggccatttttaagaaaatgataataatttttntatagaataaaaactttttatttaaaagttggaaaattctggactataaatctaggttttggacncaataaatatattactttgattcattcaaataatcttatattcattaaaaaagtagcaagctt

SEQ ID NO: 35169 - DNA, 960 bp, Heterodera glycines
atcaaaatggggattgaatttacgagttttaattatcaaaaaattcttttggccatatgagtgaaacctgatttttatttcgcgaaatttaattaaaaaattctagcgtctatggtttttaaatttttaaattcaattcacttatatccaataaattccattattttgtccaaattatgatagaggctttgatggtttaaaattatcggtatggtttttaaaatttcgaaaatttgaaagttcgttgcttaaaaaattatgaatattgcagattttcgctctgatcatgactggttagatgacatgatcacctgcttgaaggtgaccggcataaacgagcccaacttttgctgtgccggcttggttccaccggtgtgtaccgtatccattgtttgcgtcgtcgtggttgtacggtaatgattattgctctctttgggatcagaatgataagctgctgaggttgttgcctaacaaaaaaaacatttaaatagtattttttaaattttaaaaaattgtagccaacgaaatctcttcgactttatccaataatttgtaaaatttcccgatcactagtgatcgggatcgagattatcattatatcaatcctactttttatattacacactgtacctttaacaaagattataaaaatttgacattcatcgaaacccaacaaatttgaagtttcgaaacgaaaatttaaatgcctattatatttgtgccggaaagcctttgccctaattaacggactcaaattggcaattagcacctcattttccccgttctgttggtgttgctgatcaatttgtaacagttgaatggacgactgactcgcgcccgccggcgactgttgcggctggaagttccagcgtcgctgcgcctcctcccggcgtcgcttccgacgctccatcgctttcaggtcaacgccgcgcacctgtcgcgtgccggacgccactatgt

SEQ ID NO: 35170 - DNA, 739 bp, Heterodera glycines
atggtgaggttgtggacactccacgccgaccccctgctccaccaccaccacctccaccgccagggagacgtcctccgcgtggaccccctcctccaccgacggggagacgccctccctctggaccaagtcctcctcatccctccccacccggaagtcctccgcctcgtcctgaacgtccccaaagaccaagtagagcttctcggagaggtggtcgtctggagaaatggaggaaaggtcgatacaatatacagcaacggcagccggtggtgtgggaccttcttgcagaagcagctgctgccccattgcccgaaagtgacgatgatgatgatgagtacatgttggagagtggattcgcactgccagcgccgtcacaatattatggcgatttgcctgtgctgcccgacaacgcgaacgaaattgaggagatggacactgctcagcacaggattgccaccagaagaaaattacaaaaggatgaggcaaatgataatgatgatgatgatgatttacgacgcaaaagatttttggtttatcaccgttcacctccacggctcccatccccgcctcgtttgaaaacaaaaattgaaccaagaccacctccacagcgtcctaccgcaaagagagaaaaacaacaggcaaagctggattggaagaaaacccaacaccctactccagcgcctcgggcgaaaagagagccagaacttaagctggacccgcggccatccacatccaggcaagc

SEQ ID NO: 35171 - DNA, 552 bp, Heterodera glycines
tctttttagaatcaaaaaataccgttagcaggcacccggactcgaacccattgcaacactgaatcagcgagaccaccaaaccatctaaatttggtccctattgggtgggtggttcgagtcctcgtgcctgcaaatgttttttttgacattaactaaaaacacagaaatttggggttcattccagcaggattcgaagttggtcttaaatgaacgactgttttcatgtcttcactttttttgaagacttttttgatttcccccaattttttgcagcgattccctttggctgttgaagagggctccgctcggcgtcgtcgctggtcaacaaatggacgaagcgggtcaggagatgaacacggcgcactgttggcaatggacagccgggcacagtgtgctccgagtgcaattcgaagaccgggacattgggtactaagcatttattttgggggggggggaatcaaagcatcgaattttggtgttcgttgctcccccatttctccactttttttaaattggacacaccaaaccaatgcatttaaaaatgcatcaaaa

SEQ ID NO: 35172 - DNA, 935 bp, Heterodera glycines
atagaaatgaatctaaattaaataaatatttttttttattttaaatatttattttgtgataactttttgtgcaaaatcgtcaaaggctgccacagtttcgaatgaagtattaaagctaaaaaatgcaaattaaaaatttacttaaaattaatttaatgaataaaaaaacagtcaaattacaaaaaaaaagagtaatattttaattataaataaattttttcaattaaataaaaataaaaatatgaaagaacttaccgctcctcagctttgatctgtagatgcaatgcaattgcattgatgttgcctgaatatatttttattttacattttcctaaaattattttaaaattttctaaatttatttttaattaatttatttacatgtgtgaaattttggctttgattccaagtcggtgtatgtctcaaccatgaggtcattgagtgctaaaaatggaaaaatttcgaaaattaaaaatatttccttaattgacacaattttaattttaaaaaaatgcaatttaaattttcaaaaaattccgtaaagtaaattttttaccgggattgcagcacggataaccggtgggattgtggaaacaggtggccaatggcagcggcatccgaggcgggtaataataacgatggacctaattagacacaattagttttaattatttgattaattttttacatcatttaacgttggcaaatatttgctgtttattgtttgataatgagtgccctgaaattaaaaagataaaacgaataaaaaaatattttcattaaattattttgtttttttttataaacattttacgctggtaaatttgtgtgtgttttttttcatttttgtgtgttgtaatgtgtttcttgtatttgtgaatttctaaaatgtgtattttggtttttgatgaatgtgttttcttagctatttgtgt

SEQ ID NO: 35173 - DNA, 730 bp, Heterodera glycines
attcattccatttttaaagtcccattttgctaaacatttctgactttactgtgcagattctcccaccatcagataaaagcattgtctaataaatcccaaaataattcacttaaattgtccattttttttatttgcatttaataataacaaataaaaatttgaatttcttaattgttttctaaaatattgatttgccattttaagcactttaaaagggatttcaaaaattaagatttaaattgagctaacattccgactcactttggccttctcctcgtagaaacaacaattttcaaattggtccgatcacaaattccaccgtcagatcaacccaaatctcgagaaaatccatgggtcccgaattcgagaagctcgacgccggctgcggcgcgcgtttcggtcacattcccgggggcaccaggtgccggaaatgttgggctggcaggagttctcatcggacgaatcggtggattgggacccgtacgacggcttacacgccgagaaacaggtggagagattaggggaaaatcgagaaaaactgagaaacatgggaaacgccagagtttaaaaaagtaagactaacaagggaaccacccgaactgtaagtcagaaatgcatatgtgttatatatttttttatatgttttggggccgtagaatccaaatatgatattcatttcggaccccgaacccgaattcgaacaattaattttattaataacatttacgag

SEQ ID NO: 35174 - DNA, 1033 bp, Heterodera glycines
  misc_feature (933)..(933): n is a, c, g, or t
  misc_feature (955)..(955): n is a, c, g, or t
  misc_feature (981)..(982): n is a, c, g, or t
caaatgttttcatgccagaaaacggtttcgtgaactgactgagcccgtcaaggcgttgttggctctgctcaaatacccgttcatcatgctccttctcctcctgctcactgtttttgtcccctctctccaaattgctctcattgtcaatgtttccctttagcttctcactgtgacgatggtattgctcaacactcttcagttgttttttggcttcaaagctcttcccgcctatgtgcaatatatggagcagtatcgccacactttgggcattttcggagcgttgggcgaaattgccattattttgtgagtttattttggccatccccttcactttctcttccccccccctattcaggtacattatgctgtcttcgcttgtcggcctttattctgtccctttgatccgtcgccttcagccacgtcgtgggcacacttcgatgactgccataatcactaattgtgtgatcattctcgtcctttcttccgctcttcccgtcctcgtcagaactttgggtgtgtattcactaccctccccaaattgtttcccttttttgggtatcacttcgtttgatctcctcggcaattacggccgaatccattggatctccaacttctctcttgtctgggggtacaaccttctcttcgccgccgcttccattttctgtttggccaacaaatttactcagcccgtccgtcgagaattgcttcgccggttttttctttgtttcttatttctcttctaatatattttaggttcactgctcttgctagtcgcaaatgtttttctacggaaaggagaaactcgccatgtccattgtctgatacgtactctctgtcagatcacgaagccgaatttaacccagaaaaggattaaacatattgatatgttcttttgccatgtttttgatttttgtccgtttctcctccccattntctctgaagctttagacaattntgtcagtgcaactttttatgagaatnnttagtaatatgtaaatgaaaaaacaataaaacataaaagtgttgagtaaac

SEQ ID NO: 35175 - DNA, 492 bp, Heterodera glycines
caacaatttcctcttaaaaggaaaaagccgtcgccagccaatgccaacttggaaagaatgtcggcacttttttcgaaataaaaagcatatttaagcaataaaataagccaaccacaccaaccaatcagcatcattaattaattccatcaaatcagccaaaatcctccaaaaatgccttctccgtccgtctctcttctcagcatcgtcgcaattttctgtttgctgtgcaaatgttgcgtttcggcaccgcgtaattaattgcttttaattagctgtaattataaggaattgcttttctgcagatccgtgctgtcccggcagccaaaaagtggcttcgttgttggttaattacgttggtattttccgccatttctcttccaagtcatcgctttgttcggatgtcgacagtgttgcggggggattgaaaggccgtctgatcggcggcacgaacgggggacacgccactcccttggccgacatcgaatcacctct

SEQ ID NO: 35176 - DNA, 1512 bp, Heterodera glycines
aaaaatatttaaataaaagtcgcaacctttggtttgcaaacacaaaaaaagagaagtgttgttcttattaattagagcatggcgaatccaggaaaaaaatatgtatttacatataaatcgcagccttaattattgtatagatattattgatatatttgtcattacatgcacatatgtagggtggtttcgtttacaataatctaatttgtgtttatattttttgcgttcagtgcctaactacaattactttccttcagctattttttaaaatttagccatcatttcatggcgcataatatattataacagaataaccacaaaaaaaattgagcatgaaggtcatctttatgttttcgccaaacctagcgcggatggttttatcaaatttttgaggtgtgataacaaaagcaataaggacgtgcagccccgcgggcgtctgcgcgtcaaatcgaatgacgaagtcttctatccagtcgatgagcatgtctgcggagcaaacccgccgcgagcggcagcacaccgcgtcgtgacaggttagcttatatcaaatgccgaagatcttgaatgcatatttggccccccccccccacttatccactccctcgtcagtcaccgcttcatcccccctccccccctatgccctggcatgtgtcccccgccccctccgtttccactgacttcttctgacgcaatgaaatcaattagttccattttgtcctcatcactttgaactgctcgaattgcgtccgcaatggctgcctttgccaggaaatcgtgctcattgcctcgcaacgcggagataatgtccaattggtagcttatgagaaaatgtattatgatgagagaatgtttgattttacgaattggcaaattccggaaggcttaaaatgccctgagggggtgaggggtttgacggagtgcaaagctgagaaatgttgtccggagaagtgatcggacctaaagaatcagactcagctgaaattatagttaatgaaaagcaattgctgacttgaagactcagtttttggttccgaaagcattaaattatttaatgaactgattaattattgttaattattatttggttacgctcactaaatacttaaattccttatctttcaactaatggacgctaatcagccaaataacatattttacttttaaatggaatatatggatagggcaggggggcggggtgcccaaggacataatattgccaatatcttaacttatttatccaatatccaacaatagcagtctttatttggtgtccaatggtcatggaacaaagggcgacccccaccgattcggtctcggggacagagacttacgatggacgggaaacccctgctgctggagggagagaagaagaagcagaagaacacttacaaagaaagagtctcgatcagttagtatagcaaataaaatattcaatgacataaaaatgaaaaaataataattttattcataagaaggcatcatttaagacaatttactataatagctttaaat

SEQ ID NO: 35177 - DNA, 1203 bp, Heterodera glycines
  misc_feature (433)..(433): n is a, c, g, or t
taattaattaattgacaccacccatcccctacggctgacaattagtgccctcttgaccgctgaccaattagtaccccggtcagtgactaattgacacccctccccgccagctgtcactttttaaatcaatcaaattttatgtcaaaaaaaaaagtacatgaaaattttacacacccctctcataggtctaggtttccctaattaattgacaccacccatcccctacggctgaccaattagtgcccgttgaccgctgaccaattagtactccggtcagtcaattagtgactaattgacacccctccccgccacctgtcacttctaattagtgtcagctggcgacggaatggcagggtttactactaatatgtgctgaagcagcaaaaaatggtccataaagttcttggggcaagtgtttttataattaacaatntaattagcaccaattagcaattacacattttaattgatcgtaattgacccaggaattgagcaattgcaacgaccaaagaatgttaatagcctgtgatgctgctgctgctgatgattgattgatggataaaataattcatacatataataaaatttgaaaaaatatagtaatttttcatatttcgtcgatccccatatgaaaatgaaaggcaattctatttccataattctctttctctactccactgtcacttcttatgaagggtagagatgcatacttttgtgcggctttccctcctctttctttctctgcttgcatacagaaagtggacaccgcaaaaaaaaacttgcatctctacccttcataagaagagacagcagtggaggtagagaaagaaaatcatgaaaatagtatgtgtgtggaaacgaaattctctgcccccaatgtgctaatccactcatttccatatcgacatttccaattgcagtttccatatcgaccgtttccatagcaacgaatttgtgtcctttccaaacaccaaaaattttcaaaattttttggcaaaaatagggattttcaacggttttgtaagctaacataggatttacaatgaatgttaagataagagaaaaaatggaaataattatgacaaaaaggaaccgtgcaaagctgcaacacaacggccattcatacatttttcacacgctgagtgcgagcggtgaaattcgcaatgggtcatgtgaacagcatcatgcgcgagacgtccattg

SEQ ID NO: 35178 - DNA, 707 bp, Heterodera glycines
  misc_feature (69)..(69): n is a, c, g, or t
ttaataagaattgatttaataatctcttaacaatccaaagcattacttatttttgtaatttaattcacncaaaagcttgcatttattgttttaaattttaaattatttctactctttttatccatcatttatactaccaataaaatcgtttaaactgaattcattaaatttgggttttttgttctggtccccggaccaattttgggcgttgtacttgcaaaaaaaaaagtagaattttctgtaaaatcatttgcctgattgcttaaatagttgtagagaataatataatcaatcgatggtgccgaaaatggatgagtcattttgagaaaatggcaatgagcgaaatgggccacggaacagcactctctgctgctgatcagttggagcgatcactcaccgttttactctccccaaaaaacgcatcagtcaacggaatattcattcattttaattatcattaccattaccattttcgttttattttattttgtcaaaagaatgtccgtccgccgttatttctgcttcgttttgctgttgtttttccagcaaaatgtaaaaaatttaatgcttttttcacccgccggagatcgcattgaaatttttcaaaatgacatcattaaagaaaataaagaataattaaaaaggatgccaagcatcaaaaaggctttgaaatttattcctttattcaaaatattttataattaatt

SEQ ID NO: 35179 - DNA, 919 bp, Heterodera glycines
  misc_feature (844)..(844): n is a, c, g, or t
  misc_feature (893)..(894): n is a, c, g, or t
atttgattggcttatatctctcaactagagatagggtaagggattcaaacggtttttcagtttttttaaaattcttttaattcttttttcgttacaacaccaaaaaaaaagatcgaataaacaaaaagataaaaaaatgtattaatttaccgttacgcgtttatcgactggtaaaaacatacggtagtttacacttgaaaactacagcatacgatttaaaaaactaaaattttcaaaatgcaaattttttattttcccccattttccattacataaatttaattttaacaaatattcataaaaaaatttaaaaatttcaaaatttcttggcattcataagtttatttttgttgcttcattagtactactgaacatataagtggataacacaaatgccattaaaacaacggcacagatgtaattagtggacaaattcatgccacttttgtcatcaagaaaatccatgccacttttgttaatcgcggaattatttttgttttcttgccctccggcgctgctctgttgcactaattaatgcctctattcatccatccttcgggcgccaggtgaatgcgcaatttgttggctcccactgtttccaatacaattttgtcatccgtccgtcttcaatttttctcgacaaaatcctccccccctccggcgtgaccaattttgagtaaatttgtcacacattttctgtgggtgggttggtcaccataactcaactccgcacaaataatatgcatataattggcttgtcgccgcgaggcacacgccgtcgccgtccgtcgtcgccatcgttgttcagcagcaattcaacaaatgacgccaaattgcccggaanatgtctggccattcatcatcgtcccgcccgcccgccgaggagggcattnntgggggtgggtgtcaccggcgacgg

SEQ ID NO: 35180 - DNA, 1056 bp, Heterodera glycines
cggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcgtcggttcggggggactgccccgaaaacaaaaaaatcgattttttcaagtgtctgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaatttattcatctccctttttgatagaaaaagcatcagagtgcctaaactagcatgtaaataaaatttggtgcgtttcagagcattttctgaaaaaaatatttatgaattaattatgcaaaaaacaaataaaaacgaaagactcagattttcgaaaatttttttgagccagctagctcggcgctcatttcagtgtaagttagtcctttaccggggagtatccctgcaaaggttggtacgcttctgctcaattagcaaaaatatgagtgatcgaattttcctaaaaaagtaagcctacattttttggaatatttaaaagcaattaaaaatttt

SEQ ID NO: 35181 - DNA, 636 bp, Heterodera glycines
taaattctctcaaatgttcaatggttgtgttggaagcttttgggacaggcactctaacaactctaagcttttcattttctaggccatcagtaaaatggatgttaatccactgatcatccaaggttccaattgtggagggccaagaataagcataatttatgctgtgtagcccacaaacccacgagccattaaaatagacaggcttaggaagacgaacccgaaatttatttggggcattatcggcatagtctgggctattactgggcaaatggacaaaaaaagtgttagacatttatacaaattaaaatgtgatgccaatgctgatttacaagtatttatacaagttgagtctcatgaatccattctctctctgggtatcctacaaatttcacgagcacttccattgttccgtcgggcattttccgtttccgaaaaacgcgttcaattctgtaagttgtttcagcatctctacgtacgggggccaattcttccggatagaaaaatccattgaacttctctccttttgcatcgcgtaacttgtattgcattggtttcttgtggcgtttgacttcatcaatttcaagaatttcatcgcatataatgaggtatatatcctttctcgaatttccttttgct

SEQ ID NO: 35182 - DNA, 817 bp, Heterodera glycines
  misc_feature (18)..(18): n is a, c, g, or t
taaaaggggacaagattntggagggatttcacattcaacattttgcctgaaagatctgacaaaagatagtttaagaatcaattggatttggaaattataatttctaaattagaaataatttgatcagaaaatttttatgttatgaaaacatgtctccggatgtgttctgtttcgctaatcacgaaatatatgttagggctccaatttttaagtgctaaaaaacaaataaatagatttttgagaagatttttgtagaaaaattttccttttcttaggggtattatttttcatttttatgcattttgttataattttgggcaaaacgccaaaagggttaaaataagttttttcaaaattttagattctaaaaataaaaacctagaagataggtgctaataactagagcccggaattttgaaattgccgggaccggggccgggacatggaaaatggaccggggcgggatcccggtaccgggagtcccgtttttccgggactcccggtcccaatttttgggccggggccccgccgggaccgggattttttcaaaatttttgaaattttgattaaaaattcgaaaaaatcttataattttacattttagcttagaattatatcaagccatgtaaattgaccttttttgcttttcaaaaccctttttacaacgcattttttcaatgagacttggcgtacagatgggtccaccgccggagaaaattttaaaaatttgtgtataatttgttaacagatttacaccaaaaaatgacaaagttttgcgattttgacccaattttttaagagaataaagagttttatg

SEQ ID NO: 35183 - DNA, 1324 bp, Heterodera glycines
ttattacgtgttcagtccatttaatttaatttggaattaaaattaatttttattcttatgttatactattttttccacatttctaagtctaactatgcaaaataaatatctatgtgtgcttataggtttaaatggaaaaaaacaattaactatttatatattttgcaataaatgttatactatataattttgtttgtatatgtaatattgtttttgtattgaaattaatactattttttcatgattaatcccatcacgtcatcgcatctcccagcagaatcacacaaactcttttttacatctcaggaaatgcgatggaatagcgaagaaatggccataaaattagccattatagactcaaaagatgtcttcaattttgttattataataaaaaaatgttattttttaaatgtttttatttaaatattgcatattcttttaaaataattattgtctatttaatttattctttatgtgcaatttttttttgaattagtttattattcatagttatgtaattaattttatcacttttacatttttgtctaaatttaatgcaccgctaaaaatgcacaaaaaattattgtcgcgtttattttattacatgaaaattccattcaaacattcatatgtacggaaaaatcaaaaactggtttaaatcaggaaaaattcatcaaaaattagccaaagcatttgtaataacactttttaaacaaaattaaatattattgaaaaaataataaaacaaaaaatagtaaaaattttatttaaaaataaatgatgaaaatcaaaatcagtattaagttataaataatattaaaaatagatattaataaagattttctttgatattttctttagaatattattactttctaaaaataaaagccaaaagaaagttacatatattatcagggctcgcaagttttttttcaaaaaaaaacaaatgaggctaaaacaaagattttgaccccaaaataaagattttttgaaaaaatgtatttttaccatgtaaaaacagttaaaaaacattattggcttttataaaagcaaaatacaacaaatttgcacaattacaacggttttattattgaaaataatatttttttcaaaaaagtgtcattcaatatatttttcccatccaccgatctgatccaacagtttgtgattggaaatgagcatctgatacatttctgggcaagtgagatcaaaatttattttcgtctggaccagagccttcatggtttcgactttcaacgaatttcgatcatcagtccattgtgagccgcaaagggaaaaaactctctcgacaaatgcatttgat

SEQ ID NO: 35184 - DNA, 1297 bp, Heterodera glycines
gaccactttcaaaacaatagtttttcggagctttatcgacttggtattttttttgggaaaattttggattttttcccggaaatagaaaaaatttttgccctcagcgggacatttgagtcccgggcccataactcgtcagggattggttttagccaaaaatcgtcttagaacatttttgtagagaattttaagctctatcgaacggtttgctatatgcccggaaaatttcaaaaattttcgagctaggccccctagaaattttcgaaaattttttttgggttgaaaatgggggtcaaaaatatttttctggggtattttgatgtgctgagcactaatatgatgtctattttaagtttcatgatttttggaattttttaaaaattctttatttttttgcaattttttggccctcgggattttggccaaatatttgaaaattcataactcggtgatggtttcatcgatttaactataataaagctttaaaaatagagaaaaataaggagaattttatgggatttatttgagttttttatcacaaaaaagaaaaaagttattccagaatttctggaaaaattcgaattttcagaaaaaaattcataactcggttctgaaaagatattctggaaaagtaaattactacaaaaaaccgcaatatttttctctacaatataaattttatttggcaattttatctcttttttgagagatgttacaaaaataaaagtgattttgtgattccggactaaagggtggtgacgcaggatttttgagtggaaaatttttttcaccaaaaatcttccaaaaacatgtctttaggggttatttgggccgctgatcacgaatacgtgatcagattttacttttgacatagtcaagacctcagaatccctgtgtgattggggattctgaggcatcattttgaggggggagggggcaggttcggatccggacggtgtaacattatttttctatttatttttgagttatttttcaatgcttttaattaatttgaagattggttgtaaattttaaatttttttttaataaataatttcattattattttttatctgtaaaaaataatattatttcaaatttcttaaatattcaatgcattcgatttttattctttaataaaaaacttttccttatttatataattttaaaccatgttgaacctcttcttatcacttttgtacctcttcttgtcactgttgtacctcttctattgtaactcatttaatcactgttgtacctctttgtttttaattaattccaaatagtgatttataaa

SEQ ID NO: 35185 - DNA, 871 bp, Heterodera glycines
  misc_feature (843)..(843): n is a, c, g, or t
tttaaaaatattaaatgggcaattaaaaattatatatttaattaaaactcattgtacattatctatttatttttattttttgcacagagtgataagactaatacacatccgttaaatttataggatggaattaaggaaattccaccctccttttagggtcgggtgatttcgacgcagttatctcgacctgagaaatttaaaaaaattcacaaccccttagggtaatgaaaaaatgaaaatttcggaattaatgtaccgcacaatgacggagaacaaaggatgatgatgaaatgtgatggtcgggaataaatagggggcgagaatggataatcgtgttgttttgccatgcccattatattgatcgattcaatgcgggctgctaatttcgattggtccacccgccgacgtcagctgtggtggcccgtggccgcagcccatccccaaaatgacacacaaagcacatttatgtattctcctccctcccttccgtgaccataaatccaaagagccatggaatttaaattttttaaatccgtattagaaaattgaattctgggtttataggattacgtagagactggcaatttcaaatttatggatcccgctgcgggattggaattaagatcggccatcataattggatgaaccaataaaatttaatgatttttatgttgctttattacacactttttgatgttttgctcttcggatctagagttgtcgactatttgattagattttggcatgatttttgatgatttgctcaagacacaagtgtttgtgcgaactttcagttgggtagtagagaaattgaaaagcgaaaaaagcaaacaaaatttttanaaaaattaaaattcgataaatgaatgaa

SEQ ID NO: 35186 - DNA, 864 bp, Heterodera glycines
acattcacggtgcgaaaaatggggtttgccatctaagattggggaaaaaaagactttacaaaataataccccctttgagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgataagtttattggggaaaaaaagactacaaaataatacccctgggagaagggagtgggaaacatgatttcaaaattttcaattttttctagtctaatctactcaaaccggttcagaattcaataaaaataacattcacggtgcgaaaaatggggtttgacaagtttattgtggaaaaaaagactacaaaataatacccctgggagaagggagtgggaaacattatttcaaaattttcaattttttctagtctaatctactcaaaacggttcagaaatcaataaaaataacattcacggtgcgaaaaatggggtttgaaaagtttattgaggaaaaaagactttacaaaataata

SEQ ID NO: 35187 - DNA, 1039 bp, Heterodera glycines
cgaaaaatctcgaaatagttaactaaagtagtgagtaaaagggtaaaatagtgaccaaatagtggcaaaaagaccgaaatagtgacaaatagtgacctaattttcagccaaaaattaagcaaaaataatttttattcactggttgcagttgcaaatgagctacatttcctttataaaattctcttagcaaatattgacattttttaaatcaaaaattttgtcaagaaaaaaaattttgggggagaatttttgaaaaatttttccaattcttagtggtgtatttaaaaaaaaaaatttttggtcgattcttaggggtttatttttttgaaatttttttagatcgattcttaggggtgtattttttgattttattgcatttttgctaataaaatctttgaaaaatgtcgaaatagttaaaaaatagtgaaaaaacgccaaaatagtgaattttcactattttagtgacgaagcgtgaaaatagtgattctagtgatcgatagtgagatccaaatcgaaaaatttcaacgcagaaatgcgttttttgagctcctttcttcaaaacaatcgagcaaaaaaaatagttaaatcactaaaagttgcatccctagttaggtatttgtgttttcggttttttcctttctttctttatttattatttttacttgattgccgacccgtctatttattgtaatcaataattttgagtttcttcgactccagtaaaaatggaatagattggacaatctgatagcgaataaaaactttaaaaataacgtttttaaagcgattgcactagaatttcaaatttttttgttattatacataggcgatttggtccatttggctttagaattcaaaaatattttaattaatttatttttttattcataaatacttttttcgggagtgtatttgttggtgtggtaaactatttggcgcttcatttttcctcaattctttgctgaaaattatgtcgctatttggacttttggtcattatttgtcactattttggaattttttaggccctaaatatatcc

SEQ ID NO: 35188 - DNA, 318 bp, Heterodera glycines
  misc_feature (16)..(16): n is a, c, g, or t
actgtaaatgctttancacttttggaaatgatacgatttttactgacccgtcacacttttcggcaatggcacgatttcagtcgacccggctcttctctcgcactttgtccttgaaataaataataatgtcaacctaaataagtttaaaaaattaaattggacattcgagaaaaagcgcttggccatagagagagagggaaagttggtgcggtgcgggggggggggcaatggcaggaattgcagatggtgggaatgcaaagcgtccgatttaaataaaggtggctgggccgggcaattagcattttgacggtacccccc

SEQ ID NO: 35189 - DNA, 882 bp, Heterodera glycines
ttttagattcaattttgaaaaatttatgtccatattttgacatttttgccatttatgtccatattttgacatttttgccatttatgtccatatttcgcgatttttgccattttatgtccatattttgcgatttttggtccatattttatggccatatttcgcgattttatatccatatttttaccagccctaataattaaattagcaattattaaaatcagtttttaaaagaaaaaaaaacagagaaaaatgtttgcaaggcttttagataaaataaataaataacctataaattaattattttttaaggatgcgattaaaaacccagacaattatgtgctgaaaccgagcgaagaaggcggtggaaacaatttttggggcaaaaaaatcacggaaaaactgcaaacctttacaaagcaacaactttcggcatatattttaatgcaacgattgaagccgcttaaaatcaaggtcaacacattgcaattattgcttatacaaattgcaaaaatattaaataaaattaaaaaagccaccgaacaaagacaaaaatgataaaatcgatttatcgattatgcgaatatattgtcattattattttgtatttttcttaaattattttttttatttcagaattatttggtccgtccgcataagcggccggttaagctggtggaagcagtgagtgagctgagcacatttggctaccttattgcagatggtgatactgtatataaaaatgtctccgatgggcatatggtaaacgacggaggaatatttaaaaaagttcaatattgaaactagagttgagcgggaccggggcgggaaataccggttttttcaggtcccgatcccggtcccggtttttggaaaacagaaatc

SEQ ID NO: 35190 - DNA, 1782 bp, Heterodera glycines
  misc_feature (1766)..(1766): n is a, c, g, or t
cttgtgtgtctacggataagggccgaaacacacggaacaattattttattaagttttaataaaaaagaggacaccgtactgaagaggcccagtctctttttattaatttttgcacttttcgcgaaacgtcccatttttgcacttttcgcgaaacgcccatttttgcacttttcgcgaaacgcccattttgcacttttcgcgaaacgcccatttttgcacttttcgcgaaacgtcccatttttgcacttttcgcgaagtgacctagcaccgttttcgcgccagcccgagtttctggttcttactttttcattgtcgatcaaatctaacaaacttggtaacagtcgaatgctttacatgtttagaagctattcctaaacaattgattggcgaaaagacaattcctaaaaaaaatataagtgaaaattggaaaaagtcagaatttaaaacttttttcttaattactttttcaaattaaaaatcctactcagtctcaacataatacatattgcaaaaaacggacttaatttttcccaaatttaagacaacaaattcatgaaatagttaaaattatcgaaaaccactaatctgtcattaaatcttctctccatttgtttaaccttatttaatgaaatggctaaatatggcaaattttaaatattaattctgctttgatagatgactttcgtttaactaggcttttttttaaatttcgcccttttcattgcgcgatgcatcgcatcaaaatgcataatttagtaaatgccattgaaaaggttcagccaaagcaaaaaaaacggaaaaagagctgaaaaagcaaaaatcgaaggctaacaaacgcaatgggaaggagaaagagtgacaaaacgaatgaaaagagatggacagattggcacttctgctgggagaggggacggaaaatcatatggactttttattttttggtgtgttatttccaaagggttccaagatgaattttgcataatatctttggcttaaaagccacattcagagtcgaaaagcctcgtttaaaaaaagttttccaagtcttaaaaatcaagcgggtttgatagaagaagcggtgcaataaaagctgctcttggaatttttaattcaattgttgaaaaaattatcatttttgaaaatttagcactattggcctctcaaaaccaaaaaaagatggtaaaacttctcactctggtaaccctgggttttatttttcaaattctcaagcgaagaattggtattttctgtttgttgttgatattattccaccgtccccctttcacctctttttaccgtctttttcggttctatgtatcattcattctaaatttaatttgtctgtcttctgtcataaaattattttggcatttaatctaccaaaatctcaaatgactaaagatactttcgtgttttaaggataagaaaggcttattgcggactcccgccttagtgcgtcaaaattaagttggtatagctgattgagtactaaaaatgtttgaagaaccttgggaagggggaaaatcatagaaaaaaattgatcaagcgcaagtggggatatggtctagtggttaagtttacattcttttataagtttacaccttagtccaatcccctgactggaatattagatttattttacaattttaatttaggtaattaaattttgttgctagtaggtttttgtaacttgaattatagtaatatttttcctgagttttttttagactttacataaaatccacaactttgcctttttgacgcanaaatcgttaagaattt

SEQ ID NO: 35191 - DNA, 135 bp, Heterodera glycines
cgtgcgcaaggtggcgcagtacttctacccgcagacgcagaccaaggtcatgaacgagggctgggccacgttctggcactacaccatcctgaaccgcctgcatgaaaaggggctggtcaacgacggcttcatgat

SEQ ID NO: 35192 - DNA, 1252 bp, Heterodera glycines
cggtctccccataaatctgggcccctcgggttcggggggaccttcctcgaaaacaaaaaaattgagtttttctagtttcctttgggggtcctcaaacattttggggagcaaacatccacgcagatttaagtccaggctataggggaagctattctggaagattcggtctccccataaatctggccgcatcggctcgggggggacttcctcgaaaacaaacaaatcatattttacaagtttccgtttggggtactcaaacaattaggcccccccccccccccccgcccttcagagcacgacaaatatttcaacaaaaatttttaaaaattgactagagcaattgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccggaaggattcggcctccccataaatctgggcgcatcggctcgggggggactgcccccgaaaacaaaaaatcgatttttttcagggtccgtttggggtactccaacaatta

SEQ ID NO: 35193 - DNA, 963 bp, Heterodera glycines
aattcctattatgttgtaattaggttatgcgttattattattcgtaatattaattgggtttattccgaccgaataattattactcatcaaactctctttttcatttttatcaattttatcacaatatttacagataaaaataattattattatttaaaaatgcatgcatttatcatttcctctcattttccccttttaatgggactgatcgaaattgtgattccgcagcaaatcgtcggcaatgatttggctaattgcctccaccatttttgctttgctttgccactttttgtccgtcgtctcggcacttccaacgaatgagttttgccgaaaagtgcattttctgtcctttttggcgttgctgaatgaatggcatattcggcggagaagaaaattgtcattcgacacgcgcaaataaatgggaaaaataatatgcctgggaaaattgaagaaataaaaatgggattaattaaagcagcatccaaatgaaattttattaattaatgcattcgaatgcatttcatttattattatttatatatattttatggaagtctttctcataaattgctgaccaattcattatcggtgattactaataattcattccaacaccaaggaaatatcaaaatgagcgcgaaaaatgcgagaaataacaaaaatataaaacaattagtaagaaaaacgaaaaaagcaaagagcactttgatattaatttaaaaaggcatttaaaataaataaaaaaattaaaagaaggtggaattattttattgggattccaattttcaaaaattgcccaattcttagaaaggcattcacattttaatacaccgaggcgaaaattcattgaaagttggaaacggtaaaagaatgaattagttaattatccttacgagcctccgattcaatggccaaccgtaacagctgcttctgtgctgcaatgccagagattgccatttttta

SEQ ID NO: 35194 - DNA, 773 bp, Heterodera glycines
gagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctcctcataattgtttgagtacccccaacgacacttgaaaaatcgattttt

SEQ ID NO: 35195 - DNA, 1555 bp, Heterodera glycines
  misc_feature (1547)..(1547): n is a, c, g, or t
atatgccgccgtgcgccattaatgaggagcagtgcggtccacagctccatggaacaacaccaattaatcatcattaacaaaaataagcatcataatgattataattgctaccggaagttcatgcgaagcacgagcgcatgccgccacgaccacacgctgttcgacgacgacacgcactgctgcatgcactactgattgcatgccgttgcacgtcgtcactgtgacgacatttgtgatgcttgttgcccttttgatttgcacgccctgcgacagcacgagtggaaggaagacgcgcgcagcgactgcggcaggcgacgaactgtgcgatgcgcgaggactcccgatgttgatgcgtaagttctgtgtgtacagcatgcagtgttgcataccatgccgtcgcccagtgggagccgaacccttgggcgcaaaaggcgctgcaaaactttatttattttgctgcgatttagactgttttctaaattatttttaatttaaaaatttaatgcttggcaccggatactatcttaaaaatttgagtttagtttggaaattttgtaggatgaaaactcaaaaaattgaaaatattaatttatcattttaaaatactctttttttggataattctttattctggaaagtctcaaatttttaaataaaaaataaaattaaaaattgttccaactgattatgattatgaggattaattgacttttaatagaaagtaattataatttatgatttttttttggattaaccaacatttaattgtttgcttgtaccgtattttgctctaattatcccccagtctctattaatcccgcagtctccaattatcccccagtatacgaggtgttttgaaaaataatccctctatcataatcccccagtctctaattatccccccttttctgaggagattgaaaaataatcacccatgggctataattagagcatatacggtaattgttatacaaaatgattacagcgcccaatcagacggtgctgcagtgcacgcatgacatggactgcttgccaccagcgtcatgcaacaagcgctcgcgcgtttgttgcgtgcaaccattggatcaggccccaccgcctgttggctgccccaagggtatgttgcctaattagctaattccaataagtggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcagaaaatgctctgaaacgcaccaaattttatttacatgctagtttaggcactctgatgctttttctatcaaanaagggaga

SEQ ID NO: 35196 - DNA, 749 bp, Heterodera glycines
taggatggcattgtgaaagatggactgaccgatgcttacgattcggtgcatatgggcaattgtgcggagaaaacggcgaaggaatgccaaataggacgggaggagcaggacaattacgccattcaaagttacaaaagggctgctcaagcatggcaggcgagaaaagaccgtgactcatttagaaacagcaatttcttatattgatagaatgggcaaattggacccgaaattgtaccagtggagataaaaacgcgcaaagggactttcaaaatggagcgggacgaggagtacagcaaagtggactttgacaaactgaaggcattgcgcacagtcttccagaaaggcgagggaaaaaaacaaaacacataagtaatcgttaaaatgtttttttttcttccacggcccctgacgcttaattccgatgcataagaagtgataaataaaaaataatccccggccacttctgaatttttaagaggaactgactaaaatttttctttaactttagagaatggcacagtgactgcgggaaatgcctccacgttaaacgatggcgcagccgccgtcttaatggccagcgaggaaaaagcggacgcacttggggtgaagccaatggccaaagtaatcgcctacggagacgcagccacacacccaatggactttccaatcgccccggcgcttgtcatccccaaggcactgtaatagcaaatcgttctcggtcgtttcataaaatccgctagcgatttttt

SEQ ID NO: 35197 - DNA, 871 bp, Heterodera glycines
  misc_feature (277)..(277): n is a, c, g, or t
attgtcattcctttcaaattgtcatctcctcacctaatcgatgtcaaagagaatagcaaatttttctcctccttctgacaacactgccccaaaaaattttttatccgaccttgaccaactacaaatccccaaagaaattgactccgacaactccattcccgactacgccaagttgcttattaagcagcttcactccctcttaagcaccgcctccgtcctaattcattcacaggctgcggcagtcaacgcggtcgaagaggaacgacgactgagaacncgtcgttgttacaaatgtgcccgaaagcaaatcggacaaagcgacggagagagcccgggaggaccgtgccgttgtggacgaaattttgaatgccacggacgttgatcaggcaccaattgtcttccgtgtcggcaaacgaatggatggtcgaccgcgcccgctcaaaatggaattcccgagcaaacacgcagcgcggcacgtcatccgcatgcgcggaaaggtgcaagcgttgaatggtctacacactgtacgcatccgtgaaagcatgaccaaggaccaactgtcggagaggcggaaactgatcgaagaatgcgggaagaaaaggcaggcggacaacggtgattgggtgatttatgccaatcaggtcgtgctgagacaggacattgaccatattcgaaaaaatttttaaattgtccaaccaaatcacttcaaattacccataattattacacaaaggtacaaaaatttttccggtcagtaaaaaatttttaccaaaaaattaatcatccaaattttttaataaaaaataaagggaatgttaaatgctgtctagtaaacataaggtcaataatgaataaaatcgatgaaatagca

SEQ ID NO: 35198 - DNA, 715 bp, Heterodera glycines
ttttgataatataagagtcagagtgccttattcaacttgtaaataaattttggatcgcgttcagagcagtttctgaaaaaaaatttatgaattaattttgcaaaaatcaataaataatgaaccctcctccttaataattttcctgcgcccatggtactcactcggccgcttcgcggcctcgaggggggccttcggccaccccccccccgacctttaaaattttgataaaccagaatatgaccagataatgctagatatattgtaaaataaaaattaatggtgttgataatattatcgtcttagaagcggataattaaaagtacatagcgcaaatatgctagaactactggtataatttaatatttaacaaattaatattttgtatttggattcccggacataccgggatcaggtaccgtgcattttattttttttaaaccgagcccgggctaccctattccaagtgaaatttcacatcagataattttgtagtacaaaatttaatgtaaatgttggtattctataaaacaatatgctttaaaggaaaaatgttgagttgtctttctcctacatttgtaattaatcacaaaattttttaaaaggcatagagtagacattttggtgaatatatgttgaatttaatgattaatttttgaaaaagtcagcagcgtatgcctgatgttcccggcagaaattgctggtcacggcaattatg

SEQ ID NO: 35199 - DNA, 756 bp, Heterodera glycines
ttccctatagcctgtactttaattctgcgttggatttctgttccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttggttttcggggaagcccccccaacccgagggccccaaattatggggagaccggatcccttcggaattacttcccctttacccggaacttaaatccggcgtggaattttggttccccttaatggttggagaaccccaacgggaccctggaaaaatccaattttttggttt

SEQ ID NO: 35200 - DNA, 978 bp, Heterodera glycines
gaattattttttaaataaaaaattctctcgaaaattctagtaaaagtgccagaagataattgtgccactttttcacaaagtgccaaaagataattgtgccactttttccatggtgttctactcacattgtgccaccgccgaagagggcaatttggcgggatcatgcgatatgctcggcaccatatcgagaatgccgaagatgtcggcgacgaacttttgcacggaccaaaagagttggcagaagtcgacgatacggagtgtgggattgcattctgtcgggtaatatccgtccgataatgatcagtcatcgtttaaaaaaaaattattgcgtccaaatattttcgttagtgccgtttaattggtaaaatagtgcgttggagatgaacattgcgattatgtaccgcaacgaccgcgagcagttcaacaagaatgcccgttaatgggcccagaagcacgcctgttactgttttccatttcttttatctttccgattcccatttttgttggttttttctcttatcatttttctcacaatttgcaatttttttttccaaaatttcaaccctttattgggtgcaactcgtccccttcccccctccgaaaaatttcgtaaaaaattataatagaaaaaaaaaatttttttttttgacacgaaaatctcaagaaaaaaattttcactgatttttggaaaaatttacgtatgtgtgcaccctattcttctcttttcagtaccttgactgctttatctttttgatttgctaaaaaattgatttatgtatttcagttattactgaaattcgatttaaagaaaccaaagttaacaacgtagtaggctttttgttcaaattcttaggttaaatggatacgggattcgttataggcattctgaaaatcctttgtcgtttactaatgtcgttcctaatacgtccatgaccaacagtaaccttttttacaaatttagattgctttcctatggcg

SEQ ID NO: 35201 - DNA, 1381 bp, Heterodera glycines
  misc_feature (17)..(18): n is a, c, g, or t
  misc_feature (83)..(83): n is a, c, g, or t
  misc_feature (191)..(191): n is a, c, g, or t
taatataattaatttannccaattaaatttcacgtgacgatgcggaataataatttaacgtgggaatcatgaaattagcaaanatactgtgttaattttcattgaaaagattgaattttatattagctgattttcaaaatcaaataatcctgctgaactcctgaaattattatttaatatatgtaattttntaattagtttatgctcaatggaatataaaatttttgcatgatgacattttatttttatgcttgcaaaaaataatttaattataatttttgtttgatttattaaaacattcttgtaacatattataattaattttaataggtccattcatttatttgaagctaaattattctatttcctaatagatggcgaatttataatttcttgattaaaattgatatttaatttgtattgaatattgatctttagtttctttatataagttttattgttcaaaatcatatatcaaaatataaataatttaataaaaaatattttttatattaaatgatttatatttaaaaagaggttctatcattttatgcattacactaattcataaaattaattttatgtgtaaacaatatatattattcttatctaataggcacaataaatatggctccttttatatatactttgattaataattattgtttttactttcatgccattttaagggaacccattcacataactcttcaaaaaatataaaaaatattttgaattttgaacatattattttttttttaatattgtttacataagaactgtttataataaattataaattatcaaaataaagaaaaaaaacataatttttcgacatcataaattattagacaaataatttattttaaatttttttaatgtttacgatatttattcttaaattcaatataaatcaacaaaaaatccagaaaacaatttcaaataattaatgcaattatcttttataacatcaactttagataattaaaccttattttatttttcattttaaatattttttagtgtatttaaaaattcgaacttccattatcttcacatttttcaatttaatgttcagttaattttttgttttattttttgatatttagaatttcaaaatttttgttgaactttcttttcttttcatgaaaaattttcgatatgttctaataagtaaggaatacacttattgtcaatgtttactgcgtaattatttatattagttttattcatttatttattcatttattttctacgttttttattttattattgtttctgcctcgaataaaaatttatttacataattagttttatccacccatgatttcaaacgcgattgttcattggttggttggcattttatctatcttcccttaaa

SEQ ID NO: 35202 - DNA, 1081 bp, Heterodera glycines
ggggggggggcgaagccccccacgagccgcgaagagccgagtgagtacctcggtgcaggaaattataaatttaaaattttttaattgcttttaaatatgccaaaaatgtaggcttaactttttagtgaaattcgatcactcatattttttgctaattgagcagaagcgtaccaaactttgcagggatactccccgttaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaagttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattagcaattttttctagtctaatctactcaaaacggctcagggggggataaaaataacattcacggtgcgaaaaatggggt

SEQ ID NO: 35203 - DNA, 818 bp, Heterodera glycines
tttttaaaagcttttttgtttgaacgccgttattgccctttgaaatactttaaaaacaatatttgaactttttttaaaaggattcttacgaaacaacatttttaacattaatggtaaagaatttcagaagtcacttttatctaaatgtgacatattatgaataaaatattttatgtgagtacgatggttctcatgaattagtcaaaggttgagttgaaccacctaaaaattttatgctacttttattatttatgataatgagaaaaattattattcgtacaaaatatttttttgcaagttatgcatgagttgtccagaagtagtgtaggagttgttacgaatttctaaaaaagttgttttagtagttcaagagttgttgtattttttctacaaggcctacatacattatctttgtccgatgtcaagatatataaaagctttaagaatcttttcttttttacattattttaactgtttctgctgtatttttactaaaaaataatttttttttaactacatatatacattttctatgactgatgtcaaggtatattgaaaattttaatgtcaacaattgttttacattttttttactgtatattttttaaaaagctaatttaaaattttttttaatgccttacaatgataccaatccaaaatgttggtctttagtcaaaaatacataataaatattttaattattaaattgaaaagtttaggcgtccttattggaacagcggagtgatcggcttgcgcacgccgcttggcatttgctcaatcgtttttgccgtgttaattgccgccattctttccggtga

SEQ ID NO: 35204 - DNA, 693 bp, Heterodera glycines
aagaaaatgccaagagaagggtgcgaggccgcgaagcggccgagccattttcggttttatcattcataattttacaacacatctgtacttcctagcgggggatgcgccgaaggcgctaaccccgctagttttattaaaaaggttactgtcgaaaacacctggtttaaaactagcctaaaaaataaaacgccaatacattcaaatttaaaaaaacttttggtgggctttcatttttttctgctacaaattttttgtttatcttggaaatgtatgtacacatgcacgaagaatgcatttattagtttgtttcatttggttccctcttaatttagcaaattccaaattttactaaaatgagcgaccattcgtcggacgattcaagcggggctgagggtggtgatacttaccaagtttgtgaaaaaaacagcgtcccatcactttttggaatttcaatggattttttctaggttgaacgggtgttgaagaagcgcattatcaaaggggggaaggtggaatattacatcaaatggaaggtttgaatttagaaaaactttttacattttaaatccgtcccctttccttttcagggctacgaaaacatagaggacaacacatggtaaagatgctctgttttttttctgaatatttgcatttttctttacgtttccgaccccggcgcattacttttcgatt

SEQ ID NO: 35205 - DNA, 870 bp, Heterodera glycines
  misc_feature (718)..(718): n is a, c, g, or t
  misc_feature (774)..(774): n is a, c, g, or t
  misc_feature (783)..(783): n is a, c, g, or t
  misc_feature (798)..(798): n is a, c, g, or t
ttgatcatctccataaatatctcgtttttaatcatttacccttgaaatacggtagaaatcaatcattttgagatgtccaattttgaccccaaccctatctcagcgagtataaatcatagcctaaccatccaaaaggcaattctgtagtgaactttgtgctctatccaatgagcctattcaaaatttccaaaaaaattttcctaaccccctaggaatttttttctaaaatttccccaatttcaagcaatttttgactttcctggtcaccatgaaagagtgatctgatcaagttgatgtaagagacttttttgatcagtatcaaaagataagctagcatgaattatttcaggtttttaaatgaattttaaggtggtttttcatgttctgagtaaagacttttttccgccctttttttgagtaaagagtgatcaaacgactcatgctcagaattgactagatcaaaataataattttgtgaaatttgatcggcttggtaaagacttttttccaccagtgtaacaattttgaccctaactttattgaagttcaataaaatttttcgaaatttaatataataatagagaaatctttgatctatcgaattatataaacaaaattaaaaacatggaggagaaaattcgtcgaattgaattgaaaaataaatttatgtacagtcatggtcataagcagggttggccgggtccgggtacccgaccgngtccagatccggatacccggcttttttataatttttattaattttattaacgcttnttagatagncaaacaaattaatcnaaaaacttaattttgcttatattctatttttaatattttttagaataaaggacatatttaaacaaaaatttt

SEQ ID NO: 35206 - DNA, 189 bp, Heterodera glycines
aaataaataaattttttaatttcttttctaattgtttatttttattactgtttctgtcgtttataataatttatcttttcaagatgacccatgctttcgaacgagtaaatcgtgttcttctatttaaatttatccttttttgaattattgactttttcttcattttaatttattaattattttatttgt

SEQ ID NO: 35207 - DNA, 214 bp, Heterodera glycines
gttttgaatttgtttcgggtgaaagaatgtccttgaaagtttttcgaagtttgcaggacgaggcaataatttaaatggataaagtccttgagtttacagggaggcatttatgctcaaataagttagcaaatccctggcctgccaattttgcacctttttaaaaatttatataacctcgaaaactatcaattttttggtttaaaaatttttcttt

SEQ ID NO: 35208 - DNA, 780 bp, Heterodera glycines
ttctcagaaaaatgtctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagactcttcaaaatttttccattaccgcaagagctgcggaaattgtgaattaattctcagaaaaatggctatctctttttaggacaattttctatctcgtaaccccgatgctaatccgttccgcagagcctcttcaaaattttttccatttaccgcagagttgcggaaattgtgaattattctcagaaaaatggctatc

SEQ ID NO: 35209 - DNA, 1061 bp, Heterodera glycines
gtgagtacctcggtgcagaaaattattaattttaaaatttttaattgcttttaaatatgccaaaaaatgtaggcttacttttttagtgaaaattcgatcactcatatttttgctaatgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgaaaagtttattggggaaaaaaagactttacaaaaaatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataataccgctgggagaagggagtgggaaacatgatttcaaaattt

SEQ ID NO: 35210 - DNA, 718 bp, Heterodera glycines
cgctgctgcttctcaattcgttcaccgttcgttgattttttccaagttggtcctatggccaattttggttttattttcaacagtttttcactctgtaggtcgacctgcatgtctcgaatttcttgtccgagctgccggttttcgcgtcgcagtccctccacttgctcttgcagcgagtcctgttgtgtggccaaccggtgtgcttccgcagcttgcatgcgcgcctcacgctgcacagcgtccaactcactctgcaggtcgtccgcctgatgacggcactcgtccacctaagaaagacaaaatatgccatgtaattagtgatggtattaaaacattattttgagggacttattattttttaacaattgttaattaattacctgtttgtcatgtgcgcgctgccttttttccatttggagcgactgttgggcaagcgcatcagcgtcaatgcgtgccgcatcggcctcggaactaagccgtgcacgctgaaattgtgggccacaatatgattttctcaaattaagtaattagcgacgtaattaatccattatataaccggttaatttttttaatacgaaaactttagtttgcctttttctcaatatattttatttttctgacttcaatcccaatttttttttacctgcttttccagggactgtagccgtgcattgacccgcgtccaattcgttctgtaactcagcaatttcggccagtt

SEQ ID NO: 35211 - DNA, 712 bp, Heterodera glycines
ttaaatttatttttaatttttttttaaatttaaaatttccaaaatgggccaattattttcatataaaaatgcttctagtaaaagcagtgaaaattcctaaacaaagaaaattttataggcaaaaaatggtaatttgcaagggttgacgaatttgagtctaatttaaatatttttcatggacattttttaaattttggagaccgtaaattattttaaatttttttttattttaattaatttgcaaattaaatttccatgaatattttaaacaaataaatatttcaaaaatatcgaacatttgccggtcttcagctacagtcaaaccaaaattaaaaatattttcactgacatttttcagatttcggaccgaaaattctgatcaaagcggctaaattatattaaaaaaaatcaaataattttaaataataaatttgccattataatgtttccatgaatatttttataaataaaaaatttatgttgaaaaaaaggtttttaaaattaaatatatataatttaaaaagaaatatttttccctaccgacactctcaaggacacatttaggagaaaatttcattaaattgacattttcccatgaatattttaaaataattttaaatgattttcgacccaaaaatctgatttttagagccgttctgatttagaaaacatttcaatcgaagccttgttctaaccagacaaaaagttaaag

SEQ ID NO: 35212 - DNA, 953 bp, Heterodera glycines
ctctaattataatatttcgttcttaattgatctttttgataatctttttttaacataatttgtttgtttaaattaattttatatatgtaaaaattatattcttttattttgtacttaatatttttaattgaattaaatattttaaaaaattagttattttaaccaataaacaaaattgtgactcaccacatagttctggcaggttccactgaaaataaaatgcactttaaatgatttttaataatatttttatataaatccgatcattgggatgttcggaaaagagaaagatcgtttccgtttgaagaaaataatcgctaatcactgatcaaattattattttttgaatggtaaagaaggaaatgagtgattaactctaatcgctgatctaggaagtcgttgaagaatgtctgatcactgacttctgatcagtgattaattcaggaaacttggtctgattgctgatcgagtcaaacattgttttgggcctcacctgtccacattctgtcggcatgcttcttcgtccaaaatgggcgctttttgcagttcaccagctgtacattttttaaatttgttatcaacccaaaaaagcattaaaacaaaaaaaagaagcattaacttaaattaatcaccaaaaagcaaaaaataaaaaaatatggcgatgcgtcataagctcttttttaaaatatggcatttttggcatttataccattcaaaagcccagttaaaatctttgaaaattcgcatcgtagcatttgttcggcaaaaaggtgtcctcatatttttaccgaactctaaatacggtcatttgtcgcggattttcaattttcgcaaaaggcatactgtaaaagtcacgcatcgccaaagcggcacaacccaaacaacacaaataagcaattatttagagccatgacatttcattgttcaataaaatcccaccatggtactgactt

SEQ ID NO: 35213 - DNA, 1059 bp, Heterodera glycines
agcacgggtgccacgcatgcccattcgccaagccctccgtctcaactgagcacgggtgccacgcatgcccattcgccaagccctcgggttccaactgttcacgagtgccacgcatgcccattccaactgagcacgggtgccacgcatgcccattcgccaagccctcgggttccaactgagcacgggtgacacgcatgcccattcgccaagccttcgggttccaactgttcacgggtgccacacatgcccatttcaactgagcacgggcgccacgcatgcccattcgccaagccctcgggttccaactgagcacgggtgccacgcatgcccattcgccaagccctcgggttctaatgctgcacgggcgccacgcatgcccatttcaactgagcacgggcgccacgcatgcccattcgccaagccctcgggttccaactgctcacgggtgccacgcatgcctattcgccaagtcctcgggttccaatgctgcacgggcgccacgcatgcccattccaactgctcacgggtgccacgcatgcccattcgccaagccctcgggttccaatgctgcacgggtgccacgcatgcccattcaactgagcacgggtgccacgcatgcccattcgccaagccctcgggttccaatgctgcacgggtgccacgcatgcccattcaactgagcacgggtgccacgcgcatgtgccggtagctgctgctgcacgaacatccagacacgcatctttcggtagctgctactgcccagtcaacctggactgtgcacccgttactggctacaactcgaccggctagggtaagcaagtgcacgctccccacgcatgccctcagagcggctagttattattatataaaaataaggggtgtagccaaacttcaaaaagcgacctaccgcacttcccgtagggctagcgggatgaacttttttttaaatgaaagaggatctaatttagaaacttttgaaccgtgcaacttttaattgctcttgcacttttttcgagaaaactaacttttttgatttacttttttttttttgccactttt

SEQ ID NO: 35214 - DNA, 1000 bp, Heterodera glycines
  misc_feature (877)..(878): n is a, c, g, or t
  misc_feature (948)..(948): n is a, c, g, or t
  misc_feature (974)..(975): n is a, c, g, or t
aaatagaatataaaattcaaaattcaatttttaattatacaataaattcttgaaaataaaactttgttttgtcaatttagcccaggcaatatctcaataaagtgcgtattttaatgatatgtaaaatatttattataaataaaatttagcatttgttaagcaatttgtaacggtttttggtggaaagaagtgatcaatggttgatacatggagatagatattgattgatcagaatgatgagaaaaaaaattggcactttgcaacaaaaggccttttcaaaagagtgggatcaaattgtgggagagattcaaaaagagtggatgataaacacatgggaacattgagaaaacaaagatcattatggattagatcaatgaatgataatttgatacggaaaggtatctgctcggactgataggcattgatcaaagctaatcgatcaattttgatgtttaagcttaaggattgcactgatcagctgagaaaatttgaatgtgcttctaaacaacagcgtttcacgattagttagataaatgggagcagaaaatgggccaaaatatgtggctaatcgtctgatcagcttttcggaagctcaaagaaaagtgatcgaaaattaataataaaatacgatcgatcaagcactgaccagcaagaaaatgctaagcaatcaaaactgatcagtcattatgtttattattgatgattgagtccgatcagttgagataaattgtttcccgtttccgactgccgtcacccactgcagtgcccgcactcatcgaagacgcgttgcgtgccaacatttgcgcaccgccggacaccgcaagtgaattggcgttgtccctgccgccacccgtcggcactctttgaatggcactgnntgcacccgtcgcattggcatgccgtaacgatgctctgaaaagaagggtcatttacccttagtctcctttncagatcaaacagattttgaatttganngattctgtttttgttttattttttt

SEQ ID NO: 35215 - DNA, 466 bp, Heterodera glycines
ttgtgttctttctaaatttttttttgtaataaactttttgtccaaaaatcataacaaattttttattaaatattttttaggtcttagatatttcgggattatttttttttggatgaaagcattgacaattacattaaatttgaggcatggatcaaaaggtcggacaatgtgctcatcgagttttgttcaatggaatcggttaaacgctttgccgtcatgatgagcgagggcagtgttccctttctgtcaagaaaaacggggttccatgacttggctacggtactttcagaattatttaaatttttgccaaataataattgcctatactaaatttgtttcatgtaatttcattaattttgttaattatgtaagtttggtcgccagcaattctttgcacttgtctatcgtgacacgggcgttgacattctgcgcactaatggcatggttttacattgttcataaaatt

SEQ ID NO: 35216 - DNA, 1333 bp, Heterodera glycines
  misc_feature (1308)..(1308): n is a, c, g, or t
gaaattgacgaaacgttggtcgtcaaacggtagtacggggtcggccggatcttagagaaacaggaagtatggctattcggtggtgttgagcgcgactcaaattgggagcgtgtttttatggttcctgtagaatcccgtggtgcggctcgtcttcttcctcttattcagcagtatatacttcctggcacaacgattgtcagcgatgaatggcgaccgtaccgcggaattcctaaccttccgcaaaactatgttcattggacagtgaaccattcacaaaactttgtgaacccagccaatcgccttgcctatacccagaatgttgaatcgatgtggaagaaattgaaaaggaatttcaaacagcagtttgggaacaagactgaaacatacgacacctatttcccagaatttatttggcgtcagcgttttggagaccgtgaaaatgcgttttacaatttttggttgcatgtctctgagttttatccatgtgaacattgattattttctttttcgtgcatttgaatcgatttttagcaataaatgtgaattttgttaaaaaatcaatttttttattttgttcgaatccgggtcaggggttcggaatcggtcaaaatggatgtcggattcgtgatcagcgaccccgaaaacccctagaaacatgtttttatgattttttgaaagttgaaaaaaatttttaaaaaaggggggggggccatctaaactatattttaccgtcggcttccaaacaatggtggagtcttcaatgcaaaaggtggcagattcattcattcgtccagtttccaaacatcatcaccattttgttccctgccccttttttagtcattcccacgccttttctgcaagttcaatcgcgaggtgttctgctggatggaccgttggaacggactgacgctggcgcaaattcgtttgatcgaagaggagacaaagaaggcattggacgaggtgggcttctactctgacaccgtccaattccaccgctttacgtaatcattgcccattttgctcagatgcgcgcgactggcaagccgcgggggatgaaaggtaactgaacgccgccgatgaaccgagtgacgtgccgcgatgacgctgatctatttgctcgttatattgtatcgtgccgatgacgctgatctatttgctcgttaaattgtataatatgtaatataattcgtcaccatttgtcctttctttcacccccacgcattcctttcggcacttattgtatactgaacacactcccaatttcctcctgattgatgtgtatgtattattgtgattatgttgacaganaaataaatgttcgagattttagaat

SEQ ID NO: 35217 - DNA, 820 bp, Heterodera glycines
  misc_feature (8)..(9): n is a, c, g, or t
tgacgaanntatgccgtctaggtttgcttgtgcaacaacctcatcatgtcttctcgactgagcaacctgaccaaccatgtgcgccgtcacgcctcgttgaagcagtaccggtgctgccattgccaatattcgcacaatgaaatggccaaagtccgctgactgattaatttacccacaaatccttctccatctcctcattcattaaggtgcgtctgcacatgtcccacaaccatcaggacttcaccagtcagccgatggacatgctcagttttgagatgcaactccaatggggtcttttgatggagcagtgttttcccgagcattccaaagtgaacactgtccattaaatgctaccaaattgaatatctcacttttctttcattagcgtttcggcccctccgccgcaaattcgcagtttcgcaatttggaagagttgcagaaatatgtggacatggaggtcgaatggacaagacaatccgtcacaccactcgcacttgtccatttagcactcctacacatgcattgaatgtggcgaagtgttgacgggctatcagctggtcacccacttggaggatgtccaccgtcaagagtgtgtgccatttgcgtgtggccaatgcggttaccaggcgagcaagcacaaatgccagcagcagacagagcccacccacattcaccttttcattcacagagctcgtcccaatggaaagttagactgcacatcagcgtaaaacacccggagagagcggcagagataacggtggccactctacccgcgggaagcaatttcatgctctttttgcagaagttttttgccgaggtg

SEQ ID NO: 35218 - DNA, 1045 bp, Heterodera glycines
  misc_feature (22)..(22): n is a, c, g, or t
gatttctgaaaaaatatattgnacaaaagtattttgaaaaaaatctgaaaatattttaataataagtttaaataatataattaattaatttttgaaaataaatttgaaattatttaaattaatttaaaaagtaatttaaattgggaaataatatttaaaaacaatgtttgtccatatactacatattactactgatttgggaaataaaatttgaaataactaattaatttgagaattaaaacaaaatatttttaattgggggaataaaatttgaaataatttaataaatttaaaaaataaatttgattaggcctacgaaatggaagaggctatgtaaatgttcatgggggcggagtggaagatttgttggagagattcgctggatggagtgatattgtgaatgatttggtggcgctttatatacggcaatattggcgccatgctgtaattggttattacagcatgcccacaaattttgttcaaatcttccacccccaccccatcccgcagtcgagaattgacaatttacacaaatggcactccctggcacgcaaaatcgcaaaatcccttcccacaatcctgaaattttcctttccgccctcccattgttcaaatcttccacccccacccatccagcagtcgagaattgataatttacacaaatggcactccctggcacgcaaaatcccttcccacaatcctgaaattttcctttacgccctccccctccctaccactttcatcgttggctataggtaattatcggtaaaaaatcttgtcccccccctcctgcccaaaaatcaaaactttaaaaaatatgtgcccttcctatagtaattacggcacaaaaaacccctcctcacaatcccaaaatttacttgccctctgtgcaaccccccccccccccctccttaccatttttcactcgctgagggtaattatcggcacaattttgccctcccctccccctccgcccaaaattgcatcgggggggaagggggagggtaagtgattggaccagtttcccactcttcgatcgtcgtac

SEQ ID NO: 35219 - DNA, 732 bp, Heterodera glycines
attttaaaattttttagttgctttttaaatatgccaccattgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctcagttcatttaaataatttttatccaaaaaattttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacactgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaagggggggggggggggg

SEQ ID NO: 35220 - DNA, 1456 bp, Heterodera glycines
  misc_feature (1391)..(1391): n is a, c, g, or t
  misc_feature (1424)..(1424): n is a, c, g, or t
  misc_feature (1429)..(1429): n is a, c, g, or t
ttgagcagcaacatactagtaatatataaattaagaaataaaatttagctttcatttttaaaataaaatgaaatgggtattaatttgaaatttaatgcttttatagaatttaattgcaatactaacaaatatttttgtttttattcagctgtaatattggcaagtattttttgttggttatttgcatattggcaaatttataaaacgcgactggcggttttataaaacgtgcaagcaccttaggtaggtattagttatacttatctatgtaactaattgtaaaatttaaattttaacttgctatttttgaattaaaaaaatattttcgatttaggctctgaaattttgcaaatgtttgaaaattcataactctaagtgggccacatggtttttattaaggaaacattttttcatccaaatttaacaaaaaatagttttagtgttattttggctgctaatcacgaatctaatcatatttcagttaacttcgatcgattcatggggatgtatttttcgttttcccgctggattatcgggatttgcttaaactctgctttttcactttgtgccaagacctattcaaatgcttatgtaaatttataattgattaactggattgagaaatttaatagggactgaaattatttttacaaaaattccaaaatattttaatagatatttaagaaagatgccaaaatatttatccaaaataaaaaattagagcaataaaaattgaaaatttctttttgatggcttgactaatggggatacttttttctttttttaacaggcaaatattaggggtttgttttggcagaggttagaaattcattcaaacactgatctcttggagaacatgttttagttaaaagtgtttgcttccatacttttgcacctgactgtaaatgaattaaggttaggtctcgataaattatctagtttatggagtctcgactttcgcggcaaaataaaacattttcatcgaaaagaattcatcaaaattaacgagcaaaaaaaagcataaaaaatgtgtcagatcaatttgtccatttaataatcaccaaaacggccgatcatttctcaattaaatccgcaaagttcgagccctttttccgctgctttgacccacttcttcttcttctgctggttgtggagacaatgggctaaattaagtgcaacatttttgaattttgatgaacattttggcaaaagcaaatgagtcaatggtatcaatttagtgaaaggcttcatacattataaagaggaagtcaactaaaatttctgcgaaataaaaattttttgcgacgcgcttttttaaaaaaactttttgcaggaaaattttttgtagtataaatgccatttgttagcagattttgtctaaaaatgactanatcttgagattttgggctagttttttaagatanaatangtttgaggggggggggggggggggggg

SEQ ID NO: 35221 - DNA, 1069 bp, Heterodera glycines
aagagaattgagcagagaatgaagaaagtgaagctgaagggaaaatgaaatgaaagccataaaaacgaattctcttttgatggcacaaaaaaattgtccatccgatggcataaaaaaggactgtccatcctccgcctctccccccataaaaaatcttttgccgcctcacaaaaacatcgccaaattgaagaggaagaggtagcaggagaacagcatgttcacgtgctgcctcagctgcccttcactgaacatccgctggtccttctccaaattcagttccttcataaggcgttcgatgtgcgcattctaaaaaaataaaatgcaaaaaccatcgcttttgccaaaagcatttgtcaattttgcaaaaatacccactcgaattaataatttcttttttagcccatcaattcatttttcccctatatatgccaagtccattttagcccaccctcctcagttcggcacttccgtcgcccgactcatcggtcgattgttcgtcgttcggatcatcccgccatttctcaaaatcgaattttagccaacgatacgtttgtttctgctcgtcgcttgccaaaatgccattgccccaaaatgtgggcttaatcttagccaaagtgaactcgacgcgaatcccgccgactcgagtcagttctggtgattcctgacagaaaagccggacttccatgtctttgcattattatacgaacattcacagagtcaaaaagtgggagtcggaaagtatatttgatgcaattgttggcagtattcggtgaatacgcaaaagccgaaaaatccactaaacgaccatcctccaaaattcgaatgtcgatgtcctcaaaaagttaaggatgcaacggaataaaggagggttttcaccgaacctttgcctccttaacgtcaaccttcaagtaaatatgctctaagtcttgcgcccaatagacaaatggtcttaagttctgttgcgtgtccataaaatactgtacaagtaaaaaaaataaagccataaaacagtattttaggtatattgggtcatctaactactaacaataaaacaatacaaaatcaaaat

SEQ ID NO: 35222 - DNA, 126 bp, Heterodera glycines
ggaatggtcagacacaacaaataaatataaatgaaaataaatcaaattaaataaatgtctctcgggtcccacccgaacagtagccaggggcgtgactggacaatccgacagtggacaatccgacag

SEQ ID NO: 35223 - DNA, 818 bp, Heterodera glycines
attcacacaaaataataaaggaaaatatgggaccctcattcttcgtgcatgccgcagtttattattttactgtgacacgtgcgaactgtcataggaaagtgttggcggaaccactcaacatcggcaatttcacgacaaaagttctattgtttaaacgaagcaaaagcggttcactaagtgtccaattccgtagtttcttaggcaacaacttttttaacggtaaatgccattgaacattcgaaaagaaatttggtggtggtggcgagactgtaactgtccgattaccggccccaatttttggggtttgaatttaattttgaaaaaattctgattacactttcataaaaagagctcgaaaaactgtcgctgttgttgatgttgcagatgtatgaatgtaacaagtagcagaaaaccaacacaaatccattccccatccctctaaaaagtgcccatgaattatttcattttgcttaaattattttgattttttgcctttttgtgccattcgtccgagcagagtccgaaaaatgggaatttgtatgctttaaaattactcaaataattcatgtttaaattgaaattaaatactaaattcaatactttctttatctaagaaaattaaatgaattcaacgttctgaaaataattttcgaaacaaattttttgcgaagaaaataaatttaggggatgagctttttttaaaaaattggatttgatttctactagtagagcatgttttgtaaaattccggatcagcttcaggatcggcaatcaggaattgaacatggacaggattttgtgcgtaattttgtccaaat

SEQ ID NO: 35224 - DNA, 758 bp, Heterodera glycines
tggcctaatggctagtctccttgactgtcccttcttctttcccctggttcaatccctctacagaaattagtttattttcaattttttttttttttttgtatactcgtgggtttcctataaagaaaatatgattcctcatagtttattttaaattgatacatattttatccttttttaaatgaaaatcctaccaattgagcttaataatcgcaaaaaccaacctttttttgttgaaaatctgttaacaaattgcacccaaattttcaaaatttcccccggcggcgcctatcggcaccgccggaccccttctttcccaaaagttttttggaaaagagctccgaaaaaaagtgatgtgaaaatcaaatctgaatttctattaatattcgatgatttagaccaaaaatgattaattgtttgagataattgaagaaaatttgtttgaaaatatttcattgatttaatttattatactcaatgaaataattttgtattatgttcacttgatataaattaagctttgaatttttttgtaaaatttttaataaatttttttgaaattttaaaattgaaaggatgattgcgtttccaggttgttgaatgcacatgagaattaataacttcttaatctggcgatttaaactgatgtcttgtcatattaggaattgaaattaaatgtggccaaaaatagggaagagaacccaatgaaaaaattaagaaaaatggctaaattgcaaattaaatcgaattttaaccctttt

SEQ ID NO: 35225 - DNA, 472 bp, Heterodera glycines
  misc_feature (17)..(17): n is a, c, g, or t
  misc_feature (71)..(71): n is a, c, g, or t
  misc_feature (79)..(79): n is a, c, g, or t
  misc_feature (123)..(123): n is a, c, g, or t
  misc_feature (158)..(158): n is a, c, g, or t
aggggaaaaaaagacanaaccctttaagaccccaagggagaagggagagggaaacaggaggacaaaagacncaaaaaanaccaccccaagcgacacagaacggggcagcaagacaacaaaaanaaccaacacggcgcgaaaaacggggccagaaaagnccaaaacgaaaaaaagacaacacaaaaaaagaccccagggagaagggagagggaaacaggaaaacaaaaaagacaacgacaacaagcccaagcaacacaaaacgggacagaacccaaaaaaaacaacacacacggagcgaaaaacgggggaagacaagcgcaacggggaaaaaaagacaggacaaaacaagaccccggggagaagggagagggaaacaagacaacaaaaaaggcaaagaagacaagccaaagcgacccaaaacgggacagaagccaacaaaaaaaacagacacggcgcgaaaaaaggggacaga

SEQ ID NO: 35226 - DNA, 440 bp, Heterodera glycines
ctaaaaagaataaacattaatgttgttatggatgagcgtccgccggctgcccgccggcagctcattgccttcgtctctcatctctcctctaacactctctccactctcttattttgaactatctctttttgtttaatttggacaactgtttatctctaatgaaaatatttggcccgccccgataaaagccccgatcacattttttattccccagtgatcactttttgtttttcgcaacttttccggagagacgagaaataaaggcaactgttaaacctaaggcgtcgaatacatttcccattttcgggcgccaccgcgccctggcggtgccttaggcaccgtcagcggcccaacggtggcacatacaaaagtgccccatgaaatggcgctcctgggtttcgaacgcgctcctttcgaggccaattggcgcatataaaatt

SEQ ID NO: 35227 - DNA, 892 bp, Heterodera glycines
  misc_feature (873)..(873): n is a, c, g, or t
tggctcgattctgtccagaacattgtaaaagaaaacgttaaaaaagatcaataaaaaaagaatgcacatttcacaaataacaaatttgtcaacgaaaccaaaagaattgaaacaatcaaaacttaaagaaattgaacaaatttggcgttctgttagaaagttggcaaagtgtaaaagagaaagttgtcggaatggaaagtggataaacgtatgtataaattgtgcaaaaactgaaactgcagtttttaaaaaataccatatactttactgttagtttctctgaatttggattgaatttattgttcgaaaaatcgaagttcctcgctcgtatatacctaattgctttgatccattaaaatccattaacacaaaattgtgccaataattaattatttcattgtgattttaagatttatttttttatctttagtttgtctcaataagggcgctaaaattggctgaagagactcgcgacagttaaaaaattgggatttatactctaaaaatggacacctccaatttttcaattatgaaatttgaaaaaagcctcaatcgcataattactcaaaaaattaactacagatactgatcaccttatgtccgtcaaacattcgcatgtcgtgatgagcttggacgcacctgaaatgccaaattttaatttttgtttccaatccattatccatcgacggcacaaaaatttaattttttcgcttgatcatcattcattaatataaaaagtcatgaaaaatcgccaaaaagtcacgaaaaagtcataaaaaatgtatgttagaagcttcaaacaaagtgtagaacacttttgaagtcattttaaggtcatttagagtcagcaaaaaaaaaagtcatttgacttanattcccatccctattcatt

SEQ ID NO: 35228 - DNA, 918 bp, Heterodera glycines
  misc_feature (880)..(880): n is a, c, g, or t
ccttaaagaatagagcacaattgagttagaacaggccgtttaatgtacgtcatatagtttagggaacttgtgataaaaaagtaaataatgcgatcggtcgttttgggagaagcggacgaaaagccgatcaaaccgagaagagtaatcgagatggaattggtggaccaaccgacgaaatcgaccagcaaaatggagaacagcgacttgaacagacggcgaacatccactaaatttggaattaggtggcaaaaattgtggagacaattaacaaatgacataattaaatgggcaattaacaattgattgacaactaattcatttcctcctttcctttcttttttcttgcctgtgctattcccattctcttttcgcgattttttgtccattttgttcatgtgcaaccaaatgaaaatgtaaataaaaatggcgatagattccaacgcaaagttcgtctttgccaatgcgttcaccgcactgccaagcggagcggtcgttgtacaagcaattggcctgagaatttgataataatttaaaaaataatagtaattcatttcaaaattcaaacaattgagcccttaaggcattttgtaaggcgatgatcatataacagaaggaatacaatgcgcacagaaccaatgcaatgccaacagctgaccattttttaaccgatctgtacctaaagtatttcaaaattaagggaaatttttaaaatattttttaataaaacgcaacaaattaattattacttaattgggaagatagcgccaattaaacggtcaatggcaatgaaaagcattagaggaaacgagccacagaacagaaacaatggcacgaactgaaacataaggcattccgagactttcattgagggatagcctanacagcgaagctcaatgaaaaaaaacatttagtgaatcg

SEQ ID NO: 35229 - DNA, 115 bp, Heterodera glycines
ctcactcttatcccgtccatccgttcattcattcattccattctcggcctcctcctccccctgtcccctcacacatttgcccaacctcacaaaatgcaagtgaaggggagagaag

SEQ ID NO: 35230 - DNA, 1463 bp, Heterodera glycines
  misc_feature (1005)..(1005): n is a, c, g, or t
  misc_feature (1068)..(1068): n is a, c, g, or t
  misc_feature (1139)..(1139): n is a, c, g, or t
aacaattaattaattactcattaagagaaattatgaatatttttaatttaaatcattttttaaaacaattgaacaaaccaatgcccatttgataaagtgttttgctgatcgagagtcccgagaaattttcaagaattttttgggccttgttctcgaggtcttggaaaattttgcttttcaaccagccctaattaaaatacttaaaacttatgcttttgtttgccctttggttggctgatcagtagtgattaattattatacatatttatttgtcaacatttccgatcggttaaatcgcaatcaaattttgtttcattgctcggatcacttggggaaatgatcaattgacagaatattggatgatggatgcatttgttgatcatattcattcattgttttggccctgtttcaatttcgattcgaattctttcataggtatataacaggggtgggacaactctcgcctctcgtctctcgcctctcgccaactctcgccatttttggtactctcgcctctcgtctctcgcctctcgttttttgggacgagaggcgagagttgaaaatacacccctaaagattgaacttttgagtagccagaaaaattttcaaatttacgcgaaaaaaaaatcttaaatctctttctttccttccttaatgttttctctatttttggatagctccaattcaaatatggtctgctggctaaaccttctgcctttcattatttttctcttgggttcaattccccaacggtacagaatttttttaataatttctttaaattattttcaattgaaattttaattaataaaaaatatttcaatttaaaaattattattttttctttttttaaacagcctaaaactgcaaatttaaccaaaactttgatcattttttgacaagttctgttaatatattacactcaaaattttagaatttttccggcggcgcctatcggcggtgcagattcggcaccgccggaccccgcacccaatgttccaaaanaatttttttttgggaaaacagcgccacaaaaaaagcgacttaaaaacaaaaaatttaaaaaancaagttttgggtcattttttgaataaaatctgttaacaaatccgaagacaattcaaatttttttttttgcnggcggcgcctacgggcaccgcccgaccccaactgtccccgaagttttaaaaaacgcaccgcaaaaaaaaggtggaaaaaatggacaaataatagagtttgtttctagaatagatatatttcatgaaaatattttttaattttcatgaaaaattttaaagatttttgtttggatttttcatgacttgcactcggtttaaaaactaggactctgacccggctttctgtacccgggcataccctgaaccgggtatttgccccaaataccagggcccggaacccctaattttataatacgatttttggaagttttttaaattaaaaaa

SEQ ID NO: 35231 - DNA, 369 bp, Heterodera glycines
aattctgacaaaaaaaattttttttttgaaaaatttgaccaaaatatgggacccaaactatagtagtaccggaagggggaaattttgaaggtgaattaggttttacaacaaaaaatatttcatttttttcgcaatccaaatttgaacgaccccctttcaaaatgaatcactttttaattattgagccccaccaggcgtaaggcaataaccaaatatcactttttccagttattttgttttcaggtaccatttgcaccttctggactaaaagtgcggtatctcaaagtattcgaaccgaagctgaactactcggaccatgacgttgtaaaatgggtgcgttatatcggacgctccggcttatacgaaacg

SEQ ID NO: 35232 - DNA, 1685 bp, Heterodera glycines
  misc_feature (1510)..(1510): n is a, c, g, or t
  misc_feature (1567)..(1567): n is a, c, g, or t
  misc_feature (1574)..(1574): n is a, c, g, or t
  misc_feature (1624)..(1624): n is a, c, g, or t
tagaaattttgaaaatttttttgggtgaagaatggagtgaaaaatatttttctggggtattttgaggtgctgagcacgaatatgatgtttgtttaacgtttcagattttttgaaattttttaataaatttggaaaatttttcatttttttgggcctcgagaatttgaggtaatttttgaaaattcataactaaacttaggtttgtccaattttcatagaataaagcaagaaaaattgagaaaaataaggacgattttatggactttatttggaatttctatctgtaaaatgaaaaaagttattccagaaattctggaaattttcgaattttcagaaaaaaattcagaactcggttctgaaaacctattttcacaaattaaaataatgaaaaaaaccgcgatttttttctctattttataaattttatttcatatttttaacactttttcgaaaaaagttataaaattaaaagtgatttcggaatttgcgaccaaaggggggagtacatggtttttgagtggaaaaattttttcaccaaaaatctttcaaaaacatgtcctaaggggtattttaggactctgattacgaatctgaaatcagatttcagttttgaccacgttaagacctcagaatccccgtgtgattggggattctggggcatcattttgagggggggggggtgcgggttcggacccggacggtgtaaattacttttctttttattttataattttttcattgtttaatacatttaaattattaacaaaaaaaaattaatattttaaataaattatttttctgtgtgaaagtcattcttttaacaccccaaaattttcggaatttttttttgggccacaaggggggtgaaaaatattgttctggagtattttgagcacgaatacgatgtttgttttgcgtctcagaatttttaaaaaaattttgcaaaaatttgcaattttttgcccttgggaatttgggttaaaatttgaaaattcataatcataacttatgactgagttgctcaatttaattgttttaaagctttaaaaatagagaaaaatcaggaaaattttatgggaattatttgtaattgaaatctctaaaagaaaaaaagttattccagaatttctggaaaaattcgaatttttagaaaaaaattcataactcggttctgaaaagatattctggaaaaataaaatgctacaaaaatccgcagtttttttctctattttataaattttatttggcatttttataatttattagaaaaaagttataaaaataaaagtgattttgggattccagaccaaaggggggtgacaggatttttgagtggaaaaattttttcccaaaaaactttcaaaaacatgtcattagggctattttatgacgctgatcacgaatacgtgatcagattttacttttaacatcgataagacctcagaatccctgtgtgattggggattctgagcatcattttgagggggagggggggggaagttcgaatccngggcggtatacattattttttatgtgtttttttgcttatttttacgtttttaataantttcagntaataaataaaaattattatcttttaaataaaaaacttttgaagaattantttttcaaaattccctttaaaatttcatatgatgaaacatatttcactatatggtacatgc

SEQ ID NO: 35233 - DNA, 1312 bp, Heterodera glycines
ttctaattcgcgttttacggaccgtaactcgggcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctgggttgcgaggtgtagcgtatagaccgtgagcttgggttggcccgcttgttcaagtttcccttgaccggggctccagagaaggtgcaagacctgtccaactggcggtgcctatccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttgtactgctagcctccagactggggtttgctgtccttctgttcagtggcgaatggggcatttgcaggcggagtgcgctgagatgctcggagtagctgcgtgagctcggtcttgaggccagccttttggggtctggtacccggatcgggggagtgctgtttactctggttgaattgtgcaatggttttcgggtccgtgttgactcgagctgggggtcggtggcggtcgcgtgcgacacgtaccagcaaccagttcggtccagctcaggctctcacttgtgcgttctcggtgtaaaagccggtcatctgttcgacccgtcttgaaacacggaccaaggagtttagcgtatgcgcaagtcattgggtgttcaaaacccaaaggcgcaatgaaagtgaaggcttcttacggagctgatgtgtgatccctggcactgcggtgttggggcgcaacatagtcccgtctcgatcgcatgcgatggggcggagacagagcgtatgcgctgagacccgaaagatggtgaactattcctgagcaggatgaagccagaggaaactctggtggaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaaagcgaatgattagaggacttggggacgaaaatgtccttaac

SEQ ID NO: 35234 - DNA, 902 bp, Heterodera glycines
  misc_feature (739)..(739): n is a, c, g, or t
tctctgatgctttttctatcaataatgggaggtgaataaaattttaaaaattttttaattgctttttaaatatgccaaaaaatttaggcttaactttttagtgaaagtttgatcactcatattttttgctaattgagcagaagcataccaaactttgcagggatactccccggtaaaggactaacttacactgaaatgagcgccgagctagcttgctctaaaaaatttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggngcagtccccccgaaccgatgcgcccagatttatggggagaccgaatccttcgggaatagcttccctatagcctgtactttaattctgcgttggatttttgctccccatatttgtttgagtaccccaaacggacacttgaaaaaatcgattttttttgttttcg

SEQ ID NO: 35235 - DNA, 844 bp, Heterodera glycines
tcccacattatttaattaatttaagtggttaattagaaagttatgcgtttgacaccaccaaaattacccgtctcggttggtcccaaaaaaataatgagaaaacttaaatatataataaattacattgcagcgaattgagtcacttcattgaactttgagccaatgttaattgaaagtgatttttcatcaacaataatatattcatcaaaaatttccatcgcttttctaaacatttaaatttagttaaattatttgtaagcgcaaggaaattccaaatttagagtcagaagagtgttaggggtcatgagatattaaattcaattaatataatgggaatttcaactttttataatttaaaattcaaaaaaattaatagttttaaaaaagctataacaaaaaaagattaaaaatattttttatttgtgtttttttgtaaacaaaacgattttttagaattttgaatgctcagaacatttgagctcttcgaatatacaaataaattgtactatttatttgttttgagcaaaataacaatgaatttttggaataaaaatgggtacaatgtccataatattgcgactaaacgaaaacgaccaataaaaaaaaaattgggaggagaaaagcggagttattgattcagagagagttggaatatgtacatggataaacaaagataaaaatgaaggaatgacgaataggtaggtcactgaaagatgctattaaatggatgcgacccaactgacaatgaatgaagtgagtcattagtagggtgagtattttagtggcaaaaatcccaataaaataggctaactgaaagccgcaaaaccatgccaacacaatggaa

SEQ ID NO: 35236 - DNA, 1665 bp, Heterodera glycines
cttctgcacaccatcgaaatggtcctcattaaaatatagcatcaaaggtgtgtcgtaggtggtgtcaatgtacttgtagatcggtttatactgtcccaacgatccaaagatgaacacagcaaagcggtgttgtcgctgcgcgttgttccagtagtcaacgacatgaggcacaaatgtgtccgcgtcgtagccaaccaaatccattggtgcattaacctgctgcatgagctcaaccgcatcatgataaagttgtccctgttgtccgtattggttgttcaagtaacgggaaaacttccagcgaggccaattgcacgttttggcgaccattgttgcctgcagcgcgtagaaaaggcagaagtggttgtcgttattgcgaattttaatcaggcattggtcattaattcggtggtgaacggccgttttgacagggcgacgagctccccctttgacacgacgtttggatggtagtccattacggtccagagtcgtgatggtgacggtaaacggctcaccccataacgatacatttttctgttgtttggactgcgccacttttttgaactggttgagaatggtgtcgagagtgttgtttgtcatttgtcgtatcgggattgggatgtcgccgccttccagcagaggactgctgatcatacagccgaggtgtgtaggttcgatgtttcgctcacggctttcaacaattgcttcgtcgatgcagtgttggaaaatcccagccaacaatgcctcaggcgtgctcggcaaatccgtaatggtgaatttcgacttgacttttaacgtagtggaatttggccatgtgctcgatgttgttctccaattttttaacgtagtcctttgcctcttttgatgttccttcgccttgctgcaccgatccaaggaagtgtacgacacccaagagttcattgatcaggaagccttgacggggctttttgggcgcggagagaatatgatcaatggaaaagttagaggagcgttttcggggatgattgtccattttttttttaatctgagagtggagtgaaaaggaatgagcaaaatctcggtatttatatgcgagcgccggcatggaaatggcgtgaaatggtgaatgaataataaatatttggacatggaaaaatttcaaaaaacttaaacaaaactatggcctgaagagcagcacaccgccacccatgaagcacaagacgacagggcacctaaacgactcgggaaattagtcaagtcaagcgaaagacctcaagccctaaaagacaaattgctgccaggataaacggtgctttttgtaattaaagcaaccgccctggttaacagcaaaaatatttattttaattatacggtccccaaaatccccattaaataatacggtccccataaagcacaggacaagtgaggaagaggagaggaaaacagcagatgtgcaaaaaaagtgaaaatttttaaaatgaatcgggaaaatgaccgggtgtacgatacgcgtacttaggccacgcccacttgcgcaccaaaattattcccaacaagaaatcgaaatcattctttattcaaattttggaaaatgaaacgcccccatttcacaatgctcttccaatgagtgagaaaaagcccaagcttcgtcgacggctccccgctgaataaaatggcgaattgatcagt

SEQ ID NO: 35237 - DNA, 1475 bp, Heterodera glycines
  misc_feature (526)..(526): n is a, c, g, or t
  misc_feature (884)..(884): n is a, c, g, or t
  misc_feature (930)..(930): n is a, c, g, or t
tttcctctcctctacaatcaccgcctcatttcttcttattccgccgcaattagtcatgaaaatcagcagcaattgatgggttcacttgtgacagcattaggctaacggcgaagtcttcgagtcacaaagcaaaagaatcgaactttgtcgaaaatgtgaaatacccgaaaactcccaaattttcaattttattcgaatttacgcgtccgtcccatcaattcttcgaccataacttttctcttacttaatcacgcttaaccttctaattaccaatcgaaaccacatattccccagtcccacatttcaatcaacgaccagagccatccttgcatacctacatttcactatatgaattattggaaacctgaccagatttgttgatttccgttaccattatatccgcctcaacaagctagtaaaatagtgcctcattcgcacggttttgtccacttttcgacaaataccgaaagtgtcgaaaaattttttgaaaaatcgagtggtcgattgaagattgactactttcggntatttgtcgaaaagtggacgaaaccgtgcgaatgaggcactattttaccagcttgtcgagccgaatataatggtaccgaaaatcaacaaatctgttcagtcttccacaaattcctatagtgtcaattttttttttgaaaaatcagtggtcatcgaaattgacacttacggcatttaaatgaatagatttgtgtattttcggtaccattttggccagaaatgtcaatttcaatattatatgattttatggcttggtaacctatttttactaatttgcagcatctattcgttgccctcttcgtttccaatttggtacatcatggatgtactcagttcgtcatgttcgacggcggtaccgngggggggggggggggggggtgacagattatattcaacgagttcacngccagtcatttatcattgatacactgtttgcgtgagtagttgctatatactgtcgagcttgatttaggccgcttgatctcctctcacttgatgggggcaccatacaacgcgcaggagctgttccactggcggagtctacccagcttgacatgccatgaaggatttttaattgataccgacaaaaatatcaatgggtcctcttcgatgaagagtagagatggactatatttaaaattcgttaaataaccgagtgggatcatgacgaggaaaacggatgaatacggacagtactcggattcggcactcgatacaatatgaaaatatatggatttaatgcgagaataacattgagagctgggagtcagaattcggcggctacctagaaatagagttggctaatggagtctgattttatacgatttctttttaaatacgaagcttccctatgggcctttttcatgtttttattttcatcgttagaattatttttctattgataaataatttatttttgcatctttcaaaagtattttcttcatataatt

SEQ ID NO: 35238 - DNA, 988 bp, Heterodera glycines
ttagtaatcagaacgccaaaacttcgcaaaacttaaaatttttttgggattttccctcgtaaaattagaagagccgatctcgagttaaaaacttaagttccataaaataaacttggaatcgctagaggaggtcaaaatatgggcctatgcaaaatttgaagaaaatttgaacatagggaaaaatttttcaactaggtgaaattttcaataattttaattcttttttagccaagtccacaatttaagcccaaaccaaataaaatttacaatattctccagaattttcccttcaaaatgagcataaaatggttttatttgctctagtattcaccaagttataagctaaaaaaatttcataaaattgtcgatggttgtacgtaaccaacgcttttcgaatatgattttttattgccacgaaaacttttattaatgaaaaaataattctgccttcttctttaaaagaagaaattgaaattaacacacaacatgaggaggacttgaacctgggaccccacagtttggtgactaactcacagaccactaagacgaaaaatctagcataattgtacttggagcccaaaaattgactcgctgtgtaaaacaattaccaaaaataattcaaaagtttccaataattttaaaatttcattaccaaaatatttctctctttttttttttttgctgttgcctttccattttctcacttttatttcttctccggtcgagtaataatcgccgctgatgtgtgtgatttctccaacatgaattcaagttttccatttttattcattgatgcgattgagtggagggtgaaaaaaatgaagtttcgatggcattttgagtaattagtcaatctcagacagttgaaatattttaataaaaatgaaataaaaaaacgaaaggggccttttttggaaaaacggaaaaaagggggggaggggaatgggcaaatgaaaggggcaaaaaaagggggggggggggggggggg

SEQ ID NO: 35239 - DNA, 1006 bp, Heterodera glycines
tccccgaagggagagaatttaattaaatccattccttcgggggaccgtgccgggtgccgcggggtaagcagtgccggttcgtttcatcacggcaccgaaccttttggctagtcagcaatcgtcgcttaactcgccagatcggacgggtggcgcacgattccaccgttccaagcaccccaccaaaagcaaaacgatataaccaaaatataaggaaaaattttttaaaaaattttttctccatcttccttttcgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactccggaaggattcggtctccccataaatctgggcgcatcggttcggggggactcgccccgaaaacaaaaaaaatcgattttttcaagtggtccgtttggggtactcaaacaattatgggggagcaaaaatccaacgcagaattaaagtacaggctatagggaagctactccggaaaggattcggtctccccataaatctgggcgatcggggttcggggggggactgccccgaaaacaaaaaaatcgatttttcaagtgcccggttgggggtactcaaacaattatggggagcaaaaatccaacgcagaaaaaaaagttaagccaaaactttttggtctgtgtagggaggaattaccaattattataaattgactagagcaatcgaacgctaacggacgaccta

SEQ ID NO: 35240 - DNA, 963 bp, Heterodera glycines
ctaatttttttttaattgtttaatttgtattagaggattttattttttatatatcacttttttaaatttcagccaaaaaatactgcctctatgggctgattggtcaatgtttgcaggaaattcacattcaaaatttgcccaatgttttcttgggttatgtccaggcgcgtcttttggagtttgaggtgggaaatacgaaaattttattgaataagccatgccattatttaattcgtatctgtaagggtgccttggcgtacccccccccccccccccccgtggggttgtaaataatgggaaagaattaccaatttactaaaaattttcacttcaccctaccacttacatcaaaaaactctttttttcagaaaacgggtgtcgataaatcatcactgaattttattttatttttttaaatatttttttgcgagaaatcactcataaatttttttttgaaaaaaactaaagctagaaacaaaaattttcagtttttttcttatttcggagtatgcgaacaatggggggcggtatatccgggggaagaagccaaccgctcaagccttataaaaaagaacatgacgcaccaaacaatcttcgcatttatgcatccctttagcacttgagatttataacccctttttaggatctttcctaccaatgtttgcttcacatttgtcaaaatgcgggccaattgttcgaatctgaggaattcttgcaaattgatcagaatttgctgtgtgaattattcgggagtgatcagttgatgatcagcaatgaatttgcaatttggaaagctgtaatttatacttataattttgtggcatttaaatggatttgtttgttttccgtttggcactccgttgggccgacgaaaagtgccgtcaaaatgccatcgaatgttccgctgagaatcgtcgtgctgcgcttggcccggcactgttcaaaattcgcttccctctcatt

SEQ ID NO: 35241 - DNA, 913 bp, Heterodera glycines
actagtaattttccactaaaacaatgtaagtgagacccaacttcgtaaaaaaaaagattcacgaaataggaaaacggaatccaattcgtaaaaatttacggaataggaaaagatcgaatagactcaaaagcgtaaaaatttcgggttttagcacaaaattcggtttttcccccaatttggtaaaaattttaacgaaacgtaattcaaaaccgtcacaaaatttgttggttttttcccaattttcaaaaaattttcccatttaccagtgctttttcgattttggttgaaaattttacgaaatttcctcagacctccgtacgatttacgaaattgatctccccccttgtccatcgatgattacaatggttgaaaaaataaaatggtaatacaaaaatgccgaacctgtgcgtaccgaaattcgttgtgccaacaaacggccgccgagcacagcgatgccagtgcaaatcatatggccaatgattccacccaaaataacgccttaaaagcagaaatttagggaattggttgaaaataccaaccgacaacgtcctctcttgcgcccaaaacaattgtggtcagctgagaacggtcgccctaaaaattgaattgataaaaatgttggaaaatgggaaacgcaactgacccattcagcaagaaaagtgagcgtaaacgatttgacaaaaagcgtagacacaaatgaaatgatacgccatgccgaggaacttgaaaaggtaaaagatgaaatttcgattcggagtttggcaattcaattgccgaaccaggttaggcctgttttccccaaaggccggacatcggcacttttcctgtcctatctgattgtgagtccgtagtttagtgccaaattccgcatattttacctgccgtccgcttgggtcgaatccgcgcccgtctc

SEQ ID NO: 35242 - DNA, 969 bp, Heterodera glycines
tattcccgaaggattcaggtctccccataaatctgggcgctttggttcggggggactgccccgaaaacaaaaataaatcgattttttcaagtgtccgtttggggtactcaaacaattatggggagcaaaaatccaacgcagaattaaagtacaggctatagggaagctactcccgtaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtacgtttggggtactcaaacgattatggggagcaaaaatccaacgcataattaaagtacaggctatagggaagctattcccgaaggattcggtctccccataaatctgggcgcatcgggtcggggggactgccccgaaaacaaaaaaatagatttttttcaagagaccgtttggggtactccaacgattaatggggagcaaaaatccaacgccgaattaa

SEQ ID NO: 35243 - DNA, 1226 bp, Heterodera glycines
atttctgttggagacagagttttactcagaaattattcaggaaaaataggtacttcaaagaaattccacttaccttggaaaggtgtatttagagtcatagacatagaaggggtcagaacaacaatactaagctgtaattcgcctcagtctaatccaagagtagtacatattaaccaacttaaaaaatgcatagaaccccttgggccagcatgcactattcctaagcttgatgatgatgaagaaaaagcattacatgaggcaaatgcaaaggaattaataaatgaaccgggacattcccacaaattaggtcaaaaatcaaattctgaagttgaaaaagaagtagaagaaacggatgaacctgagcaaatcagtccgagatataatcttaggaaaaaaaaatccgagagcaagaaaactcagtttaaataattaattttgctttggcaagtaaaagttcagaaagaggggttaaaaaaaaaatataaataaataaaacagttttaatttaataagaaaataaggaaacaaataaaattattagtgtcgtatccattcagcatgccgactgcgaaagttgtcatatcgcaagatggaaggaaactcgtgccattcttcacatcagcatatccattttccaatcacttctcctgccgatttgtcattgatggactcgaattttcgtccagtgagcaaatgtacatgtgggccaaagcgagcgttttcggagacgaagaagcggcatctgcaattctgcggacgtcaaatccgaaggaatgcaaacgcattggatcgcgaattcggttgttcaacaccactgcttggagacgaataagcatattcgtcatgacctgtgctaactggcataagtataagcaaaatgaagacctgatgcgccatctcttcaattttggtcccgatgctgaatttgttgaatgtacagcaaatgacgtgtactggggtgcaggagtggcgctttcggatgttgaaaaaatccgcgacataaaccgatggcctggtaaaaatatccttggacggattctctcagccttgatgaagaaattcctgcgtaagaaatctggtgaaatgaacacaaaaaaaaaataaaaaataaaaataaataaaaaataaataaataaatccaagattttttttaatattacatataataataataataatttaattataattatattaaatcctataaattttttcaaataacaccg

SEQ ID NO: 35244 - DNA, 836 bp, Heterodera glycines
attaagcggcgaaaaaagccaaaaggggaggaatttgaatggaacgcgcagactctgtgacggcctctgcaaattgggagggaaagtttttgagggcattggcaaacggaaaagcgtaaagagagggagggataaacgcactattttaaaatttaggggatgaaaatggcaaatgttgaggggggggggggttaatggagtgggagaggcgccggacggagcgacgatgacagtccgacctccccccccccaccccaccaatgccatctttttttacgccggtggcaccaaaaatggatggcccgtgggtgatgaagcagggaaatgggcaagaaaaagagaagcaaggcgactggtgagttagacggacagataggtggaataagcctaattggatgcagtgggcaggaacagcgcccacagggaaacgaagggaaaggggggggaaggcaacggagacgttcattaatgcctatttttgcttatttcggatttgagcttcatgtgcctattttggactttccaagaaatcctcaacaaaaatgaaaaacccaccccaaagaattgatccggaagaatttcctaagaagtgtgaaaaatttcccaaaagattgacccgcacatattacataaaatatttcatttacaaatttgtccttatttgcaaaaaaacattaaaatatttactagtttcatttacaattcaaatatttaatttgtacttgttctactattaaaaagcggtaacaaagattccacagattttatggtggcctatcttgtgcctatgtattttgccattgtttctggctttgtctcgaacccattactattat

SEQ ID NO: 35245 - DNA, 139 bp, Heterodera glycines
ataagtagcagatggctaagcaaccaggattagattttcaaagtgctaaaggcgggctcggcgagctgaagcgcagacttttgtttgtaatcggcgcgctgattgtcttccgtatcggctctttcattccgattcctgg

SEQ ID NO: 35246 - DNA, 1013 bp, Heterodera glycines
  misc_feature (25)..(25): n is a, c, g, or t
  misc_feature (917)..(917): n is a, c, g, or t
ttattagaaagcgtaaaatgtatantcatttcttaaaaaaacaatatacttcaaaaaagtaaaataaatattaataatgcgtataaaaatgaaaaaaaaaatcaaaagaccaagcattccaacagacgccgaagttttaatcaatgacataattttcccgctttatattatcaatttctcgccaataattaggcaatttttcacattgttttgaacttttaaggctcgtacttggcttttttgtgaaaaagtatgtgtaatgctattcggataagtgggcaaccaacgaaaaataaattttacaaaaatttttaactaatttatttatttatttcggacgggcacaaaccccgtgggttgtcagtcgcggacagtctcgaattatcgggttgttcaacatttcatcaatgtgccaaaattttaaggtagaaactgcaggaattgtcctggacaaagcgatttgagacgggtgtacgacttgcagaatgtccaaataggcgaacatcttttaatggatggtgtcatttaatttaaaaatttatccgatttatttgaaccgataaaattgggaatttaaaaataactaactcaattggtgctgagccgttataaaaaaaagccattaaaagggccttataaaaaacaatcaaatggaaattttcaacaaaaaactgcccttaacttttgtcaaatcaaccaaactaaacattcttggaatcattcggtagccctaagaattctctattagctaacctaaatttcaaaaaatttggttgagcaaagttatgaccaaaattacccaaggaaacgggttttcaaacatttttggtcataattttttttataaatgacatgcaccactccatttactttaaatttatttaaaatgtataaatatgacacaaagttttcaaggngaaattgccctagccggtgctgaaaatttgacgctgggtgaaatataaataaaaaagcagacttttaatgtctgccttgccgtctacgtcagttgg

SEQ ID NO: 35247 - DNA, 1693 bp, Heterodera glycines
  misc_feature (16)..(16): n is a, c, g, or t
  misc_feature (29)..(29): n is a, c, g, or t
  misc_feature (41)..(41): n is a, c, g, or t
tgtggcacaaggaatntaaatgcctaatntattatatattntaacaatttattttttaatttatgattttaggtacccacgaaatgatattttgcttgtgaaggaaaatgaatttgattacggaactccagtgaaaatcaacaaattagttggctttttcaataataacagaaaataaatgcaaaaacgaatttttttaatttaaatttttatcatggaatgcatttttaatttttttttccacttttttgcgggtagcattttatgagagaagcacgaaaacccggaaaacatctttagacgaattaaaagcatttaaaaattcctttggcacttttagatttaaacacttaaaatcatttcctgattgttatattgtggttgagtccttttgtcatttgtaggatgggaatttaagtcaagaaaaatctccaaaaaatcgacttaaaaaggcatgaaaaagtcataaaaaacgccaaaaagtcacgaaaaatgcaaaaaagtcatgaaaaaatagccaaaaagcgacataaagccaaaaaacactaaataaacccaaaaaagtcttgaaaaattaggcaaagtaattaaaccaaaatcccctgttttaacattttccgaatagcaagcaatttaaaaacgataaattttaacgaaaaaatatacatttcaaaggcattactccgccagatttattattatttttcagtcctgccatttgagtcctaatgctataaaaaatttcagtaccgtttcgaagattgactttttttgtaattttcttcattaaaagtcaaattttaccttaaaaagtgaaaaaagttacaaaaacagaaaaaagtcataaaatcccaattgggctaagaaatgaatttattatattttacaaaataattaaatttgattccccctttttttagtttttggcactcagttcgccattctttcacaagttgttttttgccaatcaagatgcttcttcttcttcaaataattcactcagttacgagccaattgttcagcttgatcccccgtcaattccgctccattttaagcaaatgattcagactttgcatatgggagatttcgttttaaacggttttaaaaaccaaagttaaatttttaattggatttccagataaaaacattgaaaacattcttcgtgtggcaaatcgttttttggttgaagaaatcgaaggcatatgtgccaaatttctgttggactcaaattcgaagatgacaaatttgggacgttttcgcattgcttttaattacggcttaaccaacaccaaggcattattattatataataaacaaatattataaaaaatttatcgtcaattaaaattttatttaaaagaaactcttttaaaattatgattaaatcaaaaataattataaaagctgcaaaccttttttaagatatttaataattgtaaaaattttttatagcatttaattttaaatcggatgacccgcggcgatttttctgagggaaaaaattttatggagctcttcagtgaaatggaaatgcttagtgaagaagcgaaagaggaacttatgcaccgctatcaccttctttttcccggtgcgcccaaagatggcatgagaaaaaaacaaaaaattgccgatcaaatcgatggtgtttaataaaaatccaaaagttatttaacatttgccaaaaacgatcgaa

SEQ ID NO: 35248 - DNA, 617 bp, Heterodera glycines
agtgtcgcattttcttgaaatgaaaaactttctctcgatgtcggattttccaccggtgtcgcattttcagggagccattttatgataccaaaattgttaagattaaccgttattagacaaagttacgacaaaaaacactttgaccataaacatatttcccatactgtaagacaaaaggctcaaattttaagatgttgacgccaaaaaaaagtttaactgcgacgacaaatagtttgaaaaataattgttttttgttaccagaatttccaacaaaaattgaaatggtaaattttttgaatcgggaaaatcacaaaatattcaaaaataagacaattagagaattttagtagaagcacaaatcattgaaaaagaggttgactgcggggcagggctgctcgcaactggatttgcaattacggaaatccgtaatccgtaattgcggcgattttctcagttacgaaatccgtaatttcgggggtccaaaaaccccgtaatccgcaatccgtaattttcaaaattttaatttttttaatttaaattttatttaaaaaatcctataaaccttataaaagcaattaaaagcatattaaaaagtaaatttataaaagcaaaatcat

SEQ ID NO: 35249 - DNA, 663 bp, Heterodera glycines
ttttcggggtcgctgatcacgaatccggtatccatttcgaataccgaacccgaattcgaacaaaaagtcaaaaatcatttttcaacaaaattcacatttattgtacaggctactttaattaaattaattatttttctaaaaatttattcattaaataaaaaaaaaattaaaatcgggccatatgtataagagcctgcaaatcgcaagcgctttgtctcgaggtcttatgaaaacgtgccaaaattccaaaaatttttaatttaagattgaattgttcctaattaatttgttgtaacttattacgaaaaaagacaatgttttggagtacaattgcatcggaagaaagagaattggacaaaaaattaaaggctgaagacagcgatttgaagactattctcgatgatgttcattgtttgcaggaaatacgcaattcgcatgaaccccttataaaattgtaaatagttttttttattgccccaataaatttattttacagccttaagagggaagacatcttcaaacagttaatcacagccattttaaagccaccttttgacgatggagacgaaaaagtggaaccaaaagataaatatcggttgtattttatttttatttatatgtatttctgtttttgccttagatttgttcatctgtgttgtgaag

SEQ ID NO: 35250 - DNA, 1088 bp, Heterodera glycines
  misc_feature (1058)..(1058): n is a, c, g, or t
tttatataaaaaagatttatataaataaaaactaaaaatcaattatgcatgcaataaaaaatggtagcgaaactttgttctaaatctctaaatttaatgtctctaataaaaatctaattgtttaaaaatctttagtcatacaatgcaacaacacaaaatatgattaaattcttttacaccactcaaatttgcgccatttactgcgactttaagaatatctgtgcaaaataaaagtaattaattcttaaaaaatatttgatttggattctttttaattacaagataacatcgaattaaaaatgtaaaaaaactttatagcaatatgattaaaattaagcatataaaatgatattaaatttgtcaaaaatacctatggaattcaacgttaaaggttaaaaggccaaagtttataattcataaatgattaacagattttaaagcagttcaaaatttaattaaattattacaatgagaaaaaatgcattaatttatcatttaaattaagttgaatataaaaaatcactaagttacttttaaaatattaaaataatatcaaaaaaattttcaaaatttttaaaataatttaaagttagtttaaaatctcttaatatgaactcagcaatattataattaagaaatattcaaataacataaacaccattataaagaataaaattatattttaaattaacttaaatttagcttcaaattgtctgctgattataaatttcataagaggaattttattttattaaatattcataattgattaatttttaacttaatcttttaatataattcgtgcacaaattaccatttaatgccagaaattaaattaaaaagtatattataaaacgaaaatttaaaatgaataacgaattattaaaatcagtaaaaaatattttatttgtacataatttgacagcaaaaattttgcttccaaaaagatattaaaaaacattcacccagaccttttttttgtacttcggcaccaaaatttttaatctcttccgaaaatattttaagaatcagaggaaatgttataaaatgagtaatanaggaagaaatgagtaatacagggcaaaaag

SEQ ID NO: 35251 - DNA, 1033 bp, Heterodera glycines
  misc_feature (39)..(39): n is a, c, g, or t
  misc_feature (66)..(66): n is a, c, g, or t
  misc_feature (106)..(106): n is a, c, g, or t
caaatgacgacaaatggacggggacggagtgaccaaggncaacagcagaagcaatgccaaaatacngaagcattgggcgatcagccgcagaaaagggacggcacgnccgaaggaggcggaaagggcgcaatttgtgggggagggacgggaggcaatcttttgtaagagagaggggagagataattaacaaaatagcgttacatcaatttagggacattttgaatctgttgagcaaaagagcggaagcggcagcatcaaaggaaaaagggcaaaaggaggagggagagacaaggggaggacgagagacggaagaggagaaaaagactgtgaagagaaagtgcaatgtcaaaagagagtcagatgaacagcagccacaagggagacagtggacggaagacggacagagaaaggaaatagtggaaggaagagaagaagaggacgaaactgcgatggacgaaggacaaacacagacacatttgaaccattcagtggaacacattctgaaggacggggaagagaaagaggaggaagagttggcgaagaagagagcaaagacggaagagaagacggaagggaaaacggaagagaagacgcaagagagagaaacggaagagagagaaacgaaagggatggaggagagagagaaggaagagacggaagaaatgcaagtggaagatggatatcactgtgccaacagagaagaaagtgccgacttccgactggatcaaatggacagatttgcccttttccttggcacggcttttcctccagcggcgttgagacatttaatgaaggaaaatccattttttcgcaaattttgttcatcgttgcgcgcagataatgcacttacatttgaaagtgtaaacaaagtcagttttgagttcctaagtttttacaataaatttcaatttcagttaatggacactcattttgctcgaatgaaagacaaaatccggcgaaaattggcacatattcaaagttcagttctgctggtggacatccgttgtggccgttgctggcggcaccgaaaaaa

SEQ ID NO: 35252 - DNA, 1480 bp, Heterodera glycines
  misc_feature (91)..(91): n is a, c, g, or t
caatcaaacccaattaaaataattaaaaccaatcaaagcaattaaaaccaatcaaagcaattaaacccaatcgagttccctttccccttcncctcgcctccacccgttcttattcccctgtccccaattttactttacacttttcgtcgtctgcttccctcgagggaaaagaaacatcgatcgacgaacgaccgactggtgtttgatcaataggagagctctttccttttcatcacatcatatccattttgggaccaaaaagtggcacaaacaaatgccaaccccaaaaagacgtaaatcacaataattatgtgtcaattagcatgggtttgtgtggtcataggtttaaaaaaacgtttcattactaaattatatttttctatttctttttttcaaactaatgatcatttactatttatcttaacacttaaaatgattagcttgcaaaaaaggactaatgagcaatggacaatctctcccggcaccatttgtcctctgatgagtgaatgaatggccaatgtttattcgctttgtccgtcgttctctaataatattttctcgtcctttggctcattttctgtccctccccccatcttttttgtccaaatgacctttcattttctgatttgtcacttcgttttccctccaattttccaaaaatgtgccaattttctctccctaagttttgggaaacatttctttgcctttctttctgttttcaaacggttctctttaaccaccgccaccataatatatgcaataattcaacttacaattagctggagggagagtttattgaggccaattcgccgtagacgacccaaattggccaacgacaacgaaacgacagccactgaatccatttaaaagccgctgcgagtgccatgttcttcaccattccgtttttcctcgagcggtaagtcctaaatcccggccttccgtcgaccatttcaattctcagtccgatcactctctcatcccttcgtcttccctttcgtttgttcgtctgttaagtttttgctttatctttctgctctctgtcacttctctcatttcatttaagacttttcctgaaaaaactatcagtttggtcaatcataaataaatccactgaaaagcctgaggttcggtttcagtttagcaattcattttcatgcgtttttggggctcagaccatttaaagtgttcaaatcattctttcgtcgatcactttactctttctttgtcgcttctgatcgcttcttcctgaacttgaaaaaaaaaattgtgccgctgctggctaaatgcttttgctaagggttgggttaatgtttttttgggaatgtcttcccctgccttaccgtattcgctgtccccttacagtatgctcgaggatcccttttctccgctcactttgctctccatctccgccattatcactaccattttcgctgttcttctgcggaatgtaaggacatacgcatccatcactttttaattt

SEQ ID NO: 35253 - DNA, 1228 bp, Heterodera glycines
  misc_feature (152)..(152): n is a, c, g, or t
  misc_feature (179)..(179): n is a, c, g, or t
  misc_feature (1086)..(1086): n is a, c, g, or t
aaaataaaatttactttttttggtcgcatgtgacgatgttcaatttgtaaggacattttattactttttattaataaataaattagtgtatcagttatttagtacatttataattaaatattttatgattatttatttataaaataattttntaaataaaattcgttattatctttttntcatcatgaaccaatgtccaaattatttcttgttccgctaactttattttttagaaatgactttttatgatcctaaatacttttaattctaatcgtttaaacttcctactctttttctacttaatttcaaagattggaatttttaatgtttttaattttccaaatctattttaaaatacctttaattgtgttaacatttttgtagaaattttttcttatgcgaatttatattttttttcaattaatattttttcaagtttttaattttgttatttcacttcttataatataattaattatattaatgtatttagattaaaatattcaaaattgtgttttatatttcctttatttcttgtttagtgcgcttgccttcacatggccggtttcatgatattaattttatatttttgtctcaaaaatttctttttccttaaaattttgcccttcacaagcttcatcaaataggagttaaaattaaaaattatttatatttaattatttatattaatgtttcatttagaagatgaatgctgattctatgcatttattaagttttatagtttttaaaccttttttatccttttatttcgctcattttatattttgtcgcaaaattttttattccattaaactttttatactcattagtaaatgtggatttcaaatttttataagagcacaaaaactcaaaaaatttttggattaataataattgtaatataatttcaataataatttgttttaaattgttttatattcagaaaaatatttttacatttatcctatgtaattattgacttttacgttaaatcaaaatctattcatataatttgcgtcgttcttatgatacaatatttactaccataaccattttatttgtttttaaatttttgtattttaatanatgaatacgttttatttattcttatgaaagaacaaattatgtgagtcatattttggtattaatttggaaaattttactctagctaccttgttcaaatccagcataattgatatcgggacataaaaaggcttttgttgcatta

SEQ ID NO: 35254 - DNA, 658 bp, Heterodera glycines
aatactcatagaaatcgaccaatcttggcatatttgacaaaatacatatagaaagaaaaataaaaatttaccgaaattcataaatttttttggtgaaaaatcttagaaaatagagcttaattccaaaatttagcgctgcctatcggcatcacagggcccaaaaagtcataaaccttattaaaaaaattggcgcaaaatcgcaaaaatttagcatattttggacaaaatctgttaacagatctaaccaaattttcaaaattttcccggcggcgcctatcggcaccgccggacgccgtaccctttctccttaagtctttagaaaagagcgacgtgaaaaaagatgttttggaaaacaaaaaagtaataaaaattttaaaatttcaagaaaaaaaaattaattctatacaaaatttctgataaaaagaaataaaaaaatataaaaacaatacaaatattattatggaaattaataaatattatttccgaaaaaatattaaaaaaattttgactatttggcataaggcaaaaattgaaaaaccccgaccccgaccccgaaccccgaacgatttggcaaccccgaccccgaaccccgacacttccaaccccgacaaccccgaaccccgaattttccaaccccgacgtcggggtaacaacccta

SEQ ID NO: 35255 - DNA, 1498 bp, Heterodera glycines
agcaggaaaacacaattggagggatgcgcgagcgtgaaacgactgctgcgttggaacttcgccaaagggatgggttggtggacaatttggtgaaggagagggctgaactcgagaaggaaatggtacggacacgcagagaattcgaaagtctgctggcaagacaagagcgggagacggaaaagcaattggtacgccatcaatgccttccttacctcaacggattttccccgaaaatattttgtttttcatcgtgtaacgacccccccctgcacagctatggtttacataatgaaaagtgccgaaattcactcactctacatgctcaattgatactttttcctcaacttgcaattcgtttctttccattttaatacaggaggagaagaggcaggaagtggttgctgagcaaagggccaaacatcgcacagaaattgaacagctccgtgtggtgattcgtcaacataagtcagactttgaggcggcaatgcaggcatcgcggaattagaaactttgtttccattttttgttttaggaggcattgcgcgaaactcaaaaattggcggctcaaagggaggagtactttaacaactggcgtcaacttgaggagaaattggaccaatataagcaaaaattacgttcgactttaagcagaaaaatggttgcaaaatgcaggtggtaccaaattaaaaaaacaaaatttatcacaaaatgttgcagtgaactcgttcgtgatttgaaggacatcggaggtgtgtattgaaattcgcagggggaagtttgggctccaaatcgggaattaaaaaataaataaaagtattaatgcttttaaaaaggctatatgtttaatttaaaagcatagtaagttgaaccaatacggaatgtaaaatttttaaggaaattatctgatgaaactcaaaattttatgcttttaaatagcattagacgggtctctatattttcgggtccctataagccgggtattcgggtcatacctgtgcaagggggaggggtcagccaagaggtcttacgatcgactttggcccccccccccataggggggtcagagcccatttccattacgatcgaccattttttcaaattttttgcctgctgaagatctttttttgcttttcgggtcaaaaaaatgttcttcgatcattttaaaaaagttgagtgtaattttgtaaaagattttcaccaaaaatgaccatttttgaattttaagcctacttttttaataaaaatataggattttatagaagaaagggaaaaattgaggttagtcgatcgtagaaattttttcaaagcaggcaaaattatctcttacgatcgacaattttcctcacaaatcggaattagtcgatcgtaaaaatttggaatttttaatgacatttgttaagaaataaggcaattttccgaattgtctataagaaatttttgattaaaatttcttttttcatagttacgatcgactttttcgctgacttttctctctctc

SEQ ID NO: 35256 - DNA, 739 bp, Heterodera glycines
ttttggcattggcacggcggacaaatgtacaaatgggtggacaaacaaaaaagagccgaaagaaatgcccgagggcaaataatccctcccccaatggcacaaaatttcaaaatttgtgtgcttttggcaataattatttgcctttcacaaacaaatgggcaaatgaagtgcccttaaggggagagacaagaattgaatgtgatggcaatggtcagccgaaaaaatgccgacaaattcaacattggaaaaagtccatttgtgccctaattgatttggttgaaatgtaataaaaatgaaataaaaaatgtcatttaaaagatataaaatccattatttttatttattaatatcaagtttaattatttcaaaaaattataattaattttacccagaggaggaattggtgagaaacggcaccacaggacagccatcactttgctcaattgtacatgatggagcgttgttcagagatagagaaggaatttaattcaccccttcccaaccaaaaaaatcagatcatattccaatgagcgaccagcagaaatcgctttgggtatacatataaaacacgtagaattactgcgaaatgagtgcgtgcttaaacggaaaattagtcataaccaacaaaaaaggaagggtcccggatgtccgtgggatttccgaatggaatttggtgggtggatagagcacccatgggttcttcagaaaagtgtttttattttttgctgaatgagcccga

SEQ ID NO: 35257 - DNA, 483 bp, Heterodera glycines
tccccccccccccccccccctcctcttctttttttttttttttttttgttttttttgacgggcaataaagtaaggagccgaacaaaaaaaaaaaaaaaaaaaaaaaaaaaaaaaaaaaaaccttttttttttttttttttttttttttgggggggggggggggggggggggggggggtggttataaaaaaaaaaaaaaaaaaaaaaaacccgcgcgggggggggggggggggggggggggttttttaaaaaaaaaaaggaaggaggggagggggggtgggggggggagaaaaagaaaaaaaaaaaaaaaagagtgtttttttttttttttttttgggtgcgccccctccccctcccccccccccccccccccccccagataaaaagaaaaaaaaacaaattaataaaaaaaataaaaaaaataaatatttttttttcttctccccggcggggggggggggggggggggggggggggggggggg

SEQ ID NO: 35258 - DNA, 929 bp, Heterodera glycines
aaaaattatttttgattccattattttattagtattgtgtactttttttgactcttaattaatttaataattaattgcctttatttcttttatcgatcgattcgccctttcattttccctttttaatccgaaatattttactctatcccaataaatcattgggctgcgaatttcccatccgccaacgcatttttttttattcctcggctaaaaggacgtttttttaaattatcgaggccaaaagtttcttccaactgacaaatgaatttgcccatttcccatcgaaacttcggcggatgggctaattcagttgtgagcttttctgacaaatttcacgattttttcacaatgattcggtcgatctttgtgatcagaaagtgctatagggaacagctgttattagccaatgggaaatcattttggattatgcgattctcaattggcctaaagatcatttgaaagaatgtgccgggggatgatggccatggattaattggcaaattgagaagggacaaaaaaaaagctgaaaaaatgcaacacaaactcaatgactgacttgttctggatgacttttgcaaagccaaaatccgtcagtttgatgtgtccgtggatgctaaccatcagattttccggttttaggtcgcgataagcctaaaatttgaattatttgtcgattaaatatttccgttttgccacgatgttacaatttgtttggaatgaagatactcaagtgccaaaatgatctctgctgagtaaaatttgaccacagtgctggagaacttgcgcaatgctcgaaaataggcgaacagttcgccgccgggcagaaattccataacatgtacaaattggcacggtctttggccgtgtcccaactgaaaatcatattaggcatttaaatatttaaatgattgtcattaagctcacagtcg

SEQ ID NO: 35259 - DNA, 802 bp, Heterodera glycines
aaagaacgatttcacctgtacaacactcattaataatgcagcatatttctccgcttcgctgcgcaacaatttttgtgcctgatcactaagccctggcgaaacttaaaaaatattaaaacatttaaaaaatggagggggtcatttgagtgcggcacagtttaagcttttctaaaattaaaatatcaaagttaggaaaatcatattttaagttttttgccataacatttatgtaacttaacgaagttttttgatattttcagtctattagaaattattaatgccttcgaaacaatatcaaaattatttaatttggttatttaaaagaaaagttacaaaaaattaaactctctctttgcactcaaacgattcggttcgaaacttaaagcaaaattaaatgaactcattaaaatttattgatttttttaaaattttgccattgcagacccatatgtgagtaaatgatcgcccgaataagtacaaattcttcattgatcagttttaaacgggcaagtggctgcacgacattacgcatcattttgtcacccattctcatgacactgaaatttaaaaattatcaaattaaatcttaatttagtaataagtttaataataataataattcactaacactgaatcctgcttataaaatgaattttcggccaaattaactagcattatgccatctggtgtgcacagaacgtcacacctttgttgcaccgaatagaaactgttgcacaacacatacaatggcatcgcaatattactgcacaaggcaatcttttcaaagggaattattatataa

SEQ ID NO: 35260 - DNA, 1228 bp, Heterodera glycines
tatctaacaccgccgtaatttcaaccataattaattcacaaattgtcagatgtctcgtggacaccggttcaagtgtcacggtggcgtcaagggcgctgatcgacattcttggctgcaaaacggtaccatcgcatgaggacgcaatcagcgcaagtggtcacataatttcatttcgtgaaaaagcaaaggtaatgctaaaagtggcagacatttgtgtcccaattactatttattttgtaaatgaacaaaaatccgtctgcaaccgagactatcaattaattcttggatgtgattcactccgacattttggcccctttaccgtagacatagagaaaaacaaaattcaaattggaacccaatggataagcttaggttcgaaaaattatgaattaatgaacaatattcgagcctttgctgccgaaaattacacaattccaccttcaagccaagtaatgatcagagcaaacattaaaactgccttacagccaaaacacagcttagttgtggataagcccgatttaaatttgctaagcaatgaccttgggattgtaccaagtgtgtcggctccatttgtggaggatatcccgttgacaataattaatccatcaaatgatcctaagattttattcaaaggcatgcatttagcctatttaaacgaaatagtcgaaaatgatggaattttctacgaatcagaccaggagaaaattaaaagcgggaatcctgacccaaatggattaactgatccatcattcaaaattgacctctcaaaatctgacattaatgaaagagaaagagaagcacttaaaaatcttttagaagaatttaaggacatattttcaaaaagtcaatatgatttaggctcattttcaggtggcgaacatcattttgacacgacaaccgaagctccaatttcttcgccgccaagacgaatgccatataaatacagagatgaattaaagaagcatattgaacaattgcttaataaaggagtaatggttgaatctgagacaccatgggtcaccccttttgtagtagtacagaaaaaggatggtggaattagaccatgtttagattttcgaaaattaaatgaggtaatgatacccgaccgatacccactcccgagattagactcaattatggaaaaggtcggaagttgcaaattctacagtagcttggacttatcctcaggatatatgcaaatcaaactcagtgatgacacatcatggaa

SEQ ID NO: 35261 - DNA, 810 bp, Heterodera glycines
  misc_feature (19)..(19): n is a, c, g, or t
gagaggttaaggatggatntagtgaaatattgttaaaagcgaattagtaaattaagcatttggagcccatttctgcagcaatgagttccattttgggaatagtcaaatttgttcctttatgtttggttttaacttttgttttggaaaaaattaaaaaacaatcagaaaactcggaattgggattggaaacacataggaaaacagcggcacacatggcgagatttgaagcatcggaaaaacaatgtaattcatatgatagattttgaagggggagagtgaggggatttcgggggatttcaattttctcagcgggtacccaatttttaaaaagatgattccattcattttgtgaatttagtgtaattggttggtcccattcgacagattccacgcaaagagtttgcataaaaatttttaggggaagaattacgggggaaatgagtccaagggggtcaaaattagaagcaataaaagacaaaattgaccttttagtacataaattttcagggggtggtgatacggttaacaaaaattgtcatttagagtgttccatgatacaccaagaaatttatgtatcgtaccactgagcatacggtcattagggagatcagaaattgcttcggacgaattgctggcaaattcccttattggtaatgacacagtttcaaaaagggaaataacattcgaaatcttatttttaccaaccaatgggtcatcacaacatatcaaaaggttatcaacgtaaatatttgacaatatttcttgggataaatgggacggattagtggttagatgataacgaattatggc

SEQ ID NO: 35262 - DNA, 847 bp, Heterodera glycines
  misc_feature (815)..(815): n is a, c, g, or t
gctttccagggtcgctgatcacgaatcgggcatccatttctacctatttcaaacgcggacccgaattcaaacaaaaagtcgaaaactcacaaaatttcaaaattcatttttatgatcgaatctgtgcagaatgattattttttggtgttgcaatggtttcagttaatttttgtttttgatcccgaatactcagccatgttccatgaaaccaaaccttttgtggagagctaagcccatcaaacggaactattctcagaggattgccgattaaagcatttgatgtttggttcaaaaaatgacccaattcgtttgtacaataatagagcaatttgcattctcctgaataggtaattattatttgaaaaatacaaaacatagtttaataagtatgtaacctgttagtttgaacggcgattccaaaatatttttgccattattagagaatgaagaagcaaccatgatttttgtgcaataaaaaagcttttaaagtttcaactcttacttgttaggtatgattaatatctaaagattaattttgagtttatttaaatttttataggatagataataatcagggattctttttttatgtaagaaaaatcgcgaaatatgtacaaaaattcccaaatatgtacgaaaatatgtaaataaaaatttttttaacggttatcaaaaattgcaaaatatgtaggaaaaaatggcgaaaagtccaaaatatataaataaaagtcccgatttttgttcgcaaacacaaaaaagaaagtgtttttcctactaattaacacaccgtttcaattttggcctctcagttccanaaaggtttgcatgtgtggcgaagtggtttttg

SEQ ID NO: 35263 - DNA, 1034 bp, Heterodera glycines
ctagagtgccacgggaccgggaattttgggcagacccgggaccgggacctttttgggttgaaaaaccgggaatttttggctgggaaaaccgggaaaaaaccgggactagtcccggtcccggtcaaaaccgggaccttggtactcagttgtactcagttgtccgctaccaggtcccggtcccgtggcactctaggaacaaacccttaacctatccgttttttgactataacttttttttctttcatcgaaatccaacaatcttggtatcatttgaaagcttaaaacatgtttagaagttgtttcaagcgatcgcttcccgattcaacaattaccaaaaaaagttataaattgaaaattgcaaaagtcgaaacttttgaaattttttctttataacttttttacagactagaaaatctttttgctttttgtaattactaatagagcatgtgaagggcttttgaatgataccaagattgtttgatttcgttgtaatgaaaaaagtggttctagtcggttttacgcgtcccatgacattttacgcgtcccatcacatttttttgtgtccatggcggggatggcattccgaggccctgaggccacaaattttcggaagtcggaattccgtgccatccctaactaagaggaaacctatttttttgtcgtgtatttagtaaattttcaactaaaaatttcgttgctaaaccaaagtatcatgtcaactcatacacaggcaactcgatcaatggcttagactaggcgtaggcttttttgcaaatttcttttatgtgtttactgactgttgacatcaataagtttgcttagggttgcttttgcacatttcgataatcaaagtatacaatcaagaacaattagacgattcggaaggtataaagttttgattgacggttcgaaacaagggtaatccttcggaattggtgtcccgaggggaaaaagagataaaaatttttgtgcgcgtaaatgatgggacgcgtaaacagttgttgggacgcgtaaaatgtgatgggacgcgtaaa

SEQ ID NO: 35264 - DNA, 1005 bp, Heterodera glycines
agaggattttatatttagagttatcccagaaaaatggctatctcttttttgataattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggatatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcaagcatgatagggagggcggtgcgcaatagaccttttatt

SEQ ID NO: 35265 - DNA, 367 bp, Heterodera glycines
aagttggaatgtaatgagaaaaaaaatgggttggtgagtgaatcaatcaatttgtgtaatcatatcgtgcttttgatgtccatgtcgagcagtttcggtggacggcggttgcgattcgaccgtctgacttcgttctgttcaggttcgtttggaaccggttgcttttcagcaggttgttcgtctgcgaaacgcacgcaacgttgacgctgagtagtgttcggttctgtcgcgggttcttggtgaacaatttgaagatgttgatgcgaaccttgggactgttcgggaatggggaaaaagtgacgcatttgattgctgtgcctacgcacaatggcatttaaaattggtacttgaactttccaaaccacac

SEQ ID NO: 35266 - DNA, 1308 bp, Heterodera glycines
taattcctctttccctctctgatcagtcattggtcatccttctgacactgtgcatcgattgatcagagtttttgatcagtcgcaaaacaatgcattattatgataagcatggtccgctaattaattaatgatgccgactttaacacagtaaaaagcccatttctctctctccaaaatgctttttcttttgctttccatcactaaaatcgtttcggctgatcagaattcgaattggcaagaagcgtatgccgagaatatggccaggtttcttaccatcgcttttcccattctttcccaaatttcgtaaatttattttcttaagattttccgactatcacaacgattgcgtccatcgctgcgacgatcacttttggcgtttgtccgaatggctcgcgggcgtcgccgcctcctccgtgtccgcttacggtggcggcgtgcccgcgcgtccgtcggcaatgccgcgatggaacgcacgccacgcggacttgaagcaatgcgcggatgcgacgatgccggaggaagacgcacccgcggggcataaaaagcgaagcaatgggacgcggacaaaaccggcacccctggtgttgccaattgttcacggcgacttcaattggacaaaggacggaaggaccaaaaacgaagccaacggacaaccgatggagtgggcaaaaacacagggggacaattctgatcaaaatggatgaaagtgatcgaaagacgggtccaaaatagcaattgtcactgatcagcagaatttccattcattccccaacgacggcattgccaattgaaagtgccggggagaaaaagcgactttccggggggggggcaaaagtggcatttcgtagatggcctttgccaattggccattctttggctcagaatgcaaccgtccgttacgctggtcatcgaccactcctctgttgaccatcgtcccaaagtgctgcttgtcgacacgggccttccctctcatcgtcaagccgttctttccgggtaaacttttcgtccattcgttggcccattcattcatttgaattgctcccccattttttggtcttttatggcatggcattgcgccacgccgtgtgagtaccgtcgtcaccacccatcccgacgcacattccatgggcaacctcaacctgttcccatgcgcggaggtctgtctagatcatttgttttctgcttacccaatttttgcgcttcgctttaattcagatccattccggcaccgccacttttcgtgccaatattctccggcctcagtcggccccttcatttgtaatttgtttaatttatttgcattttcct

SEQ ID NO: 35267 - DNA, 1262 bp, Heterodera glycines
ttcggttaagaatgtccatacatttgccaagtttatggacgatctttatgaggaatataagaagcatgatgaaatgggtaaaagttgcactttttgagttttaggcgttcatctttaatatgagcgtattttttagttcttaaagtagtaccaaagatttatttgagcatttttcgagaaaaattggtttttgcctaaaattccttagcaaagaattaataagaaccgaaaaatttaccaccaagaatcgaactactctctaaaaaattggctttttatcaacaaaatccatggaatttactcatttatcatttaattggagagccccgtgaattttatttaaataaaaacggtaataaaagaacaatattttcagactcaattgtatatcgtgtgtggaagaatcgaatagaaaaatattgtgcgaacaaaaaaaggacaattttcaatttgacatttgttaaatgtgcggcagaaattgcccatttccgagtgattaaccaaaacaaaaattcaaaagatgcttatgtgaatttaaaagttgtcccagataagtatttgcaagatggatttgttggatttttgcattatgacaaaacacttggccaacaaattgctgagaaatttgaaaaagaaatcttttctaacaaagaacaaattaatgaaagggtggagaaccaaattatgcaattggccttctcatttgcagcccgggtgatcctctgcataatgtaagcgctttattaaattctaatgggactgtaattgtagcaattagctgtgggcgcttttttttgtaaggaatgcccgtttggggtttttttgtaaggaccgcccatttacgataattgactcgtcaaaataataaaaaaatgataatttataaacgtcaccggacgactttttgatcataatttttttcattccaaaccaatcaaaatttgaccaaatgtaataattttcaaaatttaaaaaattttcgtttatgtacaaaaaagttataaccaaaatactcaaaaaagtgacattttctgcccgttttagccattgattttttgtaccttactaaaatgaatttcgcaattgatttttgaatgcacacaaattttgtgcagctcgtctaaaaaaaaattattttttaatcatttttaaattagctaaaaaattattaaataaaaaagcaataaattattactttaaaaaattttcacgacacataaaatatgagtattgcagatacggaaggtcggaaggttttgact

SEQ ID NO: 35268 - DNA, 622 bp, Heterodera glycines
  misc_feature (608)..(608): n is a, c, g, or t
  misc_feature (616)..(616): n is a, c, g, or t
ggtcgtttcggcgcggcgttttcggcgcagccgtttcggcgcagtcgtttcggcgcaagggtcgtttcggcgccgccgtttcggcgcaagggtcgtttcggcgcgaaaccaaaattaaaaaacatgatcgtattaagttttgagtagagtgcgacgggaccgggaattttgggcaaaaccgggacttgccgggacctgagaagccgggaccgggaaccgggactttttaaaaattcaaattttaatttatttcaattgaaaataacacaaaattaaatttttattttgttttttatttaataaaatccaaaagttaaagcataattaaattaatgaaaattttcaaactaaatttatttaaattattttaaaaaataatcatttttggattaaatggtcgaatattattagaaatttatattacttttctgatcattttttcggcgctctttttgcaaaaattcatttaaaaaaaataataaaatatatgagaaatcatattttgtcgaagggaaaccataagtatacaaaaagaaaattcaaaatattttaatttccgtaggggattgaaccaggggaaagaagaaaagaaaagtcaaggggactanccaatagnccattt

SEQ ID NO: 35269 - DNA, 1267 bp, Heterodera glycines
agaattaattggtgttaattgggaataatttaatatttgtgattgattttcttattatctaaattgtgatatttcctattcaatgtgattttcgtgcttagtattagtcactcttttttgttgttgatcgttctgtctaaattgctccacctccgcttttcctctctatttaaacacgcacgtttttcgcttcaacgcattcttttcatctgacatcttattatatttaccaaataaaacttcttttatttattcggtatttatcccccccttattcaccccgccctctctccctcgcgccttcccatttttgcccccctttgccgcccgagtcaacaagtggtgccgttagcaatcaaagatgtcttcagctcgatgccggatggctttggggcccgcgctgttccgacttcggcaacatgtcactacggccgaaaatttgctggacgagcccgtgatcaatgccgagacgaccgaaaaccttgaacaggaacgggggcacatcacccgtatcctgtcaaggatggaggtcgagctggacgcgtggggtgccattatgaacggactgcaaggcccagcgagagaggcggaggaagcgcttttcactgcctttattcgagatgaccggcacttgacggagtggttggaagatgcgcgagaaatgctggctcacatagcagcagaactcgcagatgagcccaaccagccaatcgcggcgggaggacagcaaccagctgttgctgtgaatcaacccgtgccagccgtgccattcgtcaacaatgccgcatttctcggcggtgccaatgttcaacagccagctgctgttgccaaccatgccaatcagccaccattggtgccaaataatgcccaaatcgtgccaaacttgccggctgttgctgcgcctgcgcctttagccactgctcggctgccgcagctcagtcttcctgttttttcgggcgaaccaatggaatggcccgcgttttggcagagtttcgagagtgccgtcgaccgtgccgcccttgagcccgtcgacaagctcaactatctccacggttgcttacgcggaaaggctgctcgtgccgtaaccgcctaccgtggaggggacaattatgcccatgccgttgccgcactcaggcgactcttcggagatccacggaaaattgccgaagcacttcagtccgaactgatcaatctccggcctgtggacgatagcgttggatcactgcaacacttcctcgagactttggagcgtgtgtgccgccaactt

SEQ ID NO: 35270 - DNA, 1055 bp, Heterodera glycines
  misc_feature (35)..(35): n is a, c, g, or t
  misc_feature (38)..(38): n is a, c, g, or t
  misc_feature (59)..(59): n is a, c, g, or t
  misc_feature (74)..(74): n is a, c, g, or t
  misc_feature (132)..(132): n is a, c, g, or t
aaacaacccgctgatgccacgtcgaagaaaagtcncanaatttgacatccataaaactncatttttcatagccnagcgtgttaaagcaaacccgaaactgataggaaatttaaattgatcataatagaagtntaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaactgtctaaaaatttttgttgttaatattcagaaaacgtgttttttttagtgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaatagcatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaa

SEQ ID NO: 35271 - DNA, 932 bp, Heterodera glycines
tgcacacccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggaaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaatattccaaaaaaagagatagtgattttttctgga

SEQ ID NO: 35272 - DNA, 925 bp, Heterodera glycines
  misc_feature (875)..(875): n is a, c, g, or t
  misc_feature (908)..(908): n is a, c, g, or t
tgaaaactacagcaacagtattcaaaagatgaccttaatacttatgacagaaatgaccgccgttacggtaattggaaattgacagtaatatattatgaagtgatttttaaatattaattaatccgggggatcactgtagcaacgatttggatcgtgacaattattactcaaaattaaggtaattatgcgccacgaagtggctttccggaagattacaactttaatgacctaaatcgtgacaattatgatccaaattatgataattatgttccaagcatagatattgacaagcgttattcaaagaatggtaatagttgctataatgtcaagttgccaaaaagtttaatgttataaccggtaatgttcaatttatttaaaacttgtaagattatgattttggaaattacgctaacatattaatgaagtaattatttaatatttatttttagtaaagtggagactaattatagttattattttatgtcacagtgcaaagtatccagagtgacaattattacactaaattaaggtaattatgcgccaagaagcggttttccggatgataaaaatttgaatgatcaaaatcgtgataattatgacccaagttatgataattatggtccaacttatgataatgatagcccaaaccgtgatgctgatcaacgttatccaaaaaatggtattaatagctataatgatagcgttgaaacgaagtttatgttataaatacaaatataataatatcaatatgcctattatataaaaattttggagataattttaggaaaaattcaatttaattattttaagaaattggcaaatgccaaagtttcttcaacttgcaccatgtcaggcagcaatttttatggacttgnagctagaagacgaaaaatcaagaacagcaattngaagtcaaaaaaatgag

SEQ ID NO: 35273 - DNA, 1072 bp, Heterodera glycines
aggtgagggagacagagaggaagagaagagagaaagacctttaaaggaaaaaagcaaaaatacaattaaaaagagagcaaaagataaagagcaatcgagaagtgagaaatggtaacgatagaaaaagagggggaaattgatagatgatagagagagaacagagaggatgggaaagagaaaagagggagagcgaaagagagagagaagagagaaaaaagtgagaaagaagaaagcagtgagagagaaagagcgaagagagagagagagagagaggtaaagagagtagagagagcgaagggatagagagaaagagagagagagagaggtgagaggatgagaaagagagcagagagagagagaggtgagaggatgagaaagagagagaataaagaaaaaagtgagaagggagaaagcagtgagagagcgaatagagagagagaggtgagaggatgggaaagagagcaaagagagcgaagggatagagagaaagagagagagaggtgagaggatgagaaagagcgccgagagagagaagagagagagaaggcagtgagagagagagcaaagagatgggggagagaaagcagagagagaaagatatcagagaaagaaaaagagagagagagagagaagagagaaaaaagtgagaggggagaaaccagtgagagagagagagaacgaagagagaggtgagagagagctaagaggatgggggagatagagcagagaggatgggggagagagaaagaaatagagaaaaggatggaaagagagcgaagggagagagagagaaagagagagcgaagggagagagagaaagaaacagagaaatagaaaaaaggagaacagagtgaagagagagagagagagcaacgagtgatagagcgaagagatagagagagcagagagagagcgaagggagagagagagaaagagagagagagagcggtgggtgatagagcgaagagatagagagagcagagagagcgaagggagagagagaagagagaaagagggagagggagaacgttagagagagagagagaactaaatattgagtgaaaaagggaaa

SEQ ID NO: 35274 - DNA, 1268 bp, Heterodera glycines
  misc_feature (26)..(26): n is a, c, g, or t
  misc_feature (62)..(62): n is a, c, g, or t
ttttttgcgttaaaaacccttacatnttgtttgtatttttttctctatcgatatgcaaaatntggagtggatctaacgtatagaaaaaaaattaaacgtagcgaagtaaattcggtttttctctattaacagagataaagaaatagtacgccaaaaagagaatgtttttttctctgcactctctatttattggttcatgtctcgttttttgaaacggtgtgttaagctatggagaatccaggaaaaaatatgtatttacataaaaaaagaatccctgataataatattttagctctcttctgtctctccatctttgtcttattctatcttgttccttctaataaaaattctttttcatcatatttcacttcaaacaaaatttaagtatcacaatcagtctcaaaaaacatcccaaatagcattgtcatcaaatttattaaaaataaaatttaagaagcctaattccttgaattaatcatctcatacaatggagcgtttattgcgattgggaggccttagtggtttgggagcaggttcattgaacgcaacaccacacgattcgaaccaagttgacacttcggaaactgtttacatcagttcattggctttattaaaaatgctaaaacatggacgagctggcgtcccgatggaggtaactaaaaactaatattttttatatttacacaccaaaaaaagtattaatcaaatccgctgaccgcaaatatcagagacacacacgtgtacgaatttgaaatggttaaatgaatgatattagtgatcagcggatgatttatgtcaaatttaaatgttccttttaggttatgggtttaatgctaggtgaatttgttgatgattatacggttaacgtgattgatgtctttgcaatgccgcagtctgggacggttaatttgtttttttttgtctgctttatttgccgataataattgaattttaagggagtttctgttgaggccgtcgatccagtctttcaggctaaaatgttggatatgcttaaacaaactggaaggcctgagatggttgttggttggtaccattctcacccgggatttggttgttggctttctggggtcgatataaacactcagcagagttttgaggcgttgtctgacagagcagttgctgttgtagttgacccaattcaatctgtgaagggaaaggttgcctttcttattagtttaccggtcaaattacattttaggttgtcatcgatgcttttcgcactattaacccacaggcaattgcactaa

SEQ ID NO: 35275 - DNA, 826 bp, Heterodera glycines
ggacaaatggacaaagacagtgagtgagtgggattggcaagggacaaatggacaaagacagtgaatgagtgggattggcaagggacaaatggacaaagacagtgagtgagtgggattggcaagggacaaatggacaaagacagtgagtgagtgggattggcaagggacaaatggacaaagacagttagtgagtgggattggcaagggacaaatggcataggacaaatggacaaagacagtgaatgagtgggattggcaagggacaaatggacaaagacagtgaatgagtgggattggcaagggacaaatggacaaagacagtgagtgagtgggattggcaagggacaaatggcataagacaaatggacaaagacagtgagtgagtgggattggcataggacaaatggacaatgaaagtgagtaagtgggattggcaagggacaaatggacaaagacagtgagtgagtgggattggcaagggacaaatggacaaagacagtgagtgagtgggattggcaagggacaaatggacaaagacagtgagtgagtgggattggcaagggacaaatggacaaagacagtgagtgagtgggattggcaagggacaaatggcataggacaaatggacaaagacagtgagtgagtgcgattggcaagggacaaatggacaaagacagtgagtaagtgggattggcaagggacaaatggacaatgaaagtgagtaagtgggattggcaagggacaaatggacaatgatagtgagtaagtgcgatcggcaagggacaaatggacaaagacagtgagtaagtgtgattgcaagggacaa

SEQ ID NO: 35276 - DNA, 948 bp, Heterodera glycines
aaaaaaatactttacaaaataattcccctgggagaagggagtgggaaacatgatttcaaaattttcaatttttttatagtttaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaatgaaaaaatcgatttttttgttttcggggcagtccccccgaaccgatgcgcccagatttatggggagaccgaatccttccggaatagcttccctatagcctgtactttaattctgcgttggatttttgctccccgataattgtttgagtaccccaaacggacacttgaaaaaatcaatttttaaattttcggggcagtccccccgaaccgatgcgcccagataaaggggagaccgaatcctgcgggaatagcttcctctata

SEQ ID NO: 35277 - DNA, 1188 bp, Heterodera glycines
  misc_feature (49)..(49): n is a, c, g, or t
  misc_feature (70)..(70): n is a, c, g, or t
  misc_feature (1082)..(1082): n is a, c, g, or t
tttatttattttaaaaaatatgtgaatcttaaaagataaataatcattntatgtagaaatacataagacnatagatacattaatatttaaaaaaatattaagatataaattagagcgcgacatttgggggagaaaaaccgtcaaatcttttttaaggaatagttgaaaattttttccaaattgtcaacgggttcattgtaaaaatattccatttatattttaaaaaattctatttccaacaataatatttctaattaaaaaattatttatttggttgttgaaaaatagggatggttttgaagaaatgcttaaattttttgcatgttgagctttaataagcatgaaaaacctatttcgaacttggttttaggtttctaggccaagtctttgtgttgaccgaatgtaaaacggaaattatccccttaaattttatacagttttctaatttttgttataatttaataaattccaaatacgatctcttatttttgtcttattttttcgaaaaaaacccgtgaattaaattttttgttaattaaaaaaaattaacgttgaaaacccttggctgcattaaagcccccagcatcattaatttttcaatttatgaataaaataaattattaactgcttaatgatacctaatttttgcatggccacgatttgtttgattgctttttcgtataagtcaaataaatttttattaaacattttattagcacaaaatttttcctgccattcattttcccatttttccgtttcattttcctttttttccaatttttcaatttcattttttgcttttattatgttaaaaatatagtcctgcaaaactgtaatcattagttcgaatttgtcagttgagtaatgtccaaattgtgagcttttcacttcactttccctttttggcgtttccttttccgaatttggtgaatttttgccaattttatccatttcattttctttacatttgccaattagtctaagctgaggctcttccataaaagctaagcccttttcaatgaattggttgttagaagggcttaagtattaattaacgagaatttatattttgtaatattttntattaattaaattaaatttttttaattattttctttactcaatgaaaattcgatcagctcattcagcaccaaatataatttctccaacaaaaattgagtccttcaa

SEQ ID NO: 35278 - DNA, 923 bp, Heterodera glycines
gggtatattcctttccacaacaaacaacgcataaataaatcggcactttgttcttagacacccccagcaaaaataatgctccgccgaaaggtacaaagtgcaaagatcaatcagtccaaagaatgaaagggacggcggcggtcaatggaaaatgaatgaatgaccggcacggcattcaattcggcatcgttggacatttgttatggcaaattgaaacttccgttcattctttggccatttgccattgcttttttggtccttttgccattttttctttaattgttcttcactaattcgctcaattagttgtgtaatcgcaaataaaacacaaaatttcgttttctcattttctttccttttttgtttgaatttgctcaaacgaaacgcaatttccaaatgaccttttttgtctttctttctcccccccccctccctcttttgcccccattctcacataattttggattatgtggtttagtcacccacaattagaacactcttcccccccccctccgtttgtccctctctctctctctctctctctctctctccctctctctccctctctctctctccctctctctctctccccctctctctctctctctctctctctcttacccttatcctctccactcttttgcttacgctctctctctttttttgtacgttatgcctcccccccccatccaacgacctggctttttctccgatgaatcatcccccccattcgtttcctttttctttcttttggctttaccccccccccgcttttcctccctcttctgtcccgcatatttctcttacttcgctgttggtgatgataaacaacaatcgatacacacacacatcacaaaaataacagcatatgaatgaacacggtctgctgttctgtgctgtttttccctcacaacgccgggggg

SEQ ID NO: 35279 - DNA, 890 bp, Heterodera glycines
  misc_feature (863)..(863): n is a, c, g, or t
  misc_feature (878)..(878): n is a, c, g, or t
gacccattcaaaatcaaaataccaccagacactttttatgggcttcgaaaactttattattttataggaagtatgttagagtgcctgaatacagcaagccaaataaaaattatcaatgacaaaaattcaattatccattttaattttgtttttgggcttaagcgcgccaccgtttggggattctttactgataattcgaacgcgttggcctcgcgttttcggtgttcatttcaaatggtgcaattaaatgctccttctgtggtaagttgaaatacgatttaatgagagaaataaattattttaattaattttccatttaaaggaatgggacgtcgctttggtcactttcgctgaccgttcattgttgagaaacagttggaatgctctttccaatgcgattcatacagctttaattcgggtaggtacatataaataaaatgtttttcaataattatttccaaatgatcattactagggctgtaaattttaggcaagaaaaatcgtgaaacattatttaaataggtacaagaaagacaaaatatgtaggtattaaacaggtacaaaaattccaaaaaatgtattaaacaaagttttattaacgatttttttagtctaaaaagcaaataaaaaggttaaattttggttcttttactgtgttaaacgaataatttaaatattttcttagaaaatttaatatttttaaattaaaatttgtcaagaaaaaaataataatttgtgtggatgaattttccagaattccaattcttggggtgtatttattgaagttttttcatgtcgattcttagtcatcgtaaaagcccctaaccaactggaatatacttctttcttgcttatcttgcgtnaagccctagtcattnggaactgctttc

SEQ ID NO: 35280 - DNA, 931 bp, Heterodera glycines
tttccaaaatttcacgatcaaatgcgctgagaaataattccagaacaattagtatcggcgtcattatgctgagaatgcggtggaaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagaaagccatttttccaaaattttcacgatcaaatgcgctgagaaaaaaattccagaacaattagtatcggcgtcattatgctgagaatgcggttggaattcccttgactgtagaccagaaaaagagatagccatttttccaaatttttcacgatcaaatgcgctgagaaaaaaattccagaacaattagtatcggcgtcattatgctgagaatgcggttggaattcccttgactgtagaccagaaaaagagatagccatttttccaaaattttcacgatcaaatgcgctgagaaaaaattccagaacaattagtatcggcgtcattatgctgagaatgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagaatgcggttggaattcccttgactgtagaccagaaaaagagatagccattttccaaaattttcacgatcaaatgcgctgagaaaataattccagaacaattagtatcgg

SEQ ID NO: 35281 - DNA, 373 bp, Heterodera glycines
cttaaaaataataaaaatatttttaaataaataaatgatcgccttggatgggattttacaaaatctttttcaattaatcacttttttcattcataattcacaattccatcagttcacggctttagggcaattcgttttggctttctttcaacaatttgccatggaattcttcaaatttctctgttcgatttccctccattcatttgccccccccctttccctctcagctgttggcttttccttctgtgctgttttttcattcttttgcatgcgactcttttcttttctgcgcaaatccctcgaggggatggattttcggattggaagaaaggctttaacggccttggagggactgggggaggggggggggggg

SEQ ID NO: 35282 - DNA, 1189 bp, Heterodera glycines
ctgccaagcatccttcattttaccatctgcttaaacatttaaagaaaaaataataaaataaaattttgtgttaatatagcaataacttatttggaaaattttggctttatccaattatccatcatgaatcgcaataacaaaagcacgacttgaacgggtttaaacagcttttattgcgcttttaccgcagaatggggaaatgcttttcatcgctaaagcgtcatcacaatttgcaagccgatgatagttcagtgaaggagttccaacatttttcaaagggtttcaagcagcaggccgggacttcatcaacaattgcccaacacaatgctgcatttaggcataaaaacgggaattaacattgcatttaaaaacaagcatttagatcaaactcaaaattggcaatgcaaacttctttttcatctattggaaatgcacgatactgtcgcaatcagcaaaaattgtcaaatgatatgtcaaattgtaaaaatttgcagagaaatggagcaaaaaatgcatactgtatttttttgggtttaataaccaacaaaataagcaatcaaaatgaattttgacttcagctgagggagtgtccacttcattccaagccattcaaaaacttgttgcaatgttcgcatacgaatctcggtctgacgaagaattggagtttcaggcatgcaaaatttggacaaaacaatgattattaccaatgatggtctttattcagaaaggcgacatcatgtatttaatggaaaactcgtaaattgcaaattttcacaaaaattggcatttttgtgtttctattaagcaaccttgactggtggtatgtcagaaacatgaagggtaaacagggatttgtgccgagttcctttgtcgcatttgtgaaaacgccgcaagcggaggaatggtttgctggtcgaattccgcgcactgttgctgaacgattggtggtggacaaccattttccgcccggaacttttttggtccgcgaacgggaggtggaccaactggaatacgcattgaccatccgtgacatggacactggacatgggccatgcgtgaagcattacagagtcagacagaccgatgatgcccaaggctacttcataagccataaagcggtgttcaaatcgttggatgcgttggttaaatattattcaggtccaaatttattttttcgtgttactttact

SEQ ID NO: 35283 - DNA, 718 bp, Heterodera glycines
gactggttgtcgacactgggtgaatatgttactaatttacttccctaacgaattacaattttcagtcgttgttcaccccaaacgctccgagttcttccttaacagtcacgtggcgatcaagggcactgcttgtacgccacattacactgttctgcgggacgagaacaatatgtcgatggacacacttcaaacaatggtccattacctctgctttgggcatcaaattgtcacgaagccgacctcattgccctcgccggtgtacatcgccaatgaatatgtgagtcaattcgaataacaataaaaaactacataaataattgaaatcatttaggcgaaacgtggtcgagacatctactcatactacgccaagaacggtattgacaatttggagctcttcgcaaagaggaaaggggtggaatggccgctgcgcactcatgatgacatgaccaaagtcctttctttcctcaacaccaaagacctgagggagctgcgcatcaacgcctgataagttagtgatggatggattatgatgctggtttttgctttccatttgattgttcaactcccctcacctttgcctcttcaattcgtgcatttgctttcgtttcttttggtctttctttgtgcattctcttcttttttggaatgattttttccttctccgtttcattgtaccaatccttttgttgtttattatattctgagctttaataaattg

SEQ ID NO: 35284 - DNA, 932 bp, Heterodera glycines
aacaggaagcagccctggagggacgactcaaggcagatatgtatgcgtatggcattatgcttatcgctggatatggtgctttgatttttgctggagcgggattaatcctcgcgcttgctgcgttggtgatcccagttgtcaaccgtatgtggaagctcgagaatgagtcttcgcgacaacgggatgtgctcaatgcactcaaaagtcaagtggacaacaatcagtccgaatgcgacaaattgaactttgaagtttttaaattgaacaaaaagtgtgcacacttgcccagtgactagtgtaatattggtgctacattttttagaaaaatatttcgctttttatctgaataaagttgttacattaaaactttaacgatttattgccgattgtaccctttctctaaaaaattattattttttcgaacgagaacaaccctattttaaccatatgacataattagcaacagcgttttgggtagatgtgaaagtattgtcatttttagggctacgatttttaggctctaaaaacaccaaaaataggcactaaaaaccctcatttttaggggtataaaatgacaaaattcattcaaaaaggtaaaaaaaaaaagttaaatcagtatcgagtcacattattttttaaattcaaaaatttgtctacaaaaaatttttaaagacgatttttgagaacatctttcacttcttaggaggtttattttcagaaaattttgggtcggttcttaggggtgtatttttaaaattcccaaaaaatcgcttcttaggggtgtatttttcgtttttattgcatttttgttaacaaattttggccaaaacgccaaaataggctctttcaaaattttttaggcgctaaaaataaaagcctagaaaataggtactaataactcgaaaagtagcttaacaacagcccaaaaaaac

SEQ ID NO: 35285 - DNA, 1007 bp, Heterodera glycines
aaaaaaaaaagttataataaaaaaactgaggctggcgccaaaacgtcggcgccaaaacgacccagtcccatctttaggggtgtatttttcccgaaacttcgggtaaattacccgaatacgaagctcgaagtttcgcccgtccctgatcggcaccgccggaccccaaaaactcctattttccacaaaaaaagaaaccaacattttgtcatttttttgacaaaatttggtaacaaaattcataaaaaattccataaaaatttcccgacggcgcctgtcggcaccgccgccggaccccctgtttcaaaaaagttttttggcaaaactgcgccgaaaaaatactgatttgaaaattttcagttgggagccctgtgttttacgctaataaaatatcgttttaagatgatttttcatattttttaatgcgttttcttagccgctacaaacatctgaattttagtaggtcgtgaatttaaaaaaaaacttgggaactcttccgacaattggcccgaggattgacctattaatttatcgttttttttatttgattggctgtcaaatagtcactttttggttagattatgcagaggaatctcaacaataaattaaacgcctatttatcagtttttctattggaaataattaaaaaattattaatttttttaattgtgcgaatttttcataacgaattaaaaaaagtaaatttattttttttatatttttgctgttttaaaggcccaaatttccatgaaatttttaattgacgattttgttttgcctcaaattaggaaattgttttaattaatgattaattgaaaagcattgttgaaaataaatgaatgtttcgacacagaaataagaaataaatgttggaatgattcatttaatttgtgtttaaaataaatgtgaaatgttaaaaacattgcttacatttcgctcattttttgtttgtttgtaatggtttcgccaaaagtgtaataaaacattttttattagtaatcatcctttta

SEQ ID NO: 35286 - DNA, 1316 bp, Heterodera glycines
  misc_feature (937)..(937): n is a, c, g, or t
gggattaagttaagcttatggagggtgaaacgatgcttggccatactatctgtcgttttctcacacacaaacaaaaatgattcttacacaactgatgccccaatacccgtgatcaaagctgaaaaatgtttctcacgagatttaattgaagcagaacaagtcgatagagaacaaaggaaagaacatttgaagtgtgagtcagaaggcaaagtcatttggcgtcaaggcttatcaaaggtacgagaaactgacttaaaaaacgatacagatccgttggatgaaaattcgatttcgaataattatccttcatggatattagttcgtcgtgcttacaaccgaaagaggcaacagcaacaacgcaccgattctaatgacccttttgatgtccccgaaagaatataattaacgaaattaggatcactcaaactattaatgagaaaaacaattgttggcactgaatggatgatatataaaaatcgtgatattggaattatgctttttgcatcaaaaattcaattagaagctgctaaaaattgcaaagtaatggtagcagacgctacatttgagatagcgcctagaggatttagacaaatatggcttattcatggactggtaaaaatcaaaataactttgtgcattaaaaattactaaataatttaaagacgtatggtgctatttatatgcgctgcctttgctacacatccaaacagaattacaaaggctgtggagagaatatatcaaacagaaagaagaaatagctaaatttataaatacattaggggtgccgggtctactaaaaatcaaatgcagcgaaatagtcgcaccttaaaaaaaatttgaatttgattaggatttaaaagaaaatttaaacgaattcttcgttactttgaaaaagaatggattaaaaattgatacaaggagggtgtggaagttcaanggaatcaagaacccgaaacacaaatccagcagtagcttggcattctgtcatttaaagttaaatgaagaaaataaaatttaaaaaaggtcaaagtttagtgataataaaataatagacctcgttgacgtttttaaatttgtacaaatttggacatactttttaagcaatttagttatcaacataaatagataatcagattggaagctttttataatgtcaaacctaaaaatatagctttaaatgtaaagcatactgaaatataagtccgatcgatatccgtcgctatcctttatttagtgtgtttttcaaaacttaaattaaaaattcaactcggaataaagagtataatgtgttttcctagaatgatgtataaaattaa

SEQ ID NO: 35287 - DNA, 1052 bp, Heterodera glycines
  misc_feature (947)..(947): n is a, c, g, or t
  misc_feature (1000)..(1000): n is a, c, g, or t
gtaaagtccacccaacttcctccactcgtttttaaatgtcaatcttttcagggttttttattatgcctccgagtaattttaaattttcattttaaaaattcttcgtgtataatgtagtgtaaatgttcagcggataaaattacctaggaagacaagaaaaaataaataagttcctttattttaatgattttcccattaataaattcctcttcaaaaggaaggtaattcaaatgtcttaaagccttaaacgtggcgttacaacagattttgttacctgtctgaaaatatagctaatcagcggttcgtccattttgggctgatgatcgatgaattcgaataggtccatgccacagccgcacttttccatcaccagctgataatacttgtcgttttcaaacacgccgagcacccgcacaatatttggatggctcagattctccagcagatggacttcaattggcaccattttgttcgctcttttcgggcactgaatccaactttctggcaacactttgtccttgcaaataaacttcgatactgccataagtccagtgcctttttgagtggccaatttcactgaaccaaaagttccgtttccaatttgttgaaaactgaaacggaatttgaaagttactctgttggatagtgcctataattagtctcttacgtgtggtagcatttggagtactctcctcgtaccgtttcgtcgttttcgtctccgagtgcattcaccggcacttcctgcattttaagctcaattccatgtggagcttgttcttttgggttccgtcgttcactcattgcaaaagcaatggccgattcagactcgaaaatgttcaatccgccgatagaaaagcgtgccattcgttcccgcattgatttcttttttggcggtgaagcaccgatggcagtgacacctccgttttcgaatattttgttgaccgtanagatggaatttgctgtgacagcaatcactctgttgttattagggcgtcggagntttgctcgttgtcctcctcttggtagcccgcctcctcactcagagtctcaaa

SEQ ID NO: 35288 - DNA, 930 bp, Heterodera glycines
tttctaatcccgaattaattggagaaaatcttctgagactcagacaaagaacctaagtgaaactaagatactaggattaaatgcaacaaattattgtactatcttaaccaacttcattaaattccctatttttcatatggcgtcgcccaatatttgccacaaaaatgttgtctgatctttgaaaatttttgcctgctttttttgccggctttttggctttttgagatgatagtccccaagacttgacactctcaagcatcattaatcacccagcacccaaagaatggcaccaccaatttgcatattacatgaagaaattccgctgttggggatttccatttcggtgaacacaatcgtacgtgccatcggaatgtgcagcttttcgttgcccaagtttaatccaggggcgccaaatgtgcactcgcacgagtaattgccgccgcctctgttcatggtccaatcagccgaaattttggcacaatccgtgtctttcgcacaatcccaagacaaatagctgaccatgtctacaagttatttgaacaagaaaatgcattaattttaatgaattttttaaataatattttaataaattaattattttaattaaaaattttttttgaaaagaataaaaagtcatttctagaaaatctttcattaacttaaattttgagtttagttagttttttttgaaaaaaaaatatttacaaaaaattattgacaatcatacgcattttagtaccaaatttgggtcttttaagcgaggtcaaataacgcattccaatgtcattaccggttttacagtttgccaagtagcaaaactgttggcctttgtcgcattctttgtcctcaagcgagccgtatccatcttcgtcataagtaccacgcatgcaaatcaaagcttttatttttttaattacataaattacggtc

SEQ ID NO: 35289 - DNA, 737 bp, Heterodera glycines
ccgacgacgaacgtcttcgcatcgccacagcttactcactgattgaccggcttcaagtggctcagcggcattggcaacccgagcggctggtggtttctctcgcttccattcacgaacgattgagcgaaggtgccaatgccacagcgcaggagcacggtcgatgcaatgcggcatggctaccttactgcaaacccagcaaaggcgcgctgctggtatgtcgagatggatcggagcttgctgaagagcagctcaatctcatcggcaatgggcgaacgatcagcgagatcatctcctggcaatggaaatccgatcacacactggtcttcacaccggttagcgtctgctacccgctcagcaacctccaagtccgacagtttgacctgctggtggatgctctcatctccaattacccacgtctcatccttcgaccacatcctgctgacttgttgctcgtcaagtccgacgtggacgtggaattccacatcaaggagcagccgggtcattgtgccctcggaattcgtgaatggccattgcccatgcaagcacccaaaacgatccacgtcgccagtcaggtgtcaatgtgggtgaagaaatacgacaagtcagcagtcttcgccaccgccccacagctgtccagcaatgtccagcttttcctgaactgtccgccgcctcgggttacctacggcaccatctacagacagttggcacacgatccagtcccagacagcatacaggag

SEQ ID NO: 35290 - DNA, 924 bp, Heterodera glycines
agtagaaaagagagatttcggagaaaaaggagatgaaagactaaagaagagaagaagctgacacttccccgccaaacggcaccaacaaaaacgaattatgaagtgatcaactcgttaaacttgactttgtgtgtttttaagaacaccgtatgccacatgtgggttaatttttttaaatttaaaattgattcaatttttggcattatgccatctccttgcttgttggttcactaaatacaaattatggtttacataaagggagggaacggacagggagaacaaatgagtgcattttatcattacagtattgttttggcttctgtagaaatgaatggaggtggcagcaacaacagttttctctgtgtaatttttgactgtaatgcgtataattggggctgtgtggtcgctgaacgcggtgtgtctacgcttaacgaaactgtctccgcactaattgctctttgcaatgcgcataatttctcctcgctcggaaatcgtcttttgctactcgcaaaaggagccaagcaacaagaaaagaaattgttcaccaacgaacgaattactgcgaaagaattgacaaattttgggccggccattgaaggaattattcatcaaattttggctaagaatgtttctgctgaagaaagccctttcaatttgtccagtgcattgtctttgagtatttgcggtatgttaatgagattacatcatgcatttacctaatttttttttttggcgttaggggccaattaatattagctcattttaaacacaaccactaattttagcattccaaaggttcaagaagcaatttccctcttcatttgggcatgttgtcttcataaacctttcggaacaatttacttctgagcaaaatgccctgctgaatttgtttttcgctctcgtcagtactctctgcactttcat

SEQ ID NO: 35291 - DNA, 744 bp, Heterodera glycines
tgtgattggggattctgaggcatcattttgagggggggggccaagttcgaagccgggcggtgtacattatttttctttgtatttttacgttattttcaatgattttaattaatttaaaatattttgttgagttaataaataaaaaattatatttaatttttttttgataaataaattttataagtttaaattaattatttttttaattgatagaatttcatgtatttttttaattaaatttgttaaaaaatattttcattttaatttaatgaatttaataatcactgttgcacctcttctaatcactgttgtgcccctaaaaaacgggcgcgaagcgcccgtctggccccaactaaatttaaaaaacgggcgcgaagcgcccgtacgaggccgcgagcggcctaaaaatcaccaaattaaaaaacgggcgcgaagcgcccgtctggcccaaacaaatttaaaaaacgggcgcgaagcgcccgtctggtccaaacaaatttaaaaaacggtcgcgaagcgcccgtctggtccaaacaaatttaaaaaacggtcgcgaagcgcccgtacgaggccgcgagcggcctaaaaatcaccaaattaaaaaacgggcgcgaagcgcccgtctggcccaaacaaatttaaaaaacgggcgcgaagcgccagtctggcccaaacaaatttaaaacacggccgcgaagcgcccgtctggtcacaacaaattgaaaaacggtcgcgaagcgcccg

SEQ ID NO: 35292 - DNA, 967 bp, Heterodera glycines
ccgaatggcgaagaatgtccacgaaaattgtcgcaattcgctcatcgacgttcaaaattaagttgggcttctaaacaaattttctgatgaggagggcgtctgggtttgctgtcactttcgaagttgtgatttgctccactttgagtgcgtagtcaaaaagaggcgtctcctgtttgaagaaggtcttgttcttcgctatctctttcagtatttccactcttttgtccgggttgtttatctgaacaatcgccgccatttctttcgtcgctgtgcccccccccccccccagtctcaccgattttactctgtgcccaatccccggaatgagtttgcccagccgcttctgctcattcacaaattgcatggcactcagtcccgtgtccattgcttcactgaaactcttcgcggccccgtccaaagcaccgccaaaacggtcaccctgaaaatgtcaattgtaaatccgtcactgttttcagcctcctctacttttacgacaacccggtgctaggacattcctaaattccgacatgggataataaaataaaataaaattgcttaaagtcaaccaaattaaacaaattggtatcattattctcaatagcttttattttcatcagaatattaatttcaaaaatagagatttcagaatttcattcgaatgataccaaagcgttaaatttggttgattaaaagaattttataatctctttttattatcccatggcggattttcaaatggtcagcccactgccccacactcacaatggtcaataatccggaaaccagcgacgagatcaagtccttgccagcccttgcacaaacatttgtattgtgggcaccgctaacggcgggcccgtggtcggcggtagcatcaaacaatttcgaaaaacgatttgcatattcgggcaatcgttttctgaaaatgaagggtcgagagagtagaaaggaagggaaggcgacttggaac

SEQ ID NO: 35293 - DNA, 1105 bp, Heterodera glycines
  misc_feature (1043)..(1043): n is a, c, g, or t
  misc_feature (1102)..(1102): n is a, c, g, or t
tgcaaattttccatatacgagaaaattttttcgatctgtttttcgagtagaggccataaaaaccccgacaagaacgaacattgggagcataaaagaagcgaagatggacagacagagggcaacccgaatgataaaagtcaaaacagtcaactcttttgcgttactggaaaaagaaatttgctatacaatgatgcacaaaacttcacttacttaacacattcaagatgttccaaaacagtagattgaatttcttctccataagcacaatagccgagaaaaccgacaattgcgtaaacgatagtcgaaatagcgataccaccggacaaaacgccaaagggtcccaacatttgactgggctttttgattcgcttctccaaaggaagcacctaaaaataaccgaagatattgacaattttacaaacattatgacatcgtaccaatgactgggcaaggcaagagacaatgatggtaccactcgctttgaaaaagccttctgcggatggcagggcaaacggaatggaatgggctctttccgtgaatacaatttgggacagcatctgaaagagtgaaaagaaaagaattgacaaaacatcagcacaaacaaagagaatgagtgtcaaactggtgatcgtcaacccatctccgacaaggcacataactgagaggatacgcatggacataatggaattctgaaaaggtgttaaagtgcacagcaattaacaaatgactcatccacttacgagagcgacaatcggaagcaatatgaagagaaaccatcttgggtcttttcccttgggctcattgtcagctttttctttatcaaagacctgcaaaaagtttttgttttgataaacgcaatacaaacacagcaaccgtttgaaaggtcgatgcaatgaacagatagtacatgatacataagccgaattggtggacgattatgattatgttgacaatgttccttgaaaatggcaaggattcatgaaaagagaatggcacaaactttgccaatggtccataatttttgatccatccaaaactgactntgcacgattgttccgccaaatcgccgaaggtcagaaacggaattttgaggctaaattanaaa

SEQ ID NO: 35294 - DNA, 885 bp, Heterodera glycines
attccggaaggattcgagtctccccataaatctggggctcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattagagtacaggctatagtgaagctattccggaaggattcggtctccccataaatctgggcgcatcggttcagggggactgccccg

SEQ ID NO: 35295 - DNA, 914 bp, Heterodera glycines
attaaatatgtttgcctcagatggcaaactaaaacatttaatgaatttttcattatttttatggggcatcagggctgtatctaaggccgaaaaaagcccatatcccgattacctttgtggcacacaactgaattgacctcctaaatttaaaagtttactaggtaaaattatttatgaaaaatagctataaaaatgccataaaaattattaatttatttatttattttatttttatctttgttttctgctatgacatttggcttaaagatgatatttatctgcttattctgatgacactggtaatcacagaaaaggccattaccacaattattcatttctcatttcacattctttgctgcagtttgggagaaaattcatttacataatttggtgcaaaaatgacataatgcaagagaacattgaaggaattttgaaaaataatattaaaaataaagacaaaaatgtttttaaataataaaaataaagacaattaaaaggtttaaagagattaagcctcggcagcccatgcgggtgtcaagaatctcggagattgcgaatttcggggatggaatcagattagcggtcgaacccgtcaattttcttagggaaccgaccgagccaaatatgatgtacccacaatttgttagtaaatttattttttaggcagttcatcgaaaattaattttaaaaaattaattcaaattaaatttttcgaataaaaaaaataattttaaattttaaattgatcaaagggcggcttcactaataaagcttcattaactctcattatccatctcaacaaataccttttctcccttttgatcaatgcaatgagcgatcaattaacaaagtcatcacaaaaatgggattccttttaaggagattaattccatcttaatgtgatctagattttc

SEQ ID NO: 35296 - DNA, 860 bp, Heterodera glycines
attttaatgtttcactcaccataagggaggtgagcaccttcgaagtgatcgaagcggacactgtgccggaaaggacgacgcaaactgatcgggcaaagtcgaactgaatgagccgagaatttaaattcgatttggtttttgatcaaatcgtttaaagttataaacttggattagcaaaaagatataaaattcagcttagaaatcaaaggatatcctagaaaaattgatccgacaattttatttttcaaattaaccggattaccaattttggaactgatcgaagaaatttatacttttgtaattgattcggactcccattttagaactgatagtacaaacaaagcctgttcaacttattgggcagccgggtgtcatgataactcgtacaatgccctaggctaggcctaagctttaggctaggtctaagtttcggctttcttgggcctagacttaggcttaagcttaggggctttattttgtaattttttattgtatgagtttcttttgtatgaggtgcaattgtacgggtttcctttatacgacttgtcattgactctaaatccgattctggacatgttttaaattatataatattgatcaccgaattgccgtcaacccaatgggtgccaaccgccaacaccgaggcgatcagtgccaccacaatggcctgcgtttggaccagcgcaacatttgagtacagagtggtcagctgctgctggggctgatccagcaagccaaggttggcccgggtggacagccgcgaggccaacgtcatctccaaattgcctttgaggccgagcaaagcgggcaccaggatcaacgcctccggcacctcggacaggaagagccaacccgaggct

SEQ ID NO: 35297 - DNA, 1160 bp, Heterodera glycines
taacttttgctctaaaaagaccaaatttttaatccttgctcttattcgatagatctaaatgttctttatgagcctgtaaaatttcaaaaaattttattaagtttaaaaaaagttatggccaaaaatgttcgaaaatcacgtttttttgagttccccgagctataacttttttgaaacttaacgaaattttttgaaattttgcagactgatagagaacacttagtgctatcaaatgatatcaagaattaaaaatttggttgctttcgagcaaaattataaataatttttcgacaaaatttttcataatgatggttttttaagtaacgacccagcaccaatttaagcaaatgggcaaatttgtcaaattcataaaattctgctgatggataattataattcattgcattcctccgagcgtgtcactatctgaatattaattggcttttgaagtgcatttttctgctgaaagcccaatattatgtataaatcatcatcactttttcctttttcttctatttataaaaatcactttgaaattgtcacttttattttacattaaaaaataattttaattatttttttttttttgcttaattctgatcattcacagagatgactttcctagcccattttatcgtttcgcttttgctgattgttccgtcattcattccaaatgtttttggagaggagtattctttttaaatagtatcaataattatcatcaaattagtccaaaacagattgattagcgtcaaatattttgaaaataaaaccattagttacaaaaaaaaaccgaataaaaacgtgaaaatttcgctaattttccattggttttttcagctgctgtaccaaatgttacaattccatgacgggctgtcttcagaagtgcatcattgagcacaagggggacccggcctgtcgcaagacttgcaagcccaatgtgtacaaatgcgctgccaaatgcgggccccactgtccgctaaattggacgacgacgacgccgaagagcggctaatggggcgagggacgatcaaagaaaaagccattcattcattagcgagttaattaatgagttgattaaccattatttgtgcaaagctgttgttgatccgaaaaagtcatgaaataaaatgcttgtttaaatgtgtagtaattcgtac

SEQ ID NO: 35298 - DNA, 1140 bp, Heterodera glycines
  misc_feature (160)..(161): n is a, c, g, or t
aaatttctcaaagttaagagatagtcatttttctttgatataaagataaaattaaaaaatcttctgagaaattaaatggcgattgcgcaccggccctcccctctcacgctcgagcgcttttgtaacttataaaatttctcaaaataagagatagtcattnntcttggatataagataaattaaaaaattctctgagaaattaaatggcgattgcgcaccgcacttcctatcatgctcgagagcatttgtaacgtataaaatttctcaaaataagagatagtcaatttcttggatataagataaatttaaaaattctctgagaaattaaatggcgattgcgcaccgccctccctctcacgctcgagcgcttttgtaacgtataaaatttctcaaaagaagagatagtcaattttcttggatataagataaatttaaaaattctctgagaaattaaatggcgattgcgcaccgcactccctatcatgctcgagagcatttgtaacgtataaaatttctcaaaataagagatagtcatttttcttggatataagataaatttaaaaattctctgagaaattaaatggcgattgcgcaccgccccccctatcacgctcgagagcatttgtaacgtataaaatttctcaaaataagagatagtcatttttcttggatataagataaatttaaaaattctctgtgaaattaaatggcgattgcgcgccgcacttcctatcacgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaagaagagatagtcatttttcttggatataagataaatttaaaaattctctgagaaattaaatggcgattgcgcaccgcccctcctatcatgctcgagagcatttgtaacgtataaaatttctcaaaataagagatagtcatttttcttggatataagataaatttaaaaattctctgagaaataaatggcgattgcgcaccgcccctcctatcatgctcgagagcatttgtaacgtataaaa

SEQ ID NO: 35299 - DNA, 1417 bp, Heterodera glycines
tcatcatcattgctgcctttcttcctcctccttctcctcctcccgccgatggtccttatccgtattattattgttgtgtttttgtgctgtgcttctccaactcgttgcactccctcacaatttctgcataaatttgttctttgctcaatgtttttaatgctttgttgttgttgctttcgtcactgtcgttgttgttgtcgttattgtgctgctgcttctgttgttgttgctctttttgcctgtgctgctcgctgtcgttgtcgtcgtcgtcgtcgtcattaatttgtgccgcagcgcgctcaacgaattggagctggtcactgaactgttggccaagctgagtggtcggtgaacacgcaggtgttttctgaccttttgctaatgctgctgctgcagatgacgactcatcgtaagcagtggtcaaacagtcaaattcctatcagggacaaacgaaagccaaaaaacagattgatcaagcaaccattttaatggagaaaaattgccatggaatttaagttcaatgaaatcatattggattttgtgtcctgtgtgtccaattagcaagtgatgctcgagaccgaaaatttccagaaactcgagactctctagcatcactgcgattagcggaggcgggggaggatggggaagcaaatttaaaaaaataatttttgaaagagacggcgagcaagcatgcgaaaaaataataggacagacaattaggagatcgaagagacatgccctcctcccaactaatgggacactaatatacatagcacaaaatattaacatgtaaaataatatatttacatactgtttgttggtccctgaaagataggccaaagattcgattagaagagcagggttgtcgagactcgtctgctgatttgagtgggaattttatagatcgaaaatttgaaatctgcagggcatagaccgggctgtggctgacattttcgagaacaataaggttccgagccaggccgttcccaaccctgtcaacaggcgggggattgccgggcactgtacttacagagaaaccttaaactttactggaaccaataaaattggataatattgtttaaattattcctttgcattaaatcagttgttatcgaatggagaaaattaaatttggtactcttctgttatggagccgcatttcaaattttctttcccagattaacaaaataaaaaaatgttttcggcacaaattgattggaattttgtattctcttttcgcttctgctgttgcatttttttaatttgaaattgcatctcataacagaagagggggcttaaattcttatatatttgtttaattaaccaagaagtgtgttgttgttgccctgctgtttctgccggtaattgtactgttactgttgtctttgcctgcttcaatcgatttgctacgccgaaa

SEQ ID NO: 35300 - DNA, 935 bp, Heterodera glycines
  misc_feature (31)..(31): n is a, c, g, or t
acagtacgattcgtagatactgtacgagttnggagggttcgtttttacacatgaaaacgagtgcaagttcaggaaagttatatataaatgcttaatttcagctgaagatggcacccaactgtctaatgagcacctccaaaataataccgtatcggccgagtccattaccgtagccaaacaggcgttgggcgagatcatcggctcatccaaaacatcacgagcaaactccgatgccaatcacgcgccagcagcggttgttgttgttgtgaaggaatcaattggcacgcaaaccgcggacgatgaggacgaggtgaaactaattaaatatttatttgatttaaatatatctcttttcattaaatatttatttgttattcgttacatttccgaaagtttttctcggaaaataagtaaaattggcacttttactaaatgccaataatggtcacttattaaaaacaataaattttcgtaaaaatgctggccattttttatttaaaatgatttaaaaatatttaaaattatttttccatatcagaatgacagcacgacggcgtcagcgaaagcaacacagactgatgcgcatgcgttgttggttggacatggcgcgacgagtgccggcagcagtgggctgagtctgatcagccaagaggaggtgcccgatcaaaactattaaccgaaaaaataaacagattaagcacaggaaaaaggcagaaattcgggattactaaacttattagtttaaattggattgaatattttcatttttgaatcatttggtcattggattttttgaagagtgatcaaggctttatcttcaaaatactgatcaattgttgatcggctatccaataattcattgagtattttcaaaatacctgatcaacgccgatcatcatttattattttcaaaatgcctgatccatgctgatctg

SEQ ID NO: 35301 - DNA, 798 bp, Heterodera glycines
aaatgtagagagcggaccggaccgggcccggtaccggtttttaccgggcccggcaaaccggtccggcgttttttggaaaaatccggtttgaccggttttccggtttgaccggtttttgagcggccgggcccggaaaccggtcatttagaaaattccaaaccggtccggaaaccggcattttggaccggtttataccggtttatgatatagccaaaaattcttcatttttatagaatttctgttaataaattgcatcgaaattttcaaaaatttctcggcggcgcctatcggcaccgccggaccctaaaaatccttaattttctttaaaaatttgctcaaaatcgcaaattttttttatttccaaacagaaatttcaaaatcttaaaaaattttccacaaatatctaagaaagaaattttttttctttttatggagaattccttactaggttttcctatactaatgcactttaccaaaaaatttttcaaaaaattctttaaaatttttaatttttttgaattttattattgaagatgtcatttattgacgcctgaagtgaaatagagccgaaattttacatctggcacgatttatggtcaattttgggtgaaatacatgtgaaaatttaaatttttaccaaaccggaaaccggttccgggccctgcaatttgaaaatccggtttcaccggttttccggtttgtccggtttttgagaggccgggcccggaaaccggttgcttctgaaaatatcagaccggtccggtccggcacttttggaaaatccggtctttaataaaa

SEQ ID NO: 35302 - DNA, 879 bp, Heterodera glycines
gaaaaaacatcggtcacttgaaataataaagtccaaaattttgtccaggaaatccggattttttttagcctcgacctgcattttttcatatttggcctggaaaaacccaggtccaatatttaaatttacatgaggggttaactctactgtgtggagaaaaactatgtacatattaaaattttcaaaaattgatcgaagtaaaaatcatcaaagagcgatgaactaaaaaaacgaaatgacatttcaacatcatttatatcaaaaatacgctattaacaagacaaatacatcaatcattgatcagacaaaacgacacattggataatacacaatataataaacaatatgaatatgtctttggaggcgtaaacagaacgattatacaataatacagcaatatatgtgcatgggaaatacatattggagtttcttttcattaaacggcataattcgtgacatcaattcacttaagaaccctccgatgaagatgatgcgtcctctgtgccttcagaagtggcgtccgaagtcccagaactcccctcagattttcgttgtaatgaaaagaaaaagtttttgaaataggaacctaatcccccatattttttttcatcagcattaaaaaaatctaaaaaaattcaggtaagcataactttggatgctgatcaaaaaaggtagcaacaccaagttgatcagatcactccttcatggtgatctgatcagcccattttggctgggaacgaggggtaaattttaaaaaaaatttctagggggttgggaaaatttttctggaaattttgagtaggcccattttatagagcacaaaatttgctaccgaattgcctttggaatagtgggtctaccatttaagcccggtgagat

SEQ ID NO: 35303 - DNA, 975 bp, Heterodera glycines
  misc_feature (911)..(911): n is a, c, g, or t
  misc_feature (923)..(923): n is a, c, g, or t
  misc_feature (931)..(931): n is a, c, g, or t
  misc_feature (960)..(961): n is a, c, g, or t
aggtcttaaaaaatgtaaatggattaggggtgcaaattatatgcttcccagttcacgaggtttcgaattaaaaatttttgtgttaatttttaagtttagaaaaatacgaatttttaaaaatttctacgtgaatgaacaatttggaaatttcgcagactaatagccaggtattaaggtatttactgtaaatttgaaattattttgacaacaatttatcgtgaaacttatttagtacatataatttgcatcccaactaatgacatcattcattccacataaaattagccgaattcactaatcaccgaactaattaattataaaatgacatatattcttccttttttatagatagtttttgtttttcttcgttgctcatcaccaataaatccatctgcttctcggcgattgcaagaagggtgatgataaagttacgacactcctccaaattgagacgtaatgaatcaacaaatttgcggtcatattcttccaatgtttcgttgccctcgtgtctttaaaaataaatatttaaaataaattttttaattaaattttattaaggaacgcaatgcatttttatataattaaatatttgatttgtaactgtttttttaacactacacatttttgcaattcataaaaatataacggacggcaaaagcaacaaaatacaactgaagttttggacacctcctcaaaaaatttttttttaattggaaaagtttataaaatttcaaaccacggggatttggacctacgaacccaaccctaatgagttgtttttaattaatgggtgaaaaaatgaattgtgctttaattgtttgcaaatgcatagttaaaataaaaataaatttgtatttcggattatgggcgtatgattaatttggcagtaataaaaaatataaccctttccnattgtgctccantactatgncgtccttatgataagcgcccattttcttnnaaatttttaaatta

SEQ ID NO: 35304 - DNA, 938 bp, Heterodera glycines
  misc_feature (228)..(229): n is a, c, g, or t
ttctgtgttttgtctctctcactgttgttagacaccacacatatgtcgtgtatgtacacacatcgccacactttttacacgcacacattaacaaaaacacaacgccatacgccaaacatttttttttatttgctgccgccatctttttgctggcgcattcaaatgttgtggtggtggtgccctcggaaacgacgaaaagaacaaaattaattgcttcccccccccccnnccctccctctccctcaattaattggggagccccgtgggacgttttattccttcctcttgctttgtcctccccccgcccccctccccccggcggacggtggtggttgtagtggcatttttaattgatgagtccaacccatcgccggaggctaacatcgacaagccggcggaacctaagacaccaccgcgtcattcatccatgttcagctgctgcctcatcgccagcctcccgttccccgtcaccgtcggcaaacagtacaacaacagcagcagcaacaaccggcggagaggcttcatttgttgccggaggcggtgttgccatgacatcatcatcatcttcatcattagcattgtctggcagcatggcacaccaagaagatgatggcagccattctgttgctgatgagcaatatcgacagcatgatcatctccatcggcaccagcagcatcggcaacgcgttttgcagccggtgccggctgagagccaagccggaccatcatcatcagcagaacagcagcaacaactggtggcggacagctcatccggcggctactatgagccgcgcggtggttggccgttgcggaccaggacatggccggacgggcgccgagttggaccggacggtacggtgctgaaatggcaaaggttgcggcccaaagttgtgcttccaacaccaccaacgactgcaacaaggacaacaaggccaata

SEQ ID NO: 35305 - DNA, 772 bp, Heterodera glycines
tttagaaccatcgggtaaactctttggattatccaaattcatgttaaaaatttagctttcggatttgagtcaaaaagaaccaacagcatcagtatttttgtattataatgatgccaatttgaacctgataaaacagccaacaaaagataaattaattattttgttttatttctgtgataatctttataaaaaattcattcccttttgaaagttgcaaagaaattctgggggacttattgtggcacctctctattagacacttgtctaatagctcctgtaatctggttttgcaactttaaaaaaagtaacaaattacgaattagcaattttatattcgaaaattaaatcgtataaaatcaaaaaattttcgcctgcagcgtgcatataaacaaataaacttttagccagcagatattcaaatacttactttgttgcaaatgaccgtatcgcgtgtataattaaagatataaataataaatataaagaagaatatcattctccagggaacagattaatatgtttttacatattttttgtgcatatgctatcgcatgaaaaactcaaaaatagcgtttattttacctgttttcaacaatctgagcgagtttatagcacataaaaaaccatcatctaaactattaccggggttggttaccgggaaaataattgagttgctctaagccagttttagtttaaacgatcaaaaacgcaaaacaattgaccttaatgctcctaacttttctcacccattgaaatgtttgcctcttacata

SEQ ID NO: 35306 - DNA, 1126 bp, Heterodera glycines
  misc_feature (1056)..(1056): n is a, c, g, or t
  misc_feature (1070)..(1070): n is a, c, g, or t
gttgttttttctgaacgaaatgtttgtaaggaaggggtgaaattgttaaaaattgagtcatcatttgtcagtccctttcacatttctgtgctgtcagcgtggatttttaacagataagcatagctgtgtccccaaaaatggtacgtaatgcgatgtggcggttcttttgctgttgtgtgtgtttattcagcattccttttggaaaacaaacacacacatcgaatgaaaggccgaaaactttgctttgtattaagttttaacattaattctttttttttaatatgtactaatttgatccgattttgttctttttaaggcgccggcaaatcgagattgatgtttggattttttaatatgaacaaaatgccaaattttgttataattatcacgacaattttaaattgcctttgcattcaattttggaaaactttgtcatcgacacaaatgaaactttttatttcagaaaaatgaaagccttgattttggttggaggttatggcactcggcttagaccgctaaccatcacacaacccaaaccgcttgttgagttcgccaacaaaccgatggtaaatgtagcgcagaaaacaattgctgaatgattttaaccatttgtctttttcgggtggtccaccaaatcgaggcattggccgccgtcggcgtggacaccgtcgttttggcagtcaccgctcgcattgaggaccttttggccggagaaatgcgaaaggaggagcaacgcattggcatcagggtgaaaaactgatttcaaaatttcattttgcaatttatgtttaattttagattgttttttctgtagaggatgagccgatgggcaccgccggtcctttggctttggccagcgatttgttgggcgatacggagcccttttttgtgcttaactcggacgtcatctgcacatttccgttcgccgaaatgatgcactatcacagaaaacatgggcgacagggcacaattgcagtcacaaaagttagttatttctacgtttgtgggggatgcaaaaagttgaaatttttggatttgcataaattaactcactgngactaattttttanatttcgaattccacatttactttaggttgacgagccgagtaaatacggcgttgtcg

SEQ ID NO: 35307 - DNA, 955 bp, Heterodera glycines
cagctcggtcattccgcaaacactgattcagtttatattcgcgaaagaatgagctgtaattttgcgaattagacaaaaatgatcataaagtaacaaatgagagattttcacattctgctaattaggctttaaatataaactgtttaagtgtgcagacgatcaggttgataagcgccaataccctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaatttgagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataagctgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgg

SEQ ID NO: 35308 - DNA, 984 bp, Heterodera glycines
  misc_feature (961)..(961): n is a, c, g, or t
atgcgggcccatgaaaaaatgcagttttccgggtgccaattttttgtgaattttcattcgggcgcgtcataagcggattgttggtggcaaatgcaacaaattttgtgttatcgaatgcgctaggcgggctcgacatttccaaatgtatcaacaaagggtctatctccactctctggcaaggtatggccagccaaagcagagtggggcataaacaagaattttttaatctttggtatttcctctattttgtgcctgctctacatttatgtcttgtgccaatatgcctattgcaacagaaatttattcagctttcccgacaaattgttgagataattattctagacgatttttttatatctcaatgcttaactatcgcctttttgtttggcaactggtagaaattggcagtgaaaaaaagtttgtttgtaactatttacaataaaaatttatgtagcatttctaaaaaggatgtaaaaataagttcttgcgtaatatttttatattgtgtgttgaagaatttgagtctgcttctgatgcaagtggaaaatttttcagcttttctcgaaaagttttttcccagaaaaaggatgggacaaataaaaaactaaacatctctcatgaccaatttaaatttccttacattttgggtttactttactatgctggcccatgaaaaaatgcagtttttccggtgccaaatttttgtgaattttcattcggcgcgtcataagcggattgtttggtggcaaatacaaacaaattttgtgttattcgaatgcgctaggcgggctcgacatttccaaatgtatcaacaaagggtctatctccactctctggcgaggtatggccagccaaagcagagtggggcataaacaagaattttttaatctttggtatttcctcgtattttgtgcctgctctacatttatgtcttgtgcctaagggagctattgcaacaganaatttattcagctttcccgacaa

SEQ ID NO: 35309 - DNA, 964 bp, Heterodera glycines
  misc_feature (905)..(905): n is a, c, g, or t
tcagaagcagactcaaattcttcaacaacataatgtaaacccccaaggcaagaaattatttttacatcctttttagaaatgctgcataaatttttattgtaaatagtcacaaacaaactttttttcactcccaatatctaccagttatcatacaaaaaggcaatagttaagcactgagatataaaaaaatcgtctagaataattatctaaacaatttgtcgggaaagctgtataaatttcagttgcaataggcatattggcacaatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaaattcacaaaaatttggcaccggaaaaactccatttttttatgggccagcataataaagtaaacccaaaatgtaagggaatttaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcaagaaattatttttacatcctttttagaaatgctgcataaatttttattgtaaatagtcacaaaaaaacttttttttactcccaatatctaccagttatcatacaaaaaggcaatagttaagctttgagatataaaaaaatcgtctagaataattatctaaataatttgtcgggaaagctgtataaattctgngaacaaacttttcaagaaagctgaaaaattttcaatcgcatcagaagcagcctcaaatt

SEQ ID NO: 35310 - DNA, 792 bp, Heterodera glycines
cattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttaattcacttcaaaaaataattccttacacaagttttttacaaccacttattgccaatttaatttcttgcagatttaaagccatccattgcctgccggttctcggcacagcaaagcactaatagggtgtttgactcacttcaaaaaataattcattacccaaaagtttttacaaccacatattgccaatctaatttcttgcagattgaaagccatccattgcctgccggttctcggcacagcaaagcactaatagggtgtttgattcacttcaaaaaataattccttacacaagttttttacaaccacttattgccaatttaatttcttgcagaattaaaggcatccattgtctgccggttctcgggacagtaaaacactaatagggtgtttgactcacttcaaaaaataattccataccccaaagttttttacaaccacatattgccaatctaatttcttgcagattgaaagccatccattgcctgccgattctcgtgacaataaagcactaatagggtgtgtgactcgcttctcaaaaaaattccttacccaaaaactttttactaccactgtattgccactctaatttcttgccgatttaaagctatccatt

SEQ ID NO: 35311 - DNA, 991 bp, Heterodera glycines
gcggtgccaatgccaacaatgggataaatgcagaaatggtaagcaattgtaattaaattttcaaaatttaattatttttctcattttgttttaaggcgatgcgatggcagtgattgagcccggcggaacagccaatgccaacgaggcccagcagcgaaagaggagggtgagttcgggcaaattctgatggactgtgggtccttgtcgggcccagcttttgcttttctggcccagataagggctcacccctgaggtgtgggcccagattgggctcacccttggggtgtgggcccatgttgggccccttttgtcttttggagccctgattgggctcacgggctgtgagccctgctgtgtattaatcatttaataaaaaaaatttttttttcataaaccgcgttcgggggcagccaagcgaaaagcgaaggagcgatctgttgctcaaccaagagcacctgctgctactaccaacaacccgcacatgccgtttccaatgatgatgccgatgatgatgccaatgatgatgcctttcaatttccccttcccgcctcctccccctccaccatcacaacaacaataattttttttttgcattttcacatttatttttatgcattttcatttatttatttttgtgcttaccttcaataaatcaaattacaaaattcacggtcgaaattttcagtttttcttaatgtttactaataattcaatcaatgacagtgtgattaaataaagatggcaaattttattggttaatgaaaaatgaaaatattaacgattgctgtaggcaatgaaaaagtgatcatgaggaaatacagtaggagtccaatcacacacatatggttaatccatgcggtgcatagcaaatgaatgtgccaacaaatattggttgatgagtcaatgagaaaaggtcccggttttgtccacaattaccggtaccgctctactctagtttttagcatttcggcatttttgtgtttatgaattg

SEQ ID NO: 35312 - DNA, 1181 bp, Heterodera glycines
  misc_feature (1153)..(1153): n is a, c, g, or t
ttcattaaataaaaaatataaatatatatgtctatccatattttacgggaaattcttactctatgctattatcaaacataaaaattattaattctctattcaaatttaattggactaaaaatgcttttaaaaacattctttttcaatatccttaaataatctaaaaagttagacacccaataataaattaataaaaaatttaaatttacggtcaagaatttaaaaaaatgaatatatgggaagcatttagaaaaaataaattttatcattcacttacttaaaatatctcgaaaatttatattaaaaacaaaaagaaagttaagatctttgagattaatatatttaacacataaacatcacaaatcagttgagtccgtcggtgaaaatttagaaaatttcagtggaaaattgttaagaaaattgtaaaattgccaataaaagaacaaaaaaatgaaaaacttaaagtaaaataagtttaaatttattttttgaccagagaatagagatgtggtggcaagaaatacaattattaaatttttgaataataaaaaaaagcaattagaacaaagcaataaaattattttctttaataaaattaaaacaaaaagaaaaacagatatcatgacaataataaataaatcatcacaaaaaaaaaatttttttttaatttattttgaaaattgtcgttcatacaataaaatgaaaataaaaataaaacacgttgactttctgatctaattatatagatattgataaaagagaaattaactaatttaattaaaatatttatggattttaatttactataaatatgataaaaatgaaaatagacaagcatttctaatttggaaaaggagtgaatattacgttatggggtattcatttcaataatatgaaataaaaatggataaaatacataatatctaaaacattttcgagaaatcaaaaatcgaataaaatatttgattaaccagatataaaaaaattcaatacattcattattagggggcccgataatgaaaagaattattaaccaaaacaaaaaattaaatgaaaaagaatagaatagcctttcacccttcctgtaaaaggtatactgtaattaattaattattttatcttatataagacaagatttggagaggtagaaaantttttcgagtttattattaatttaaaat

SEQ ID NO: 35313 - DNA, 710 bp, Heterodera glycines
tctaaaagtacccattcttccataatactattactattttataattaaacgtgtaagtggtcaccccttcgttggattttatttttattttgaataaataaaaaaaagaaatggcggtagggaaatgggtcgatccctcctttttccattttatgcataaaattaccatcgaggcgtgcgttttaccagttttttgttactttatttcaaatgttgatgtgtaggcataaaacggaaagtacctgtaacttgtcagcattctcgaacacccttcattaatggtaaattagccaaaacctcgcaaaaaggagcatgcaaagatggagcaagttaggcttggcttaagcttaggcttcagcttaggcttcagtttaggcttcagtttaggcttaggcttacctaggcctagccacaaattaccctagaaatgactttatttcaaaattttaggcaggtggtcataaaacggaaaagtaccaaaaaaaagttttttcagatggcgcggttcgacttcataccttgtttttttagacttagctcgtcaagggctttcgattggtacgaaatttgtcgggattcgaccatttaaaaaaatagagtgccaaagctctcaattttatgagttttgaaccggttcaaaaatcctcgctttctttatttgttaattcatctttagaattatgccttttcaatttggtccagctaccact

SEQ ID NO: 35314 - DNA, 1463 bp, Heterodera glycines
  misc_feature (1366)..(1366): n is a, c, g, or t
cgtgagctgaacgaagggctgtaccgcgtgtacaccgtcgatgtttggaatgcgttcgtaatttcgtcaaaacccgcgaaaattctctttctgcacgttgacaagcaatcgatatcgttcgagaagtttgacatcaaagaggccatctcgcacaagttgcagttccagatcagacggaggacggacagagaaacggcggcacagtgcgcaatgatcggccggagaccgccggacggagacaacgactgtccttggctgattttcaaggacaaggcaggtgaggcggagagtacggcacggcacgaatggacgggtcaaaatttacaaaattaaaggcaaccaaatgcgagctgacaaacacatcaaacagttgggctttcggttggccgaattcactcatttggttgaggtattcgctgatcaacgcattgttatcaattcacttttgatcaggtgtcttttgcgcccactctgatcaacgaattcttcatccacatcgactgctcttacgacagttccgagcccaacgaagagcccgagttggtctaccacagttcattccacgaactcgacggtccgtcccaccgctaagccatttcctttgtgaatttccgaaatttaagtgttcttttccctgcagttgcaaatgcacacaaaattggcgtttttcctctgctgaccgcaccggtgaaggagaacagagtcgaactggtcgaacttcccaaggaaaagattctcggacaccgaacgcaccgaatcggtggacacaatcagaacagattctcgaaaagacaaaagaattgaaggaaaagtatgaaaggaggagtaaaacgaaagaggagctgttagaaaagcaaagtgtttgctgattttgcccttttgtgtgcctttttgtgttcgatttccctagttacactttttgaacaattaggctttggctttattttccaaattggcaagcgaaggcaacgaaagcaattcgatcaatttaaatttgttgatcagtcaaaggtgcttgccctgtctcaaaataaatcgaaacgataaaattatgctttatgcaaaacgaattaaagacacgaataaccaaaacaaacacaatttcaaacaaacttgaaaatcggcgagaattaggcacagacgaaaataaatcaatcacacaattaacttttatttttcaaacataaacactaattaataatgaaaccaaaacaaattatttaaggtcaatttgaataatcggaacgccaaaacaaacataataaattaaataattaatgaagtccaaaaatgatatcacaccccgaccctttatgagaagacggtccctcgtctaagcaattaattgggatgagagacagaaatnaagagaattagaaatccgattgggtggtggtccaaggcacatggctcagtgacgacgacgattctcaaagactctccatctctgcgcccgcgagaat

SEQ ID NO: 35315 - DNA, 1049 bp, Heterodera glycines
tttctattctgctggctactaatttctcatttaattatttgtttaatttaatttaattagtttttcactcaactttcaccttatttcccactttaggaatcggtgccttcctcccactcgactccgttgtgccaaagtccgccgggcagcctcctcttttcgcgccggcgcaactcaaacggcggcgatgcagttggtggcttggatatcgctgctggtggcacatcccctgcggcggttttatcgtccgccgctggtggcgccgctgccgcgaagtcgtccacgacggcactggtgcgcaggcggtccagcaacaacggaggcggtgccaagtccaaaaagccggtgcagtcgaggagaagcacacaaatctgaacagtgcagcgcaatttcctgaacccgcacctgaagcggtactcattcaatgacaattgtggagaatggaaccaatcagctgactttggtggctaatagtcaagggcacaagggcatggttgattggtgtttccatgatcggcacacatcgcaaatgcattcgtggagagcaagcgattttcacactaaagccaaatcagaagtgccgagggggtcccagccgatgattacacccactcatcaaacacattccacttttgagctgttcttcgctctctcccatttcactaactttttgcttccagtcttgtagttgtaaattaaaaaatagaaattaattaatttaattgtaagcgaattatttacttcaaaaaatgcaggctgaaataaatttgctttcataatgaatggcctctgatcagactgatccacactcactcactgatcgtttgttttactttccgagaatctcgccacccgcccaaatgttttccactggcgattttcagtttttcatttgtgtttatctccaaaaatgtaatgtttcaaaaagtctttcattcatttcctttgcctgttcctccctaattattcccatcgttttgctaattaatgaccaatcacttcaattaaagagatactaatattccaactttggagttccgttaaacaaa

SEQ ID NO: 35316 - DNA, 701 bp, Heterodera glycines
atgataaaatgaaaattcaatcgcaattgaaatccaacattgtccccgagggcatgaataaggggtggggtggggggcttaattaattatactaaatcatgataaaatgaaaattcaatcgcaattgaaatccaacattgcccccgagggcatgaataaggggtggggtggggggcttaattaattaaactaaatcatgataaaatgaaaattcaatcgcaattgaaatccaacattgcccccgagggcattaataaggggtggggtggggggcttaattaattaaactaaatcatgataaaatgaaaattcagtcgcaattgaaatccaacattgcccccgagggcatgaataaggggtggggtggggggcttaattaattaaactaaatcatgataaaatgaaaattcagtcgcaattgaaatccaacattgcccccgagggcatgaataaggggtggggtggggggcttaattaattaaactaaatcatgataaaatgaaaattcagtcgcaattgaaatccaacattgcccccgagggcatgaataaggggtggggtggagggcttaattacttaaactaaatcatgataaaatgaaaattcactcgcaattgaaatccaacattgaccccgagggcatgaataaggggtgaggtggaggagcttatttacttaaactaaatcatgataaaatgaaa

SEQ ID NO: 35317 - DNA, 908 bp, Heterodera glycines
ctaaaattaaacgtcagattcgtgatcagcaccaaaaattagcctagaaaaaaatttcaggggggggggggggtggaaaaacccggaagtaccgctgatttttgacggtcaaatgctgattttgaaaatttcagttgggagccgccctgataataattggttgactttgtttatcatcaaaaataacaatgcaattattgacataccaaaaccagatcaggaatgaccaggcagagggaaagttatgggttttacttcaaattgatgagtacctattcaaatcattcattggattcactgattgatcagtacataatactatactgattagattagctatactaaaattggggtgcaactcctcgtacgaaatgaatctgatcacaaaatgatgaattgtcaacaatcacttgaggtcgggtcggatacatgccggacccgtgtacggatttttttgttgacccgtaactcgtctttttcgggctgacccgggtttagagtttgtcgcccgtaacccgtatttgtgtcaagcctgtaaccctctcccttttccgaaaatttctgtctctaataattattgatcagatcagtccagccggccacactcacttacccgattccaatttgccctgaatacaagcgagaaaaagcagcttctgcgcgtcaattccctgatcatctgcagattgcatggcttgcgcttctgataaaattgatgatgacgttaaatatcaattggaaaaatttctaaattggtaaaatttgctggcaatggcattccaaaaggacagatttcggctctgctgcagtttacgcgtccaatcaacgaccgaccgtccccagttatttagtacataacttttttcttacttgtaacaaaacttacattcttggtatcaattgaaagc

SEQ ID NO: 35318 - DNA, 1113 bp, Heterodera glycines
gagaaaaaaactaagttggaggtcgtatggggaagccacagatggacgacaaatggaaaaatctgattttaaaatatatgtagttgtagtgagagaaaaggggcgtcgctcatttggcagcgcccatttggcaacgaaaatcgtcttttatgtgtttcgtattttcgtgtatttggggtttttcgcttttttcgcacattttcagacaaaattttgtggaacgaatggagttgctacggtgttgaatacagtgcacaacgcttgagcaaaatccgaatggacactgttgatcagaaccgtgccagagacaacttgccaccccgtgccaccggcgatcagtggcaatgcacggcacaatttggaaagactggtgtgagcatgagtaacgcactgtttatgccgccgttggtcaaaattgtgtaaaacacagcgtgaaaactttaaaattaattataaaatattttgatcgggttttctacacaaaatcaatcgaaataaacgatttccgattaaaagatcaattaagttggtctctaattttatgacgttgagtatatttttaaaaaatatgcgagagtttaggataatttgaaactcaatttaatcaattttggataaaataacttccctctttaataaaattaaaaatgctaataatattttttcaaatttaattaatttactcgtcagcaataaaatgcaaaaaagccaaacaaagtgagagagggatggtggtagaagataatgatgaggaacaaagcagcagcagcaacatttgctacacttatgatttatccttttttgaatttttaatttaaataaacttattttgtctttatattaaataaaaattttgggaaagtcttttttcgcgtggggacgttttcacgtgagtacctgtttaggactgaaattgatcggatttgtgcaaaacatccatgtttcgaatcccgaacccgaattcggacaaatttcttgactttttaattttttatttcttacggctagtatcttctacgataatttgtcagtttggtcggatgtgcgtcaaacggaaaaaataattaaacttttataaaaacacataaatagtataacaaaaaataacaaatt

SEQ ID NO: 35319 - DNA, 201 bp, Heterodera glycines
agagcgaagggagagagagaagagagaaagagggagagggagaacgagagagagagagagagagagaactaaatattgagtgaaaaagggaaagagaaaaagaaagagcggttgtgatagattggaatgcgatcttttgggcaccacttgaggggttcttcaagtttgggtggggtcgaggcccattccttttttggacgt

SEQ ID NO: 35320 - DNA, 918 bp, Heterodera glycines
  misc_feature (30)..(30): n is a, c, g, or t
  misc_feature (772)..(772): n is a, c, g, or t
ttctctaattgcatgctaaaatgtcaatancgcttgtactcttcttaggtgaaatgcataaaccccgcgcgaatttccttttcccgcaataaacaaaaatattttcgtttttggatttattaataattttgtttataaattgtggcacttcgtgtcatttgcctcctccgctttctccgtttgtttaattaacccctaattgattcgcatttcttaatttgggcatgcccttttaaatgtttcattttttgtgaaatcaaagacattcgcaatagcattttttctaatcgctcactaaattcgcaatttttgccattttccgcaaatgaattcctttccttcgccccttccgaaattttctaccattggcattggcactttccttctgttgctggtgatcaatttccatttgattgcgagcaacgaatttgggcctgaagattcggtggaccgcaaaaagacggcggaaaataatgaatcatttgctttactccgacgtccgaattattttgccaaaaaactcatcgtttcgatggacgctttttcggacacggacagcgaagacgaaacaaagcaaaggacggcacatttcgaattgagcgattcggaggaagaatttaaggaatggcaggaaaggcaaagggaaaggaaattggaaaaggaaaatgccgaaatggaaaaagcggcaaaaagggaaagtgccgaaaagggaacggtgaaagacaaaaaaggaaaattaagcgaaaaaaagagtgattggaaattataaggngccaaagaacatttccaaagaaattagaaacaacctttgattaaattgtcaaatatttatttatcattcatcgtttgattttatattttcttcgataaataattttttctaaaatagctaattaatctctgccctgacaaatcatt

SEQ ID NO: 35321 - DNA, 587 bp, Heterodera glycines
aaggggagggagggagtaaggggttgtggagaagagggtgaggggaatggggggggggaaagagggaaggtcggcaactgactgatcgctaatgagtggaagggaagggcgtttcttcctaatttgattttgaaaagcttacccgtcagctcgaagttctgagcaccgcttcttcctgctttccctttccctccaccgcttcttcccccgtcgaccgtcccatgcttaattcatcagcagaaacttgttcactgttgacacaagtcactgaacgcattgatgacattcgacgactgagtcgagcacgacacgaagcgctgaagcgacttgaggaggaaaagggacggcaaagagagggggcacggccggtgcaagtggtgtcaccggaaaagacagaaaaacgcgacgacgaaggaaaggtggacaaaatggggggggggaagtactcttacaaaagtgagagagaaacagggaagaggagggagggaaaagggggaagaagagaaagggaagagaaaagggggaagaggatagagggaaatgggggaagaggagagagggaaaagggggaagaagagagagggaaa

SEQ ID NO: 35322 - DNA, 1109 bp, Heterodera glycines
agaagtgctctccggtttctccgagcccgatttggcggcacatttgcaagtacgcttgctgaccttggcccagtctctggttgatggtcaatttcatcgtggtgaattgaccaaacaacggagacatttgaaaacaggctgtcacttgagcggttaagccttcatgaggcacgaccggcagcgactgtttgaagtcaccgctgaaaatgaccgtttttcctccgaagaggagatccttgtgctggcgaattgccatctctttgcacactcggtcgatgacctcaatcaccgtgttgtgaagcatggtgatctcatcaatgatgatgagttgggcctcacgaatccgacgggcaaagaagctctccagcggaatgcttgggagtttgtctaatgacacttctctacccagacgaaacgtggaatgggctgttttcccatatggcagcaaaatggctgcacacccagtggatgccgtagcaagcactttgtaggtgtatggggcctttcgcaagcgcctaataatttggccaaacaggaatgtctttcctgtgcctccatcgccgtatatgaagaaacggcgggggacagtcgaatccctagggttcgactgtattgccaacaaaacagcatcaaagaccttctgttggtcgctgttaagtggcggaggggtatttggctgtggacgaggatttggttgccctggaggcaaattcaaatcatcatcgccaaagaaaaactcttcaattgccgcgtcagtatttttggcaattgaagttggcgggtctggcaggctaaaatgcacacagcttaagttaaagcagctgtgcagccgccaatcaatgtcggctagggcttcaagctctgctgcttggcgttgtgccggtgtggtaatgccttgcggattgtatatttggtctttgtacttgttccacaattctatggcattactcggctggccatagaccaggatgctcacaaagagccatctcatctgatctggccagcgcgacagagctgcctccgccagagttttgtcccaaattttgtcgtcttcaagaagaccatgcattatacggcctcagtgaatgaggtacaaagcaacccattaa

SEQ ID NO: 35323 - DNA, 129 bp, Heterodera glycines
ttaagaggggggagggggtggttgagtgcgcgaaattgggaggagcggtgaggggatgcctgatcagtacaagggggggaggggggttgatcattgatcagattgttgatctagaattgaaggagtggt

SEQ ID NO: 35324 - DNA, 978 bp, Heterodera glycines
aaagcattgtacatcataattaaaagcgaaaataattttcgtatattttttcacaatttatttcaaaagacaacaaaaaattgataaaatgttgaaacgaaatagtgcacaaaaagggagggatggttagacgaaaagaggaatttttaggatgggacgcaccccatctgatattcccatttttctgtttcacaactggccaacggcgactgtgctcattgacacgtagttgtccaattaaggtacttggactttccacagtaaaatgtggtgcaaattttggaactgtcccgcctcacggcggggcttaaaagcatttgtaacgcaataaaagttttttgttttgaatttttcacaatttatttaaaaaagccaaaaaatccggatccaattttaaaaacgaaaatagttcacaaaaaggagccgcctcacggcggggcttaaaagcattgtacatcataattaaaagcgaaaataattttcgtatattttttcacaatttatttcaaaagacaacaaaaaattgataaaatgttgaaacgaaatagtgcacaaaaagggagggatgcttagacgaaaagaggaatttttaggatgggacgcaccccatctgatattcccatttttctgtttcacaactggccaacggcgactgtgctcattgacacgtagttgtccaattaaggtacttggactttccacagtaaaatgtggtgcaaattttggaactgtcccgcctcacggcggggcttaaaagcatttgtagcgcaataaaagttttttgttttgaatttttcacaatttatttaaaaaagccaaaaaatccggatccaattttaaaaacgaaaatagttcacaaaaaggagccgcctcacggcggggcttaaaagcattgtacatcataattaaaagcgaaaataattttcgtatatttttttcaaaacttttattcaaaagaaaacaaaaaattgataaaat

SEQ ID NO: 35325 - DNA, 553 bp, Heterodera glycines
agggggggggcaggaattgagtgcattaattacagccgcctacagcgtgagggtaattactcaggagtcgctccatccgtccgccccacgccccccccccccccaaaaaaatggaaaatatttaaaacaaagaaaaggaatgcagaaaatgattttttttttcgcaacttattgtaaaagcaaaaagcattcaaaaattattatgaaattccttttccgtcttagacctcccaaccgcctctcagtttctcccagccaaactcggctgcgggtggaaagtttgggcataacaacaaggatggtgatgggatgggagtataattatgacgccaaaaatgttgcaatttagcgcaagggaaattgtgaagggaattctcagtcgttgctctaaagctttcgtgcctatgggtgatggagcattctcgggtgaccgtctcaatattcgctctaatgcatgtttaacatcactttttaaatatgcagtaccatcagctctcagtatatgtcctctagagccaaccccaaatttttcagggtcattatttataattaa

SEQ ID NO: 35326 - DNA, 1015 bp, Heterodera glycines
aaatttttgtgggattttaacgggagctggattttcacgagattcccgatcctgctcccggaaaattttgaactcccgatcccgctcccggaaattttttttaccggactctagttctagcagagaacttcgaaatccaatgacgaataatgaattctatttggttattttcggtattcgaattatacaaaaaaaaaattttgaaatattttaaaaagtgaaagttgattttttaggggtgcatttttcaattttcttgtatttttcttacagatttttctcaaaaacgccaaaatatgtgaaaatatctgccaaaccgcgaaatatgtgtttttatgtttttatactcgctctaaatcaaaaattggtcgaagaaaatgctatttttgggcttctctcgtcataactaagtcgcaaaaaaatatttaaaaacataaaaatcccatctcttgagtcattcaggctaattaggaaccctgaaccccacatttatagaaaatagaaaattcaataaaaaatactctttttatatacaaattcgaaacagagtgcaaaattctaaattgaatgccaaatgacatttatcgaattcggttatcagaggtgtaaggggtcagttcctgggccgtcctcggtggtgcctcaggcattcagggaagtcgccccctccgtccgcgtgctgctgccgtcttcagtacggctgtacgccgtctccgaaatgtcgtccaccgtacggctgtacgccgtctccgaaatgttctcccccatacggggggacgccgccccagtcgtgccctcctctaccgtaccgggggacgccgccccagtcgtgccctcctctaccgtaccgggggactccgccccagtcgtgccctcctctaccgtaccgggggacgccgcctccgtactcatgcgcagagacgctgccccatgccctccaacgttgggaccacgaaatgctttaagcacttttgcagcaccttgaaaaagaaatttcatgtttgcgtgccagatg

SEQ ID NO: 35327 - DNA, 522 bp, Heterodera glycines
tatttcgggatttttctacatattacatatgtacatatttttatacatattttggacttttcgccattttttcgtacatattttgcaatttttgaggatttttaaggaaatttttattaaatgccccaaaaaatccaaaatttagcaatttttcgtacatattttcattttttattttcatattttggagaatttatagaaatttcttgtgaaatttcgattttttttgagaaatatacctctaaaaaatcaattttttcaaaaacagataccaaaaattaatttttaaagtactaaaatgtgattctaggcctatttgggtcatttttattgcattttatgcctatttcaccctttacgaagaatttttccaaaaaaagtaaccgttaaaaaaaatttatttacatattttcgtacatatttgggagtttttgtacatatttcatacatattttagcattttttatacatattttatttacatatttcgcgatttttcttacataaaaaaggaatccctgt

SEQ ID NO: 35328 - DNA, 372 bp, Heterodera glycines
cgaaaattctttgaggtgtttttgcgatgacttttcctctaagctcattcattcattttccaccaatttaaagccgctttggaggtggaatatcacatttggcttattattgcacactcactccaacagtgaaacaaacgccgaaggaaattttgtttttctctttttttagttttcaaaaatatttagtagactcaaaacaaaattaccttttaatatatgaaatgatattcaaaaaatttgagtaatacagcctgacaaatgagcttaaaatttcacattataaaaataataaattgacacatttaaggattttgtcaggaagaaagaaatttcgaataccttaaatacacaaaaattatattcctacat

SEQ ID NO: 35329 - DNA, 895 bp, Heterodera glycines
  misc_feature (872)..(872): n is a, c, g, or t
atacgatatgatacggtaaagttacgaagcaaaaaatcattttggaatttacccggtaaattggcgtcaattgttctccccgacaattgtccgaggcgtgcaaaaacatctgacactgtccctttttggaggaagcgccgtgtgttttgaactcgaagaggacggaatggctgaaagggaatcagcggagtactcgagactcactctcgactcgaccctttccattcccgactctcattcccgactgattctcgctttgatccatggtcttccctccacaaactgaccaaaatcggtattcgtaacattgtctgacacaatctgacaccgtcctcgcttttgtctccacactcagccatttggcccatttgtccttcttttccgccccttttgtcccatcgtttggccatgaaattctgccaaaaaggccaaatccgacccgagaacacgctaaagtggcactatgaataaatcgagacaatttcgaccaatttggcatttgaattttcctacgcattttgatggtattaaatcaaaatttatgtctttgtttttgtgtccatctttcattactttctttttatttcgtctcgtgaatttgtcttcttttattttatttcttgagtttggtcataaaaacattaaatgtctttttcggttgtcttttaactaaaaatatttaattttcaattttattaatttttatttctaattaatttattaccgctttcttcgtttgccgtcccttcgattgcggaagaaagggccaaattcaaaaaaataatattcaaaagaataagaaaagagaaataattcatggcgaaagacgaaaaaggcgaccgacgcaaatcgaattttaattttgacctgangcaatggcaatttaaaaaatgaa

SEQ ID NO: 35330 - DNA, 1475 bp, Heterodera glycines
  misc_feature (23)..(23): n is a, c, g, or t
  misc_feature (34)..(34): n is a, c, g, or t
  misc_feature (66)..(66): n is a, c, g, or t
  misc_feature (98)..(98): n is a, c, g, or t
  misc_feature (1411)..(1411): n is a, c, g, or t
tgctcagcagaaaatcggcgctncatgctgcccnagtatgttcaaatccgtttttcactattccanaagaggattttcacaaagcatttgtaatgttntaagaattatcaaaggtttatggatttcgacaaatcttaaacaatgggaatgcttaaaaatatttctccattcgcgaggtcggtcttaagcctaaaaaagccaaattataacacaaagtgccgaaaatgcaaatatcctctaatttttgtctaatgcatttctcacagttccttctgacgtgctaacattggaagaagtgatcggcatttatcagttccattgccattcaaatctttctgatgtgcccggtgggcggtgcctattgcaattttccactcggcaacgcatttctgatcggcacaagggcacacttgcgttggaaattgaacatttttcggcatttacacggcaaacttgtgaatttggacggtatagcaatgccgtgtatataaggggacttccatggcaaatgaagcacaagtgaacatggcgtccaatggcactgaaaacttttgggtgtctttctctcatgtcagaaaacgggtaggagtaattaaaattatgaaaaaatattcttattaacgtattaagacataaattggagttatgctgtgtcggcaattttgcaaatcctttcgcaaaagaacgggacggagtatttaacaaaaaattttgtcaaatagcattggttatccaaattttattgcttttacggtgagaggaaattaaatttacattgaaattaaggaattgatggacccgggcaaaggattggacaaagtgacactgacaatggcaattggagttatagcagacaaaacaaaaacggacaaatcataaaacaatttgatgtcttttaaaagtggtaaatcaggatcatttatttgttgaatcaatttttcatattagcaaaagacagtagtgatcagagagaaagaggcaaaagaaaagcgaaatacttttttattttcgaacaatcgatcaaccgaagattaaaattgatctgaatttttttaaattctaccagtttgaattaaatatttttcaataaaatattgattgattttgaaggaataattgtttttaaaaaatctccaatgttttgatcatcataattaggggctcaggataggtaggatctggtccggcacttagtgtctggtgagactttttttagcagattccatatattccaattatttatggcttggatttccaaaatttaaatgtatggtcgggcttttcgatcctccatgatcaagacttgaaaatgctcaaaatgtttaaagatgagactcaagtatcaattaaattaaatgcataaaaatagagaggggaaattttggtgttgcgaaaatggttcatctcacgnaaattgttacataatatttgttttaaaaaataaattttaattattttatttttctcatatgttc

SEQ ID NO: 35331 - DNA, 1004 bp, Heterodera glycines
  misc_feature (915)..(915): n is a, c, g, or t
attcacactgatcacttgggtcggaagtgcctcgataagactaaaagcaaaaatgagaattataatttaatttattttgttctcaatttactgacccgcctccgatttcttcctgattaatgcaatgtcaattgtatcccagtcgccccaaaatgttggcacttttaaacgccaatcgctccccagtcaattgattggtaaaaccgaacggcatgataaagtcatcatcatcagactgaaattggcacgagatgaagcactggaaaatgccgaaaaaggaaaacaatgtacattccaaaggaactgattgtgatcaccaccttcagtccttaggttagtgatagccattcctctttcatgtgctgtaggccaacatttcgttggtccgttcgggcaacgcacttttgaggaggccgcacaatttgggcgtatgaaagagacggacctggaaaattaaaaaaatttaaagaatttgaattaaagatttgcgcggaaaaaaatttgtttttttgtaacggatctcgtgaaaatttgttagtttttgtggatttttggaaaaaattaacgatttttttctattcgggaattgggaaaaaaattatttgctcaaaaactaacgattttttttctattcgggaatttggaaaaaattattttctcatcttttcaaacccaaactcaataatgaaaattgccgaatttgccgtcagaaatttgttaagtgattttaaaaagcaatgatttttgcaatcgttgatttttcattgtttgtccatatttatttatttagtaaattgaaaatgatgtttaggttgctcaatatttataactagggctataaattatatgcttttgcatattttttctgcgcatatgctatgaagaaaggggcccaaaatagcatttctgcgttanaatttttgatttggtcaaggttttagtgcatataatgcttaatttttgggggttttcgagaataatgcatatttggccatttttgcatt

SEQ ID NO: 35332 - DNA, 1274 bp, Heterodera glycines
  misc_feature (1109)..(1109): n is a, c, g, or t
tcttttattttcattctttatccttatctattcatctcccccccgggaattctttcattttagtatatttgtttatactttatctaacccaattttggtgaatatcaaaatcaattttcttcttccctaaggcaaattaacagacaaaacattcaacttaaaaaaactcccttctctaatagttacttaaattcaaccaccttataattcactagtaccaaaaatgcaaagtgaggattttgatgatggatatttacgaacgacacctgatccgtttgttgtcttgataaacaattattttttcttgtgtctttttagaaattcatttaaattaccgccgactgaattaagcaaagcacccgacgaagtgttcgatgtaattagcaaaattggcgaagggttattttgttccgaactgcttttcatttgcattgtgtaaatttaaggtcttacggctccgttcacaaagcattacacagagaatctggccacacgcttgccgtaaaaatggtgagccgtaaattatttcgggtggggcggtgtttactgtttgaataattatgctttcattgcaattccttctattaaggtaccagtggacactgatctccaagaaattatcaaagagataacgattatgcaacagtgcgattgccgacacgtcgttaaatactatgggagttacttcaaagactccgacctttgggttgggtgaccgatctttgccgatgctttttccatgtgcaataatttgagattgtcatggaatattgcggtgccggttctgtgtccgatataatgcgattacggcgtaaaactttaaacgaatgcgaaataggagcgattctcaaagacactcttctgggacttaattatttacacggattgaagaaaatacacagagacgtcaaagcgggtgctaatttaccataatatgctaaacatctcaaaatatgaccctttgttctgtatcaagggaatattttactgaacatggatggcaatgctaaggtacggatggtttatggacttgctttgcgaattaatttaatttagctagcggattttggcgttgccgggcaaatcaccgacacaatagcaaaacgcanatacggtgagtgtgatgctattttctgacaatatcaattcttgttaaggttattggcactcctttttggttaatcgacagcgtttctttaaaatgttttatttgcacctttaggatggcccctgaactgattcaggagatgggctacgacatgaaggcggacatt

SEQ ID NO: 35333 - DNA, 952 bp, Heterodera glycines
aaatagagacaaaaaatccaagcgcctcttcgttgtgtcgccgttgtccgtcttccactaattgcttaattttttgtataattatcaaaatgcaacaacaacaaaaaaaatgatgggaatatttttgtgcggcgcgttcatattcattgcctctctcaatgcactaattgcgccacaacacaacataattaatgccaaccaaattatgaataataatttgaaaacgggcgcccaccgccaaatgtccttcattcagcgaaagaaggcccctggggggaaattgtaacaaaaaatcactgattctgaggggttaggcggtcggtcaatcgttcgtccgccattcgattccatcaccatttttttttatctgattttgtggtttaggaaatttactccgaaaaaatacactaaataaaataagataatttaaaaagatggaaattaattaagggtaatgattaaaaaatttttaattatgaaaacttttaaaagcataatttaatttatttaaaaaagaaataatgtaataaagtgaaagtgatttatttcaaataatataaattattatttataataaattctttaataataataaaaaaagcaaataaaaaagacatcgccgaatgctgaagagaatgcgtctcaattaggttgaattgatgccgtaaataattgcgcagtgtgtgccgttgtttgtgtgtggagaaaaagaaaataaaggttaattttgttggtgtaaaaatggcacaaaaagatgatgatgatccatcgagaaaagaagaaaatatatttgttaaaaattcttaaaatttttggtacaaaaaattaaaaatctaaatgtaaattaaaaaaaagaaaatcattaacatattccctatataaaaagaatctacccccctaactcacttaaaaatgaaaatctcgagtttttttgaagtaggggggggggggg

SEQ ID NO: 35334 - DNA, 974 bp, Heterodera glycines
attctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaatcgatttttttgtttcataaatatttttttcagaaagtcatgcgcacccgtccgatctggcaagtaagcaacgattgctgactagccaaa

SEQ ID NO: 35335 - DNA, 1006 bp, Heterodera glycines
attctgcctttccagccttatgggaaagatattatcggaactccctggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgtattatatcagtcgatagaattttcgaatcgcttttaaatcgtctcttttgcgtcccttaatcttcactctgaggcgagttact

SEQ ID NO: 35336 - DNA, 877 bp, Heterodera glycines
ggcgcaacgaaaagtgttaataaatagcgacttctattgaaaaggtttttcaaataaataacgatttattaaaaattaataacaaatataatgatattattaattgaaggatatgagttagatgcaaaattataagtctcctcaagtttatttctttggtctgaacggggccaaaatgtcggttgctcggcaattgtcgatcgtacacttctcacagagttaaaactgattactgatcgttcatcgttagtcgtgaatttgtttttgttgttccaaagcgcagaaatacagacttaagccacaaaatttgacatattgaagtttaaataaataacttacaatcgcacaagcgatatgccaacatgtatttggggcgaaaaagtttccaggattgagtttttgaggcgtttggtagaatatttatctcttcttttggttcgttcatgcaggaatccacattatgaatcattatgaatgtgaattggttgttgcttaggtaaatttatgaatgaatttattcacgtataacctagttttaataaaataattatcgaaagacaaaaaaaatttaaaaaaaaagttatttacgtttgcctcacctttgtcgaggaattcttgccaaatctcttcggcaagcatttttccatagcaacgctggtcccattcaaccacttgctacggcgtccatttcttaacttcttctcatcatcgtctgaatagtttaaaatgttattaaaataattataaatgttgaataaaatgatcatgatttccgtttttatacagtttattatttgtttaacacagaaatacaacaagaaatcttataaatagcttaatattcgctcatattttcactgctttactcactttatta

SEQ ID NO: 35337 - DNA, 999 bp, Heterodera glycines
ttcttttgccaggttaccttgtgagtacgctgaaatcgtggtaaccggccgcatgtgtgtgcaggacgtaatggaagaggcgctggacaatttcggcatggacgggcaaagttggaatcggtacaatctgatcgaagtgtcgctggagaagggcgtgggcgagcggacggtcaacccgcaggaggaaatgctacaattggtgcgcaatctgcgcaaggttttgtgccggcatttcgccgtggccaattgcttttttgacaggattccctccggcgctatcacgtgctgcgcttttacatccaagagaaagaggaccctcacggtgaaaaatgaacaaaactccccagtttaaaatccaaattcttaactgtcgcaatggtcaaaaaaagacaaataacattgattactccttcggcttttttaaggcagtgggcagagctattgagcggcgactctggcaaatgtccacctcggacatgactgaccctttcgtcgcccattttgaacagctacggcggaatgatggaatgcttgcgatggatggagttggtgctgctcaggtggccgacctgcatcgtccatgaacaatttcgacatggtgctaaccctttttacattttatcatcttttttggtcgtaattcgaatccaatgttttttttttgtaattagttcttcctttttacttagcttttgtttttacgtcctaaaatccttgaaaaaattttaaagagccttgtaaaatgaaattttgcggacaaatatataataattaaaaaacaattagtctaccaaaccaaaaaggtctaatttgtttacttaacaaagagaatttattaatcttttttgccgaaaaacattatgaacaaatcccttccaagaaattccgctcgacaaaaaaatgtttccctcaattttcactgcccattttttgatgcatcccatcgatgggatgagaagcacaactaatcacgcttaaaatatttaaatttttcccaaa

SEQ ID NO: 35338 - DNA, 936 bp, Heterodera glycines
gaagattgaaatcatctgtttgtacgcgttggttcgtccttcaaaggatgggtaatagacgagcgagagcagcagtgtcaggatgagcgtcgacagactatgcgggggaaaacagtccgacccgtcactgtccccgtccgcctgcggcccgagtgccaatgtgcgctgcagtgttgaccacagtgaaaccacaaaactgtcactgcggctttgtcttcgaccagcaccactccctcctccagacatttttgcatcgtccaattcctcgtcgaaatggtagaggaagttctcgagcagtacacgaacgatgtctccgctctgaacacatcttatcggcaaaacaaagctaatggcgaaaaaaatgaaaaaaataacaattgtgtcatcagcaatttgagaaattcggagtgttcagtgatgctttcttcgtagagttgagtgctgagcaatgaaaggaggagacgaattgcttcggcatgcaattgaacagtgagggcactgaaattcattaacgaaaattaagctaacgaaattaatggattcagaagttacggatgaacacactttactggaatttgcgtaataatttgtatgaggagagttaaaaactgttcgggttcgttttctccgacatcgcctccgctgcgattttgtgacgccgcactttccaattgttgagcaaatgactctgaaagaataattgcatttccatcgaaccaaaacacaacaaaaacggtaatagtacggatggtacccccctttttcgaaaaacaaaatttttgaaaatttttttcgagaaaagattcgaaaattttaattttcgactttttgcttgaattcgggttcggagtccgacataggtcaaaactaatgtcagaatcggattctccgacccttaaaaccccctaatatgatcttttctcgaaaaaaatttca

SEQ ID NO: 35339 - DNA, 879 bp, Heterodera glycines
aaaaaaatcaaaaattcaaagaaaaatactaaaaaaaatttaaagctttttttaaacttacatagatattactaaaaataaaactaattccgaggtcatgaagaacttacgaatcaattactctgtaataattcgttcagggaagttgctcgtctcggatctcgtatttagagtcaaaattttttggtttgcatttaactcaattagttttttcgagtttataaatatcattatgagctttagcagataattgggaaaaaacctatttttttttgcaaattttcatcttttagtcttaaatacccgggaaacgacaaaattttccgattaatacaaaaaatgaaattttaattgaagaagaaaaacataaaaatgattaaaaagagcaaattgatcaacaacattagtgaataattaatccttccatcagagagtcgccaaatcgaatttgaaattgggcccaaaattcgcctcaattttgtaaccagagccaaacaaagaaacgaatggataaagagaaccatcagcaaaagatggatcaacgaaaagaccggaggaatctgtgaaaaagttaagggatttttgattattttaaacataaaataaattagcataaaatagacaaataaccaaattgtaatttaaaatcgtaaaattatattatttattatttgctaacccaaacgaagcccatttttggtgaaaaagagctgtcgagtgaataaatgaacaccaattcctacggtatcgccaacacggtagaaatattcgatatttgttcctttttcttttccgttaatccataaaaagccataattgtcaaatgcataagtgcccatttcaagttgaatgtctacatccaattttgtctgctgttta

SEQ ID NO: 35340 - DNA, 530 bp, Heterodera glycines
  misc_feature (23)..(23): n is a, c, g, or t
  misc_feature (36)..(36): n is a, c, g, or t
ttaataaataataaaattaattntaaattttatttntagaattactttttgcgtttgaatgtggacaaatttcgtgccttttgcagtgcgaaccgtgaacagtttttgccggttgtcagcaaagaatttttgtgcgctttgttcgtcaaagctaccgagatgggaaatttgaaatagaaaaacatatatcgtattttctaaccccttaaattaaaccccccctgaaacaaagcccgccccctttttgggttgaaaaacaaagattttaggaaatacaatacggtcttgtgcaaaaaaccagtaattaactattacggtatcggagcagtcaaaaattgatttactttaaataaaaacaaatacccaatcggattggttaataaaataatttattgtttttcatttatttccaaaatgatttcataaaataaccgtgatttaagaagtcaaaatcactctgaattttttgacttgtaaatgtggagaacacatagagctttctgcttatttactgaattagaacccccccc

SEQ ID NO: 35341 - DNA, 645 bp, Heterodera glycines
ccagacaaaataggcatcacaaaagtcacaaattaaatctacttgcgaaaatgtttttgctttgctttgtattgctaataaataacaaattacaatcttagctatattacgacgtccgcgttcctcagagatatgctcaaagtaaagagctaataaaacttgaatatgaaaaggcaccaaaaataaaacagaagaaaaaataaacgaaagataaaaaaggataaataacgaaggatatggcaaggaaaatattgtcggatggactaaccaacggagaaaggcccgcaaaagggagaaaacctaacggataattgagttaatggtataattaaaatttaaaatgaaaaaacgggcggaatggaaaataatttacaaaacgaatgaatgggcgaacggtcgtccgtttttggctatggacaaacaaataattgcgtgattcatacaatgcgtcgtctgtcgttctttttgcgttttacaattgcctaacccctaaagcgattcggtgccgaaaaaggacggcaacatcaaaggcctcccatcagacaaagacagccgccgccgttgccgttgttggcctgctcagagcgcagaatcgactcgagaatgcacgcgtatgaaatcactccgcatagctgctgctcatcg

SEQ ID NO: 35342 - DNA, 905 bp, Heterodera glycines
cagttatactcggtaaagcgaatgattagaggacttggggacgaaatgtccttaacctattctcaaactctaaatgggtatgaagccagggttgcttgactctgaacccaggcgttgaatgtttgagctccaagtgggccatttttggtaagcagaactggcgatgtgggatgaaccaaacgtggagttaaggtgccaaagtgcccgctcattagacctcataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtggtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtgggtcagccgatcctaaggcaccggctaacgccgtaacacactacggatgacgacttttctgtgcttgcgcagttggtccatccggttgccgaaagggaagtgggttaacattcccacgccaggctagggaaatgacggttcgcaagagctgttttgcgcggtaacgcaaatgaactcgcagacgtcgtgtggagtccgagccagagttctcttttctggtttagggtgtgcgtgcctggaagtggctcagcctgagatagggatgttgcgcccgtaaagcaccgcgggtccctgtggtgtctcgtgcgctccacacgggcccttgaaatgcgagggaagctattt

SEQ ID NO: 35343 - DNA, 999 bp, Heterodera glycines
  misc_feature (955)..(955): n is a, c, g, or t
aattttaattttgtgtccctttcagttcggattcctcctttctgctgctgaacagtgctgcggtcgtcccttcctccgcgcgcatttccaaaacacaacccctcgctgaccatcggcccgttccgctcgcgttcgtcccccgctgccttgcgcctgacccgccctgtccttctgctcacatcccccatcattcctccgtcgtctcgaatcagtcccttttccgtcaattttccaattcgtccgatcctttgccggcttcacaatgtccacaaaacatttctttatcggccatccaatcgtctaaatcccgcgttgagcatcagcaacaacagcacacttctgccgattgtggctcttgcagtttggtgtccgcgggtcagtttggttgcactttattttcaaacttttggcatattttctgagtatttttgagttggaaatggtttttttttgttgctttttctgctgtgacttggactgtttaaggtgcagttgcactttcttcggttggttcctctgccgctggtggtatctcagccaaatacggcgccaacgacgaggggccgtacttctgcccaaacagtggtaacaacgaactgcctttttcgtccaccgccacggcgaccattctccccaccaatttgaccgcgagttttggcggtgccctttccgcctcgggagcgatcacaattgctgcgacaagcggcggttatgagccctcgccgggcggaccaacgacctcatcttcgacatcatcagcatcatcgacctcaacacaggttgggaggggaattgggagagagtgaggaacaaaaggaaccagagacgacgaagagaaagaaaggaagaggaaatagtatgaggaaaagtgactagcaaacgaaatatgacacaaaaaagggaacgagcgaagggagcgagaaagagagagagagagagagtgaaaagactttcngaaggaggagagagtgagggaggagagagagcacgggaaaagca

SEQ ID NO: 35344 - DNA, 832 bp, Heterodera glycines
ttggcgaattcgatcaactaatcatgattgattacaaccgtcatattgtgaccgattcaaaaattgcataaaaagatgagaaaatagaccctccagcatcacttttcatttgtagaagcacgaaactaaattagcataccaataccctccctctcaaaaaaaacataaatgatcagcaacggaacaccaccggtcgctgactacttccacggtggaattcagacggccgagccgcttcagccagcggccgccgatgctcttctaaccgtgtaccagcccgacgagtacgcatggcccgacagcgacacgttacaacgtgccgctcaagcactgatcctcgcactccactacaccgttgtagtgcccatttttctcttctgcttcttcaccgccgtacgctggctacgccttcaacagcctggtttggatttggctcaccacctcccatataaccttgctggtccgcacctagcatctgttggggtgacgagcgccggtaacagcgaccgtggcggtagcagcagcaataccagcgcagagcacaacgaattcgagcaccacctcaacgggataagagtcgcggcactttaccctcctcacaaattgccccaattcgtttaatttctccggtgcccatttggccgagtggcgaagcattcggatgatgacggctcgacaccgcacattgaaggctcgaccgcctttggcaaaacccctgactcatttgagcttgcaccgtcacgcaagtgaattaaagcgaaatgagtctcgtgttttgtcgaacgcggtcgtcaatgtatttttttgttactttctctcgggctgatgcata

SEQ ID NO: 35345 - DNA, 996 bp, Heterodera glycines
ttctctcaatttttcaatcttagcaccccttgaaaaactgaaccaactgtggaaatggcttaaaacttcgggagtatgccgccggtctagtttttctcgaaatttttgtcgaatcgagtcgagactcgggattctcgagagcatcaccagtctctagacagacagtgatgctcgagactgaaaatgtctcgagactcgacaaaccgagacccgtacccgagaaaaccccagaccgagaccgaaaaaaaaccgagacttttgtccagtcgagattcgggattctcgacagcatcaccattctcctccagacagactgacagtaattaggccacaccaactccaagcgataggccccggagactgatgagggaagtaattgcgggcaccgcgcgggcgccgcactttccgccgccgcggcgcttttccccccgcattcacatcatccatcatccatcaatcatatttcccgcacattcattagagagacataacggtgccctggggcaggggacgggggcacattgtgaacattgtacatcatcataatcatcattcatgcttttcgtatcatcattttcatgcttttcctccccacgcccccttttttcggtgtctgtctctttttctgtttctctctctaccccacttttttttttgttacttctccaaacattcgcgacaatacgccaaagcgcattatcatcatttagcatcaaacaaatttgatgctctgatggcggtggtggtggtgatgataattgataatatcatatataatttgatttgattcacaaatcagtgcattgccacattattatgctttatttgtgccgcccccccccccgcctttttttgtccggttcaattttttggcgcttcaattttacatttaacttaatttttgggtttagggatgtggtaataatcatacatatacaagggggtgtctcagaccaagggctatacgacggacgattggcgcaggggcgatgcgcc

SEQ ID NO: 35346 - DNA, 727 bp, Heterodera glycines
  misc_feature (683)..(684): n is a, c, g, or t
aaaaaccaaaatatttaattagttttaacaaaattatgccattttttgtcaaaaatatcaaaaatggcgaatttacaaaacgcactgtggattttacgaaacgaccgaacaccctatgattcatattgtcttaccgtttgatccttccattttttttattatttgtatttgagctttatattattttttcataaaatttttttctctagaattattcaagctgtattcgtttttgattaaatgaagctttttaaatattatataaatataatactgaaaaatgaaaaattaatcaatatcacaacaaaaatccttttactgaacaaatgcggattgaaaaggaaaaacagaactttgggaatcatttaattttttaataatttcatctttgttttgcttttcctcttctcctaaatccaccacctcattctcctacccttcatcctattcctcctcctcgccctcctcctccttctcctcctcgtcctcctacccctcttcctcctcctcctccctctcctcctcctctcatcctcgtacagttcatcctcttcctcctcccccttctcctcctcctcgtcctcctacccttcattctcttcctcctcctcccacttttcctacctcttcattctcctcctccttatcgtcctcgtacccttcttcatctttctcctcctccnntctcttcagctcctcagaaatttctcatgatattcatcttcat

SEQ ID NO: 35347 - DNA, 663 bp, Heterodera glycines
tttatgctggatttcatttccaaaacaacaattattactataaaatcagtaaaaaaaattatgccaaaaatttgtaagcaaaacaataaagatgagatagaagatcacacttgtccaccaacttcggaatgctgctcattctccttaaaatggtaaatttaaaatttaaatcacatcttcccgatatgttattccaacaccatacttctttctcctcctcttctgatgatgtaaaaaatttttgttggcgccgtcgctgtttccgttttttgcccaaaacatagtccacaaaatcggtctctttctttgctgttgttgaaccctggaaaacatttaatggtttgattaaaatgggtgtgtagtttaaaccaaaaaaaaaaaaaaaatttcaatttttttaactaaatgcaatgtttttaatcattctgaattattgtccatgaaatttaattcattttccaaatgcaaatttccaccgtttgtctcttgtccaagacaaagtccaaatctgctgattgttccgttgacgccttccttttccgcgcaattcttgtcggagaatggcaagcctgcatataatgcgaaaagaaaaccatattcaaacactgaaattggaattcccaaagaaacaaaaaacacacagaaattggcgttctgttatga

SEQ ID NO: 35348 - DNA, 1600 bp, Heterodera glycines
gtcaagtaaaaggtaaaattcgacttactaacgtccatcagcgaagcgcaaacgtcgtccctctgataaattgataagtcttaaggcttcctccagcgaatcgactgtttttggtaaaacattccgtccaaaattgcgcggtttgttccctcttctaggcgacgaattttgcgattttcccgttcctcctagtgttgcttgtagatttgcaaggaaccgtcggttccgggtggattcggcagaagattctgcgcttcttgaggaccttttggcgctgttattgtttgagccaatgatggagggtgacggtgaatgatccaattctgacgccatacttaaggccttgtcctaaaaaaaaagatgcgttgataattaatcgattaacaatttaatggattcctatgaaatgcatttcaattaaacagtgggcaaattccaaatgacatgggaacgtcgtaattaattacatacctatatgtacatacataagcattaattattcattaattaatgaatttgatttaaatgacaaatgtcacaacaaatttatgtgttttgcttttaggctttccaaaatgagtcaaaatcgtaccatttgagttttagtcgaaatatcggagacccacccatgtaatctaacgatacacaataaggtggatactttttaatctatattctttagagggctttgcactggacttcataaattctgaggagtcattttcattagtttgatcgtattaactctctctgttcttttattaatcttaatccctctcctctcctcctttccgtgtgtatgtgcataccatttcgctgttgctgtttattagatctaccgctgccttttattagtcgttggactctaaggaaaagaaaggtgcgaattgcaatacatatttttttgttagttaatgacgaattgcaattctgctatgtgccagttgtcaatgtaattttcatttgtgagtacaacaaatgtatgtaagcgtaagctgtatttttactttaattttttgatccctatttttaatataaaaaaaagtgttaatttgatgcttacacgcaaaagcgtcatttttaattgattttaactacttcagtaatactcacaaacaattctggctttttaaaactgtcttccagcagatgacaagtacggaaacttcggcagatcgcctcgctgtgataaactcatcgtttgcggatggaccgcaaaatgaggagcagcgatatgatgggtttcaagtggagaaacagcggttcaacacgggtccatgtgcgagtaaaacactccctacacaatttgtgtgtttagaatttatttaaaaacaatttatgagaaaatcgtttttcttcagcatgtcgtgaccgcaagcgagtggacaagctcaaattgaccaattggacaaaccgaaaagtgctcattcttcacccgaagaacaacaacaccaacaacaacagcaaattgttcaacaagttcaagtgctcagcaacgaatcgtcagattttagtctttgttcggaaaaggagctcgaagtcttaatggtcaactcgaagacaaataacaaccctccaattatgagaagaaggccagcag

SEQ ID NO: 35349 - DNA, 645 bp, Heterodera glycines
ttctttaaaagtttatagtgctttcgctttacataaataagacatacgctattccacattggagccaaggaaatgctgtaactgagagatcctttaggactttccataatattctctctaaatatatttctaagggaaagagtcaaagataagagcccttaatgatgctggaatgtaaattcttggcttagtgtctttctgacgaaaatagagaatattagactctatgcataaatctttggccaatattgatagtctgtctttttcttgcctgagcatttcatttggaaattcacctgactttaagaattgaattaaaattgacatttccggatcctcattttgttccttttgtatgtcaacctgttttatttctccttcaatgttacgaatggaaagagttagcccaaatttctcatgaataattttaatctcggaatttcgtttttaaatttcttaccatgggtggggcgcgaccgcggcaatttgaatctgcgatgcgcgaacgcgggatctttatgtccgcgctccatccctgtttcttactaaaattttgtatttctaaattttgagtatgttaatggtcttaatcagtttaatgtctccaagtcgaatcataggcgtcagccgatcacgtatggaagc

SEQ ID NO: 35350 - DNA, 670 bp, Heterodera glycines
  misc_feature (22)..(22): n is a, c, g, or t
aattaatttgaaaaggcaaaanaatgcttcgaccaaatttataatttttcgctcagtcatcgacagttatttaattattttggaatttgcattgacattccttcgacaattgtttacattttggaaatgattactatcataaagcataaacaattttcaaagtcaccattttacaaattgttcttcatccgtgccgttgctgtaagctctttaaaaaaatatatttcaaaatttatttaaattggaatttattttaggatattcttagtttagtgcccaattccttgggcattttgcttccagcattctttggccaacaattgttgtcaatttacagcaccgtaccaaattgggcaatcgtcttgttaacctttttcacaaaaactttggtattccaagtctcaaacattgtgacagttttcattttgttgaatcgtttcactgcaattgcatttccattgcgtcacaaaatggtaattaatatttaaattaaattaattaatttccgttttttttaaatttttagctatggaaaaaacactttaggcatctgatggtgtttttgttgattgtaccaatgctaattacttttccaataatgcgaatgcgcacaatcattgttttttatgacagcaacagttttctcttagatgacaaagacccggtaaaa

SEQ ID NO: 35351 - DNA, 911 bp, Heterodera glycines
gtttgcggtaaaaaatgagaaaaaagagatagctattttttggtcaagaatttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaatagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaatgagaaaaa

SEQ ID NO: 35352 - DNA, 810 bp, Heterodera glycines
atgaagccgtttggggggggtgacgtagaaacacgtcatttttacgaagggatgggtggctagctgtgcaagcaaatgcttcataccaaaatgacactgactacacaggtcagagacttctttcggcgaaagttcgacccgcctcccaattttgcctatttttgtaaattctctcccaatttggagccatttcccctaaattaattgcttattactattcattattcactcgattgagttcatttttaaatcatcggtcgatccttcgattggtcccaaaagagtgccaaatgcttccgccaaatgccgtccctttttccatttaaacaaatgaacggattttctcttttagcggtttccggcaattcaacttcttctgcttccaccacaaaattaggcgccattaaagaagtggaagaaagtgaagagacagtgcagagcagagaaaacgcagaagaagaaggactaccagagaagcagagaaagcggagagagagtgtgccgaggcagcaaaagaagaagaaagggtctttgtgcgattggagcgcatcgtccgcttcgccttcgtccggaagcgaagaattcgaggaagaagggcgggtggaccatgacgaaagcgaacagcagcttttcgtcgtcaatgtgaccagcttggacgaggttggagaagcgtcgtcgtctttggtgacccccctccgccccctccccgccgcagggtcccgaagtgagtcaaaacgagtgcgctaacggtcgccgtccctcggactcgacttccgcctcctcctcctcctcctcccactcttccttctc

SEQ ID NO: 35353 - DNA, 1159 bp, Heterodera glycines
tctgaggccgcgaagcggccgaattaatccataaatataaaaagggtgcggaacgcccgtcctgaggccgcgaagcggccgaatgagtccacaatatttagaagcgcaaagcgcccgtctgaggccgcgaagcggccgaatgcacttgctcatcacttatcaacgcgcatgcactagcaacgaagtcctttgcgcgaagcgcttatgtcaataccgattatattggggttccagaagtattttttctactttaaagccaactgtgcaccctagttatattactatagagaaaaagggggtttcgtcttaaaaactaatttgagtcgaacggctgtcgggaggggtctgaaagtggtggaagggtcttacaactttttgaggcgaattcaggaaaactataggttttccgctccggtggccaactgagtcccggcggctaatttctcacttttgcttgcgtttgaaggcccgtaactttttttctaaaactctgatcaaaaaatgcttgctggtaggaaactaagttgaagtgttttctaattttaaaaaaaaattccaggcctctacctatacttggaagagctgcagaaattggcaacttttcagtaccaactttattccagttcagtccccgttgaataactcattaggctttgacctgagcgcagggtggccagcagacttattgtagagctttggaagctcgattttctgaaatttaaaaatttcgaaaattttaaaaatttttcgagctaggcctaaaaaacggttttttggtttttgaattttaagaatttttaacgatttttcccagaaaaacgaagaccacttccaaaacatagtttttcgagctctatcgactggtatttttttcagaaaaatttcgattttttcccggaaatagaaaaaaattttggcctgagcgggacatttgagtcccgggcccataactcgtcaggagttggttttagccaaaaatgacctcagagcaaaattgtagagctttttaagctctatcgaatggtgtactacatgtttggaaattttcaaaaattttcgagctaggccccctagaaattttcgaaaattttttttgggttgataatgtaggtcaaacatatttttctgtggtaaaataaggtgctgagtacgaatatga

SEQ ID NO: 35354 - DNA, 1421 bp, Heterodera glycines
  misc_feature (1227)..(1227): n is a, c, g, or t
gcttcattaaatttaatttaaaaataattatcctttatatattttatttttttttagtttttgtattgatttttattaattaattaaattatttaaaaaatagttaggttatgggatgatgatatttgaaaagaaagtgaaatttatgaatattgatcggatcatatagattgggtattgtgatagaagttattttaattgtgattggatgagagaggaagaggatttttttattgtcatctccatccccgctctgtcccagaatgcaaaaaaacgcacattggcaaattttcaaaatgagttttaatttcaggataaaaaatcatataaaaaatctcaggatttgagaaaataccccaaaaggtttgggatcaaaaaggaattaattggcaaaagaatttccttcacctgtcactttggtgacaggtggatgattgatgaccttcacgcggcgctgcgcggcgcgggaaaaaaacacccgcgaggatttggggcatcggatttggttaggcggctacatcatagggggagtcaaataggttttggttttgaaacaccccccatcgtgggtttttgatggggcggcaacttcaaagggctgcgccctcccataggcacgggctcgtgcgggaaacacccgcaaccaacccgcaaccttttggaactatatactactaaggtacaatattaatggaagagttcgggagttaatagatgttgggatatatcaaaaaaaattttatttatttttacatatagttatcatttaatttaggctaaataaaataaaattaaatagattttaaagaaattttttatgtgcaaatctcatgtctgaaacattttggttttatttaaaaaaaaccttatcaacttttgcgaaaagtatgattaaatttttaattttaaaacattcagcatagctgattaaaatttaattgaattcaaagataatagataaaaaaatccaaaattattttgaaattaataaatttgtccatgcaagtgccggtcccggatttgccaaaatttgcggtcccgctcaacttctacaacaaacgataaactatttctcggattttcagtcttaagaatgacgagttttaagaataattttattttatttttatcaacattcaatcaaaaattgaattaaagtattaaatatttttataattactttttaggtaacgaacaccgacaaaaaagtcatttctgcttatatanacttttaaattcatgaatgtttttattgatattgccacatgcttcgaataaaaagtcatttgtgcttctgggcttataacttttttctttgtcaaacaaacttaacaatctttgtacattcgaaagctctttacaggctatattagccttagaaagaaagattgataagctatgaaaaaatattctgaaaaaac

SEQ ID NO: 35355 - DNA, 914 bp, Heterodera glycines
ggcatgaaccagggatggcattccgaggcccaaaaatgtcggaaatcgaaattcagtgccatccccggcatgaaccagggatggcattccgaggcccaaaaatgtcggaaatcggaattccgtgccatccctggcatgaaccagtgatggcattccgaggcccaaaaatgtcggaaatcggaattccgtgccatccctggcatgaaccatttcatggatttacaccgcccaaacaagtatgctctccaaacttcatgtccgcagttttttatttattttcttgacaatactttttgatgtttataatgatatatctcaatactggtttggattaatgttttgctttctggataaatattttacaattttgcaccagtaaatttgaaagttgttagcgactatttgtccattttttgcacctaggtgagagttttttagaacctaaaaactaactgattttgacaggtgttagaaagaatgtgtttaaattttgaaaaacgaagttgcctgagactgtgagaatgacaaaaagccgataatttctccagatagctctctccagcccttctgatggagacgaacgattgtgtgtgggatcgtaagaacacatgaatgtgcaacatggcttaggaccaccaattaggagtcataagggaatttatttattcgttttgagaggcagctcacaatgagcccgaaataagtgagtccagaggcaactacttccttagcttaatgtgaattgccgcagaaaaacgctaaattaatacaagattagttaaataactattttttttaaataaaattaaatccaaagaagcctccttacataattacctttaataggcttggagcaaaattaacttaaagtaaattaaaaagaaacgaattctgtaaaaactaatctttctcat

SEQ ID NO: 35356 - DNA, 917 bp, Heterodera glycines
  misc_feature (869)..(869): n is a, c, g, or t
tgatcagtctagaacgttgggtgataaaatgaaaaaaataattaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaatgaaaaaaataattaaaaaaaaataatacttgtgtggtattaattcataaatattttttttcagaaaatgctctgaaacgcaccaaattttatttacatgttagtttaggcactctgatgctttttctatcaaaaagggagatgaataaattttaaaaaatttttaattcctttttaaacaggccaaaaagtttaggcttaacttttttttcagaaactgatcagaagcgcaccaaacttagcagggatactgaaaggaagagaaataacctattttaaatattatctagtcagttcatttaaataatttttatccaaaaaaaatttttttttggatttcngggcagtaccctgaaccgatgcgcccagatttatggggagaccgaatc

SEQ ID NO: 35357 - DNA, 100 bp, Heterodera glycines
atttagataaaaataatttattcaaatcataaaagcaatgagttcttatatattgatattcttgatattcaatttcctgaaaatttcctaaatctttgag

SEQ ID NO: 35358 - DNA, 1425 bp, Heterodera glycines
agtgctaacggaaggcggaagtcgacgggggagcaacgcgagacggaaaagcagcaccatcggacggatgaaggattggatagcggagcgggcgagcaccatcctcgtcaacaaagtgacaattgaacaaaacaccgggggaaggccaaaaacagtgccaaatttgcagatttatcccgaagagtcatcggacgacgaatcggagacggactcagaagaggaggtggaggacgagcagctgcagagggtagaggagcgggaagtggaagacgaaccaatacagctcgaagcggtggtggtcgagcggaggccgctgctgagggaagcggcgatcagaggagacggcggactggcgaacgcaacggacgcggggggaaagacagcggcggaaatgatcattcccgacagacgtggtctgtgatcagaaaaggatcgctgaattcaacccattgatcattcgttaagtgtcctttggctccattctctcaagccaacaaggctcaatgggcaaaaggaaggcaaagaaagcgccgaaattgccgaaaaattacgccgacgcattgcttcggtacgacccgagcaaaatccaagcgattcaggcgagggaaatggccaaactgcgcagagaaggacgaagtgcggactttaggtggaacaaatttgaaagaaatttgaatttaggaattaaaattggaaaggtcgcgactttttgccaaattcactgccaacaaacgcttcactcaaattgtggaatcgaatcagcccaaacaaatggtcagcagcagcatccaaacgtcgcccgtccaatcgccgattccatcgcgccgaacgtggcgactccgacggattggctgcggagttggtagggaccaaaaaaaaccaacaaagaaacattgattttgaattttgaaataaaaaatactaatttgcaaatggctcaatggatgcttggttcacaattagtcgaaaacaacggagagagaagcaggaaaagaatgagggagagagaaaaaagagagagaaaagtagagaaatatggggggagagagagagagtgaagcgagaaggtgagataagatggtatagaatgagaggctaattgacctccaagaatttatttaaatattaagggtagctaggaaatattaagcttaataaagtttactcaaaatttattttaatgttaaaagtcagttgattaatgatttaccatttaattgagggtcaatccttccctgacttttctaatcacttgtaagcatttcgctttttgtcccttcgctcttcagagtccatggactccacgtcgacctccgagatcaacgggctgaccacctcacggacggaaaacaacagttgtagtgccaacgacttggactccctctattccaacacttatttcgacctgcgctttggcggatcagt

SEQ ID NO: 35359 - DNA, 912 bp, Heterodera glycines
  misc_feature (48)..(48): n is a, c, g, or t
  misc_feature (55)..(55): n is a, c, g, or t
  misc_feature (60)..(60): n is a, c, g, or t
atgcttcggggagtattcatgacgcatttgagcaggagaaaatgctgncatcacnaatgntacagcaaattcgtgtgagaattttatgttttcaaatttcaaaattgaatttctaaaaaagactttatagaattgaaataaatacattaaaaacattttgaataattttcttattaaaaaatttcttacaaattagctaattaaaaaaaaatcattttttaatccgtcccaattttttccccagtttttaactgcaaatagagataatatctattaattaaaatgctaaggtgggaccggacaatgctcgtgtggccattgtcaaatttgcgtcagttggcaaagtgcgaacagtgcatgcttttgattcagttcaaaacaagcaaacggtgcttgacgtcatcaaaaacatgacattcagtgacgggaccactgcaatacattccgcactacaacaggtggttgatgtgaactcgtgtattcaattatccaattagttaattgagtggtatttatgtattcaattaattaatcagtttttgttctattaattaagtaattagactaatttgttattttggtgtattaattaactaattatctacgtattatcgctctctactgtcaatgcaccctcatcactttgatccgatccaatcacaacaagtatataattatttgatcacccatatttcatatgaaaaaatgctaattggaaatttaaaaaaatcgtccaatttatgagataagaataaggagatcagtggcagcgattgctccaatggatcaatcaggtcagtcatccccatcgacggttctgctgagaccagctgcacgtatatgcaggcgaatacgttgacacttaaaccaccacaatcactgagtcatcccctttccttgtaccacccattg

SEQ ID NO: 35360 - DNA, 1202 bp, Heterodera glycines
  misc_feature (50)..(55): n is a, c, g, or t
  misc_feature (57)..(58): n is a, c, g, or t
  misc_feature (61)..(70): n is a, c, g, or t
  misc_feature (72)..(74): n is a, c, g, or t
  misc_feature (76)..(76): n is a, c, g, or t
  misc_feature (86)..(89): n is a, c, g, or t
  misc_feature (91)..(93): n is a, c, g, or t
  misc_feature (97)..(97): n is a, c, g, or t
  misc_feature (99)..(101): n is a, c, g, or t
  misc_feature (103)..(104): n is a, c, g, or t
  misc_feature (179)..(179): n is a, c, g, or t
  misc_feature (191)..(191): n is a, c, g, or t
  misc_feature (237)..(237): n is a, c, g, or t
  misc_feature (246)..(246): n is a, c, g, or t
  misc_feature (264)..(264): n is a, c, g, or t
  misc_feature (311)..(311): n is a, c, g, or t
  misc_feature (320)..(320): n is a, c, g, or t
  misc_feature (322)..(322): n is a, c, g, or t
  misc_feature (341)..(341): n is a, c, g, or t
  misc_feature (343)..(343): n is a, c, g, or t
  misc_feature (350)..(350): n is a, c, g, or t
  misc_feature (352)..(352): n is a, c, g, or t
  misc_feature (387)..(387): n is a, c, g, or t
  misc_feature (397)..(397): n is a, c, g, or t
  misc_feature (436)..(436): n is a, c, g, or t
  misc_feature (460)..(460): n is a, c, g, or t
  misc_feature (470)..(470): n is a, c, g, or t
  misc_feature (472)..(472): n is a, c, g, or t
  misc_feature (1134)..(1134): n is a, c, g, or t
  misc_feature (1192)..(1192): n is a, c, g, or t
atatatttaaaatttaataaaagtgtttattattttattcaataagctcnnnnnngnnttnnnnnnnnnngnnncntctttaaggnnnntnnnttgntnnntnnttatttatttatgtgatatataatgagtatgtaattgaaattgtttattatataatataattttatatgatttantgagtttataanatttaaattttattattttgattataaatgatagttttttaggttngtagagaanggaatgattgtattttgntgttttatgaagaaagaaaaagatatattttttaagtttgatgaganggaattggntngaagagttggggaataagngngataggngntgagttagaaaaaaaaagaattttgtatatttttngtttgatttnagtaataaatgggtaattttaggtttaagttttgaaatnttaaaggatttgtgggatggagangataggtgtngnaggggaaaattttataaaaatcccaagttttttcattttaaataaatacgacattgaacttatgggttttgagcgtgaaaattgcattaaaaattaatggtaataaaaagcattttaaaatttagaactctttttaaagttaattcaaaattaaatgtgattctgaaatacagtactactaaaaaagttaaaaatatgtaccaatatgtaaataaaaaatttatgatttttttttggtggttcataaatattgtattgaaaattaactttataaatttttcaataaataattaaataaattaattttaataaaagttagaatgtttcaaaataagaaattgcacaattatttttatttcttgtatttatttatttatctaacatgataatatcacatccttttttaaatatttttatattattattattattataattaaaataaaattattatcatttaataaatctcatggaatgtcatagcgcttgtgtataaccgagtggaagcattccatttgttgctttaacgtggggacaaaattggaactttcattaactgtttaaaagcttttcgatggattataataataataatttatattatattacttattttgatcaaattatattttttaattaagaatcttattttgctagggttntattattatttaaatgctttatttgccttacattttttttattatttcctttagattngtagctcgaa

SEQ ID NO: 35361 - DNA, 745 bp, Heterodera glycines
attattagggctgggatttttaggtgctaaaaatcccaaaataggtactaaaataggtgctaaaaaagtgcaaaataggtgctaaaaacccccaaaaaaggccaaaataggtattaaaaattcaagaaatcaagtgtgtttatgcgaaaaaatacaaatttttaacagtctatcaatttcgcgaaaacaattgcaaatcggatacattcgaggtgttcgggggtaaaactcattcgattatcggccaaaattgatttgtaaattgaaaaactgcattcaacgtcacaagaagtcaccggcgcatatttcatagattccagtacgtccggttccatatcaacatccgcccgaccgccagtcaaaattttggcgatatcaatcaatttaaggaaatgctgtaagaagtggaaagaaagtcgaaatttaggggtctatttttcaattttttgtattttccctcattttgtggctttttgataggtcaatgaggattttttggaaaatgaggatttgaggatttttgtggctttttaagaaattttgaggatttttgaggcttttggggaagatcctcaaaattttttaaattttgataaattggcataatgtttacaattatttaataattgggtttttaatagagcatcaaaacgaaaatctcacccaaattttcaaaaaaaattttgctaaattttttataaaaaccagaaaagaaccaattttttcaaaaaaaaatacaaaatta

SEQ ID NO: 35362 - DNA, 142 bp, Heterodera glycines
ttttttttttttttttttttttttttttttttttttgtttattttttacatgttttttttttttttttttttactttttttttttttttttttttttttttttttttttttttttttttttttttttttttttttttttttt

SEQ ID NO: 35363 - DNA, 1237 bp, Heterodera glycines
  misc_feature (22)..(22): n is a, c, g, or t
  misc_feature (65)..(65): n is a, c, g, or t
aagtgagcgcttttggtttacnttttgaaattcttagtacattacaaaatgattttaaaaaggcnatttatatacacgagcattttacgggggctggaatttataaattctgagaatctcgtaaatttgctaaattttcacttttatcattggcaacactgctgaattgtgtgtgcatcaatcagttgccataattctctgactataacagcaatgggtgaattttaaaagatctgaaccttttaattaatgccgaatatggtaaaagtttgtaaggatcaaacgcagattttcggaacatataagcgcacctcatcatcttatcaagggcttcgagcagtttagcaaactcttttcattgtttgagtgtttttattattgtcgagcaatttacgaaagtgagcgcttttggtttaccttttgaaattctgagtacattacaaaatgatttttaaaaaggcatttatatacacgagcattttacgggggctggaatttataaattctgagaatctcgtaaatttgctaaattttcacttttatcattggcaacactgctgaattgtgcattaatcagttgccataattctttgagctataacagcaatgggtgcattttaaatagatctgaaccttttaattaatgccgaatatggtaaaagtttgtaaggattaaacgcagattttcggaacatataagcgcccctcatcatcttatcaagggcttcgagcagtttagcaaactcttttcattgtttgagtgtttttattattgtctagcaattcacgaaagtgagcgcttttggtttacctttagaaattctttagtacattacaaaatgatttttaaaaaggcatttatatacacgagcattttacgggggctggaatttataaattctgagaatctcgtaaatttgctaaattttcacttttatcattggcaacactgctgaattgtgtgtgcatcaatcagttgccataattctctgactataacagcaatgggtgaattttaaaagatctgaaccttttaattaatgcccacccaatatggtgaaaagttgtaaggattaaaggcagattttcggaacatataagcgcccctcatcgtcttataaagggcttcgagcagtttagcaaactcttttcatttgttgagtgtttttattattgtcgagcaatttacgaaagtgagcgccttttggtttaccttttgaaaatctgagtacattac

SEQ ID NO: 35364 - DNA, 787 bp, Heterodera glycines
cagcttgctgcctgaggtcttgctatgagatacatttccaattttttgactcgcccccactggttgacaaagacggctttcgttttgcaattagtcggtcaacattcggaaattggtctcgaattttttcggcaattaaaatttattaatttttttagcgcaaaatcaacaacaaaagcgaaattttcgcttttttgcttatttttgacataatttattaattttaagaaaatttaaatttattcaatattctcgagaaattttggcgaaaaaatgattttttgaaaaatttttcgggttttgggctcaaaaaggctaatttagctactggggccgttctaatagaggtttttttgaaaaatgccaaaatatggacataaaatatggaccaaaatgccaaaatatggaaatatggacataaatcgcgaaatatggaaaaatatggaaatatggatatagaaatccttcctagaagcttcaaaccaagctaaaaacataatttttattcactgatttcagtgcaaatgagtagggctgggatttttaagggcaaaaaaacaaaataggtacataaaaaaataatttttaaaattaaaattcttgccacgaaaatacctttttgagaaaattttttttcatttcctaggagtgctttttgaaattttttttgtcgattcttaggggtgtattttttgaaaaatttttaggtcgattcttaggggcgtattttttggttttattgcatttttgttaaggaattttgcccaaaaatgtcgaaatagtaaaa

SEQ ID NO: 35365 - DNA, 206 bp, Heterodera glycines
tttttttttttttttttagtttttgttttttttttttttttttttttttttttttatttatgttttttttttttttttttttttttttttttttttttttttttagaagagataggaagggggagggggaggcggtaggtaaagggaaaagaaacccggtattttttttttttttttttttttttttttttttttttttttttttt

SEQ ID NO: 35366 - DNA, 732 bp, Heterodera glycines
ctgaagtggccaccgccgaagagctctgtccaacaaccttacagcgcgactccgctttgtagagcagagtgaagggaaacgctgcccttcgcattgtgaccttgggcgcgcactttgagacgtgtgaactccacaatttgtccggcacaaatgttgctcatgcgcggcacacactcctgccagccgtgcatcgccatttcgtgctccaagttgtggtggtcaaaaatgatgcgcacgtcgtagccgcggatgtcggtttgtgttgtgaacgggccggccaggacgacaaggcccacgacgcggctgaaaagcggaaaatggaaatgctgaaaataaaataaaacaaaaagctcttacttcatcaccatatctggttgccactccaaatagatccaccaaaggtttgagaaaccattctcaccaattgccggcacaacggacgcaaattcgggctgaatgtgtttgttgaccatcttctgcatctgccgcgcatgcacaagtgcaaccgcctcacgcacactgggcgggagcgcctttaaacgaaaaatgtttaattttaaaatttggtattgccaccttcttttcctccacattgaaaaaaatgtttaaaaaaatgccacctcaagtccgccaattccgcctccaacagtaccgcgcatcgaaggcgtcccaacaccggggcgagctgcacacgaagcgtcacccccgccggccgtcaccagagcggcaaaa

SEQ ID NO: 35367 - DNA, 842 bp, Heterodera glycines
tgaagataaattctttaatccatttttgaatatatgtgtgatttgttcccaattttttcgctattttcgaattaattttattccattcttttgctgaatatttactacctttttgcttaattttctcttttattttgtaatatttttcaattttttctcttttttcttccaatctttcttcttctttttcttcctatttttctccaaatatttcatcaaatgactttttttgcaactttttctcttctgtttcaacttttgtaatttcaacaattaaaaatacaaataaaaataaaaatggaaataaacaaaatttcatatttttcaatgttatgcttaacaaaattataaacttcacaaaaaaaattactaatataataattgatgaatgaattgttaaaatattttcgattaatttaggaaatgcttttcaacgctaatcattgtcaattaaaaaataaaagcgttggattgattaccaaaacgaggacaaaaatatgtaaatataggacaatgattaaatattacaaagattttcatttcctcaggaccaacataaaaaacgcaacaacaaatttatgaaaaatgagaatatctttttaatatgccaatttttttttacaaaatttaatcaaagaataatatttcgtaataaaatataatccgggaccgggaccttttcgggttgaaaaaccgggaatttttggctggtaaaaccgggaaaaaaatgagacaagtcccggtcccggtcaaaaccgggaccttggtactcagttgtcccgcttttttcattaccaggtcccggtcccgcttcactctaatgaaaaggtaaatacatttga

SEQ ID NO: 35368 - DNA, 955 bp, Heterodera glycines
  misc_feature (916)..(916): n is a, c, g, or t
attagctgccatgatgaatgcaggaaatgccaaaaacggggattcgtcggggatggcagcttagtcgatgatcaattgtcatggcgatgtggtgatgtggtgattagttgtggcagtgatttttttttttcacccaatgcgtaatggtgatcagaaagctttcaagtgctgcttgctctgcagttaaaaccagttttctcattctctgcccctctctctttctctgttctatgtcagtcaaagactctctcatcagtgtgcacctttctctgtcacttcctttgcgcttgccctctgcccccggtcggcccttcccccgccccgcctctctctctctctctcgtctctccctctcccttcctctctctctatctctctcgcccctttctctcctctcctctctctccactatctctcttaactgtcggtctctcctcccattttcattcaacaataaatggcccccgggtcccacccattcttccattggctgcgctcattggcagaataaaaactgtttaattcttcttattattagtaggcacctatcaaagtatcatagttattatttttcaaaattcaaaattaaattattaaaaaatttattcgtgaaaaagtatcaaaaaatatatatatttctaaatttttccatagaatgtttccccatttcttgccaaaaaatatggcaccttcggtgcccaacaatcgggcacatcatcagcaccaccaaatgccaacaacagcaggtggacaaatgctccccttagccatcaacatcccctcagggcaaatagcacttcaggtagggtgattttatagtatttttatttgttaaaatattttattatttttataaatccattaaaatattttttttaaattccgtattaaaatattttatataaatcgaaattanaatattttataaaatatatccacgtgccacattttgttt

SEQ ID NO: 35369 - DNA, 1634 bp, Heterodera glycines
  misc_feature (143)..(143): n is a, c, g, or t
  misc_feature (1237)..(1237): n is a, c, g, or t
aaagaaaaaaaaaaaaaagaaaaaaaaagaaaaaaaaaaaataaaaaaaaaaaagaaaaagaaaaaaaagaaaaaaggaaaaaaaagaaataaaataaaagaaaaataaggaaaaaaaaaagagagaaaaaaagagaaaggtnatgaaaaagaaaaaaaataaaaaaaagaaaatataaagaaagaaaaaaaaaaaaaaaaataaaaaaaaaaaaaaaaaaaataagataaaaaaaagaagaaaaaataaaaaaaaaaaaggataaaaaatgaaagaaaaaaagaaaaaaaaaaaaaaagaaaaaaaaaaaaaaaaaaaaaaaaaaaaaaaaagaaaaaaaaaaaaaaaaaaaaaaaaaaaaaaaaaaaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagggggggggggggggggggggggggggcggggggggggggggggggggggggggggggggggggggggggtgggttttggttttttttattaaaaaaaaaaaaaaaaaaaaataaatattttttttccccccccccccccccccccccccccccccccgccccccccccccccccaccacaaaaaaaaaaaaaaaagaaaaaaaaaaagaaaaaaaaaaaaaaagcgcgtcaaagtgggggcagaggtgtggtggtggggggggggggggggggggggagaggaaaaaaaaaaaaaaaaaaaaaaataaatatttttttgtgtttgtttgtggtggtgttgttttttgttgtgggggggccgcccccccccccccccccccccccaccttttttctttttttttatttttttattattataggggttggaaagagggggggggggggggggggggccccccccccgcccccccgccgggggggagaaaaaaacaagaaggggtgttggggggggcccccccacccccacccccaaaaaaaccccccttttttttttttttttttttttttttatttttattaaaaaaaaaaaaaaatttttttttttaataaaaaaatatatataaaaaaaaaaaaaggggggggggggggccccccccccccttcggaaaacaccccgggggggaaacaacccccctgaaaaaaaaccacggggggttttttggggggagcccccccgtgagaaaatttttttttccccccanttcatggcctaattttgtcccacgaagacggtattgacatcaccagcagtgccttggcacccgttacggaacaacagctcccagtgctcatcgaaatgcgcgaactacgcatggagacggacacgcaattaattttaatgcggtttctcctcgtacttttcaatgtcccttttatcagtggttcgtatccccttgacagttgatggactattttttaagataattggaaaatttagtgtcgcgtcatttgcgaacacccggcataaacggcacgtcatttgcgaattttaaaaacaaacgtatgcggacatcgccatatacggaccgtcattagcggattgacgatttgcggaacgtcatctgccaattttaaaagccgacattcgcggacaaccac

SEQ ID NO: 35370 - DNA, 672 bp, Heterodera glycines
  misc_feature (645)..(645): n is a, c, g, or t
tttttcttatttttttttacacttctgttgaagaactatgctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggtgttttggtgtgctggcgcgaacttgtggttctaattcgcgttttacggaccgtaactcgggcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggncggtgcctacccatctttacgtgtctt

SEQ ID NO: 35371 - DNA, 977 bp, Heterodera glycines
  misc_feature (14)..(14): n is a, c, g, or t
ggaattaaaaattnttaaaaatttatttcatctccctttttgatagaaaaagcatcagagtgcctaaactaacatgtaaataaaatttggtgcgtttcagagcattttctggaaaaaatatttatgaattaattatgcaaaaaataaacaaataatgaactctcttccttaaatattttttcattgccacgaggtactcactcggccgcttcgcggcctcgtggtcggccttcgccccccctccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcacataaaaagttaagcctaaaatttttggcctgtttaaaaaggaattaaaaattttaaaaattttattc

SEQ ID NO: 35372 - DNA, 881 bp, Heterodera glycines
tgatgtttttcttctcctgaagttacaaaaataataacaaattcatttccatattatttacgcttataaacaacatatggcagattaagataaagatcttttaggccaaaccaaaatttttgtttagtaatttattttgtttattttcatttttatttacaacagtgtccaattttctggtgtccatttttccattggtgtccaattttcggtgtccaatttaccgggagccccccatggggcccaatcgtactggggcccaatcggcggggcccaatcgacccggtccgtccatttcacctcatttccgccaaaagtgtaagtggcacatgtccttcttttggttattcatttattcataaaaaaaaaataaaaagtcatcagaagggcgagaaccacttactctgacgactattccggtaaatgtgtcgtagagtaagtgacaaaatatatggatgatcacaggaattaaaaaaagacaaaaatatgtgaaagtaaataataaataaattgaggtcaaagtcaaatgaggtcgaaataccaaatcacttagaaatttgttacattctagctttcccggtcttacataagaaaagtcagacctccaacaaagggaaaagtagttatttgttttttagggttgtaggagaaaaaaaaaattttttttgaggaaatgtttggaggtcgaggctctaggaaaatccgacattggaagaaacgaccccaaccttaaattttaaaaataatttatgttttttttaaattgaattgattgcattagacgcgttcaattgtaaatgatctgtttttttcatttcataaactcgtttgttatttttacaaaaaaattaatataatatttttaaaaaataaattttttt

SEQ ID NO: 35373 - DNA, 1092 bp, Heterodera glycines
  misc_feature (434)..(434): n is a, c, g, or t
tatttttttttttgctaatctggttctgcgctgctaaatcctttcattggattcaaaaaaagattatggatcagtgatcagcattcgtttaaattgattaaatcagtgatcaatcgccgtgccgatcgacagacgaaccgccgtcgggcagacttaattaactaattaattatattgcgctgattgaatgttgcgtttgagcaaaactctgaaaacattgtgtttgattccgtttgacgtctcgtgacacacaaaaaaaagtggagcattttccgttttcatcaattaaattaacggttgaacgtctcgagagtctcgtgggaaatttgttgcgggtaaatgattcgatgtttcaagacggaaatgactgaaatgccgcggagggggcgggagtgggaagctgaacatgtctggatctatacgggttctcttantataataaccacagcagttcaaatgaaactttaaaaataaaaaaaagactaagaaaaattgcgcaattgttggaacgagaatgtgaaaatcagaaataaattcaaatattatggaaagttaattagacctacacattggcaaattttgactcacaattaacaaaattaccgtcaaatatttaaatgaaaaaaagatgcattgatggaatgacattcttaaaataatcaaaataattcaccatctgttaggcgggtctgaacccatgacaaatggtcatcaaaatttaagaggaaaaaataccttaaattaacttatttttgctttttttcatttgatcaattttttgatcagtttttatcagggcaaaaaagccaaaaattggtaatagatgaagcagccatggattttctagaattttttcatttaaaaaaaaaattttatttgagagaatgtgaaattgtttaaaaatttaacgcacgcaaaaatgttctgatttatcagaaatattctgatttgagggtagtgatctattttcatttgatatcttgaaattaataatatacattttaaaatttatggcataatttgagtattttaaaatgtgttaaaaatgatcataggaggcgaaaaacataattattatttgatacatttttt

SEQ ID NO: 35374 - DNA, 1018 bp, Heterodera glycines
  misc_feature (879)..(879): n is a, c, g, or t
  misc_feature (889)..(889): n is a, c, g, or t
  misc_feature (929)..(929): n is a, c, g, or t
attgtcagaggtagagctgaaattaggtgatgaaacgtggtcttgattaaatttaaaaattttcgactcttgaggacaaaattctatgtctctgttgttccgggaatttaccatttagattcttgaagtcagttttgtttctaatggcagaaagaattttaaattttggctcccgaagccaaacattggctgcctcctcggttaattaaaaatttgactctcgaagccaagattcgattctcgaaaatcagtaaagcgaaaattgattctctaagccaagactgttttcgaatatcagtaaatctaaaatttcattcataaagccaagattctcgagtatcggtaagtcgaaaatcatttattaagccaaggctcgttctcgaatgtcggaaaatcaaaatttgtctctttaagctaagactcggtcttgaaaatttaaatcgaaaagtttgattctataagccaacactccgtctcgagtatcgcataacttctattatctcgatatcatttgaatacatcctaccgatgtttcttgttattttggttgtccatcatcaacagttgttcctcgttcagaccatgctgttcatcactgtcatcattatcccgtttatcgatgttggcattggcaccaccgctgctgctgctactctccgcttttttcgccattttttgctgcattttctttgcccgttcattttcaatgtccaacatgcgttttatggcattgaacaattcctatgaaattatttaatcattatttatttttctatagaaattagcaatggcttcgggggtcaactctcggtctcaggagtctcgaataaatttgggtcttcatttcggccatttttagcagactttcattaaaaattngtatttttantggatttttcaaaaattagtgaaatttttttttgaaattntggaagaggtaagtcttgggaggggatatcaccaagtaaaaaacgaaatttcagcaaaaatactttttttttctagtttattttaaggg

SEQ ID NO: 35375 - DNA, 1804 bp, Heterodera glycines
taatttgcccaacaaaatgtcagacgaccgaaaagaggcagagaaaaaaatggcaaaagcaatgtaaaatcaaaatcccaatttcaattttgttttcccttttcttcagcttcatctccggcgacgcatggctggcggtgtacgatttgcttccgccatcacaagttggactgggaattgcgacgatcagcctccgttatgactattacgtggacgaacatctcaagacgcgaaaatggacactgaaatttatccgaattcgaagcaaaattggcgagaatggcacggaaatagaaattgtcaattccgatggaaaagcattgccaattccgcaaattgaagtgccacgcaaagtcatcggattcgaatacatcagcatctcgtaaaattgggcgcgattatgcaaaaatttaagcaacttttcccctttcattttcagttacatcgaccacaatgtcatcgcttttgtcaaccgttttcgtccaattttcgatgtctgtcaaatcaatttggccatccgatcggcaggtgctcgcgctttggagaacattaagaacaacatttggccaatgatcaaacgaaacatttgtggcattcatttgtgcgaagacattttccaccgtttgcgacaattcgtcccgtcaattcacaacggctgtccatatcacttcgctttgtctctttccgttctgaggatctgatcatcaaatttccgatcgatgacagtgccatgggcttcggatggacaatcgttggccaattggctgttcactcctcgtctggacatgggccaaaggtgttcaattgcgcatgctcgtcgaagcggcggagcggttggaaagcaaaaatgaatggatttaaaacggtagtttgcagtaatttatttagtttaaatttacaatttaggcttttcgcatggctccttctcctgccaatttcattgtcgtcatttcatttccgtttttttctggtgattcaattgtcccttttgttctgaccaacgaagaggaacaattgacgttgcaattgattaacaaccaagcccgaccgttgtctgatcgtccgttgtcccattgtgcgcgacacgaacaactggggaaaattggaggaggaagcgattggctggcaattttgtgagcaatggaacagaattgacattgcaattaatgacaacaacattggagatgggtaagcgaatgcttattcgaaaaatttagatttatttgtatttgattgtttgtttttaagcctctcgacaatactcccggccctagtgatcgccgcaagtgaatgaatgatttgcggagaagtgaccgatcaatttgaattgtggcgtgggataaataatttgacgtttataaatgttctatttattgcggtgatcaattgtattgttaattaggaagtgatcggtctaattgaattatgtaattgccaaatgaatttcatgctatttgacccgtgctcataaaaattgttctctttaagttgggatccattttattgttaagtatgcctttaggataaatttagtaactgaaactgtaattggccttaagaataaccaaatttgtgatttggagttaacagttaaaactttgggacagcgggccaaagatgacctgcaaaaattttggaaaaattatcaaatcaaaaaatgatgaatttggcagtgaccgattcagagccgtacagaataatcattagggatttgatcatgaaatactttcatgtgctttatttgttggttcattagttaattaccgtaagttattttgggaatgtttcggaggactctttttga

SEQ ID NO: 35376 - DNA, 452 bp, Heterodera glycines
ctcattttcccaaccccccgcccccccccctcctattttgatatatcatagataaaatacactgtaaaaccaaccttccgaaattgtcgaactaaacgggaacacaaatacaacaattccagctcttgttgttgtgcattgatggtttctcggtcttccttgtgacgctcctcaatttcttcctctgcttgattggcccgattctccacatcttgaacaactgctcgaaacgcagcttcattcgccggctaaatgtttggcacattattattgggatttttcacattagttgtttaccctttttatatagttttctattttgaacaacattttagctgactgttttttggtaaacgaattgaaaaatataattgttccaaaaaaatataaaaatttttatttttaaatgtaaatagttatttttggcgttttgaacaatttagtcaaataac

SEQ ID NO: 35377 - DNA, 977 bp, Heterodera glycines
  misc_feature (852)..(852): n is a, c, g, or t
  misc_feature (902)..(902): n is a, c, g, or t
  misc_feature (909)..(910): n is a, c, g, or t
  misc_feature (955)..(955): n is a, c, g, or t
tcacaaattcggacatgtccacttcggtgatcagcgaatcgtcccgatcggagcgcaaatcccacaaataaatggcgccggtggagtcggcaacgatcagctccacttggttgggatgcagcacaacggagtgcaccggcgtgttcacctgaaacagaagacagcaaattgcgcagcaaaattttgtctcgcatagtaacaaaaaaacgggtccaaacatgcaaagcacaaaaatttgtgtgcatttcattttccccgcgaaaaatttaaaaaaaaaattcaaacttattgtcaggaaattttcacttgaaaaagtttcagatttttttcttgaaagatttctgtttgaaattttttaggaattttttttttggtgagatagtggtcaaaaagttcgtacatctactgctcgtcacccaaatttagtcaacatcttacttggaatatcctctggcaattcagctgattgttgcgcatatcccaaatctgaaaaaacattgccgaatttaaattttgcggattttgtgtccaactttggccatgcaatcctcccctcccgtgtacatccacgcaccgtccacttggaagcccaccgacgtcacatttttctcatggacactgcagaaaaaattagaaaaatattgtacaatatttcttgggacgaaattaaactcggactttccaaattcgtattgataccccgaattgtgtaataaacagaaattgtattgcaaatcgcagtacgagttggattttaccatcttttgcttttaattagtgtccaattaaacggtaaaaaacaaatttgtgcacaaaattcaaaatttgtctgaatttttgaccattttttanaaggaatttgataattttaaaataaatacgattcaaatttatcataattngacatgnncgtcctttttgcgtttctacgaaaatgtgtgtagtccttgcgcgngtggacattgcaaatcgtaaaa

SEQ ID NO: 35378 - DNA, 921 bp, Heterodera glycines
ctgaaatcagatttcagttttgaccacgttaagacctcagaatccccgtgtgattggggattctggggcatcattttgaggggggggggggtgcgggttcggacccggacggtgtaaattacttttatttttattttataattttttcattgttttaatacatttaaattattaacaaaaaaaaaattaatattttaaataaattatttttctgtgtgaaagtcattcttttaacaccccaaaattttcggaatttttttttgggccacaaggggggtgaaaaatatttttctggagtattttgagcacgaatacgatgtttattttgcgtctcagaatttttaaaaaaatttagcaaaaatttgcaattttttgcccttgggaatttgggttaaaatttgaaaattcatcataactcataatagaattggtcattttatatgcaataaaacaacaaaaatagagaaaaataagatgaagttaatgctttttatgtttattatatgttacatgttacttcaactgtcccctctctataaataccccacaaattttattttttgtttatttaatttctaatttattatatgttacatgttacttcaactgtcccctcaatataaataacccacaaatttttatttattgtttatttattttctaatttaatatgttacatgttacatgttatgttacatctaaggttgcaacaaccaccgcttcctcccaataattactctaccactttttttaaaattttcattattttaatatttaaatgtgttatatgttaaacttaaggaaattttacgtattattttccgcagtttttttctctatcttataaatttattgggattttataatttattagaaaaaagtataaaaataaagtgattttgggattcagaccaaaggggg

SEQ ID NO: 35379 - DNA, 1430 bp, Heterodera glycines
atggaatgttggtgggttgagtcccgttgaatggatgtggttggatgagttcccagtgatgggaatgttggtggatcgagtcccagtgattggaatgttggtggattgagtccagtgaaatgctggtgggttgagtcccagcgattggaaagtcagataattgagtctcagagatagaaatgtggtgggttgagtcccagagattggaatgtcattgaaagttggtgggttgagtgagtcccagtgtttagaatgccggagatttgagtccattgtttggaatgccggagatttgagtcccagagattgaaatgctggagggttgagtcccagtgattgaatgctggtgggttgagtcctgttgattggaatgttggtggattgagtcccagtgattggaatgctggagggttgagtcccagtgattggaatgttggtggattgagtcccagtgaaatgttggtgggttgagtcccagtgattgaaatgtaggagaattgagtgccagtgattggaatgctggtggattgagtcccaatgattggaatgttggtgggttgagtcccgttgattggaatgttggtggattgagtcccagtgattggaatgttggtggattgagtcccagtgaaatgttggtgggttgagtcccgttgaatggaatgttggtggattgagtcccaatgattggaatgttggtggattgagtcccagtgattgaaatgctggtggattgagtcccgttgaagttggtgggttgagtcccagtgtttagaatgccggagatttgagtccattgtttggaatgccggagatttgagtcccagagattgaaatgttggtgggttgagtcccgttgaatggaatgttggtgggttgagtcccgttgaatggaatgttggtggattgagtcccagtgattggaatgttggtgggttgagtcccgttgattggaatgttggtggattgagtccagtgaaatgctggtgggttgagtcccagcgattggaaagtcagataattgagtcccagagattggaatgtcattgaaagttggtgggttgagtgagtcccagtgtttagaatgccggagatttgagtccattgtttggaatgccggagatttgagtctcagagattgaaatgctggagggttgagtcccagtgattgaatgctggtgggttgagtcccgttgattggaatgttggtggattgagtcccaatgattggaatgttggtgggttgagtcccgttgattggaatgttggtggattgagtcccgttgattggactgttggtggattgagtcccagtgattgaaatactggtggattgagtcctgttgattgcaatgttggtggattgagtcccattgattggaatgctggagggttgagtcccagcgattggaatgttggtggattgagtc

SEQ ID NO: 35380 - DNA, 1080 bp, Heterodera glycines
  misc_feature (1022)..(1022): n is a, c, g, or t
gccgtcagatccccgacttagcttcaaaacaggtaaagccacacattctctatcattatgaattttgatcgcctcacttcccggcaattcatggccgtaaaatgcgtttgaatttcacaacttttgccatcgcatgcaacttgtgtttttattttcaacggcgtgttggcgttgtgaaataaatcatatactgtatccatttgcaatttggacaacccttttctatacaaaaaactgggtttacggtcatacagcgaccgccattgcctttatagaaagtggccataaaatcagttcgtttaaagagagaactgcactttattctcatattagccgtcagatccccgacttagcttcaaaacaggtaaagccacacattctctatcattatgaattttgatcgcctcacttcccggcaattcatggccgtaaaatgcgtttgaatttcacaacttttgccatcacatgcaacttgtgtttttattttcaacggcgtgttggcgttgtgaaataaatcagatactgtatccatttgcaatttggacaacccttttctatacaaaaaactgggtttacggtcatacagcgaccgccatcgcctttatagaaagtggccataaaatcagttcgtttaaagagcgaactgcactttattctcatattagccgtcagaccccgacttagcttcaaaacaggtaaagccacacattctctatcattatgaattttgatcgcctcacttcccggcaattcatggccgtaaaatgcgtttgaatttcacaacttttgccatcacatgcaacttgtgtttttattttcaacggcgtgttggcgttgtgaaataaatcagatactgtatccttttgcaatttggacaacccttttctatacaaaaaactgggtttacggtcatacagcgaccgccatcgcctttatagaaagtggccataaaatcagttcgtttaaagagagaactgcactttattctcatattagccgtcagatgcccgacttagcttcanaacagttaaagccacacattctctatcattatgaaatttgatcgcctcacttcccggg

SEQ ID NO: 35381 - DNA, 1387 bp, Heterodera glycines
tttttgcgattattaagctcattggtaggattttcatttaaaaaatgataaaatatgtatcaatttaaaaaaaaactatgaggaatcatattttctttataggaaacccacgagtatacaaaaaaaaaaattgaaaataatctaatttctgtagagggattgaaccaggggaaagaagaagggaaagtgaaggagactagccattaggccatttgcacacttgggcaatgttacttttaaagaatatattaattattattttttatttttccctttgactccaattttcttcactaatttttcactcacaaatcagaccccattcttaccagtgcttgtttttcccggttcccggttgccctaccgggaccgggacctgagcttttcaaaacccggaacaccgggaccgacaagcactgaggacgaatgaattcccggcccggtcccggtcccgctctactctaaaaaaactcatcaaaaatttatttttcattaaatccatttttaaaataaataaaatttttattttcactttgtgttttttcactatgtgattttctaaaaaaaaataatattttaaagcattaattataattattcattctttattatggcttgcaggtgcgtcgccgctgcattacgcggtgttcgggcgccatttggacgtatgctcggcgttggtggaggcgggcatcgatgtcaagcagcaggcggggaagagtggcattacggcactgcacgcggcgtacctcgcgaacgatttgaacatcggtcagtcagccagcgatggcgaaaattgggcaccaatttaattattattattttttttaatacgatacatttatttaattaaatttaaaaaataataatacaggagtgcaccaaaagcatacatatacaaggggtgttgggcggagtaggacaaaactccgtcgaccgaaactccgccaagaaaattttttttttaaattcaaacatagaaaatcttaggaaaattctttcttagaaaattcgaagaaaaaaaaagttcacggattttttagtcaaatttcttgtggaagaagctggcgctgacttggaaattcgcgacgccacaggggaggacggcgctaatgggcgccgcctctgacggactagcggacattgtgcaatatttggtcacgaagaaagcacgcacggattggaaggatgaaaatggtggaggtgatactgcattattatgcaatatttgtttgaccaaaaccgaacttttctggggccagaaaattcaaatcaagcggagtcataattcgttgatcgcaagcggagaagggcagaaaattccgaaaattttggctaaatttcctttttatgttcataaaattctgatattttcccggctgtgcct

SEQ ID NO: 35382 - DNA, 971 bp, Heterodera glycines
ttttccttttcctcctcctcctccgtgtgcttcttctccctctttttgttgctcctcttttgcttcttcaccgtttgctgctgcttcttcttgcgttttcgttgcggaagtggcaaaggcgcggcgacaattgcggcaccgccgcctccgcccctttccgcggcactgctgctgccattttcgtccgtcactgtcagcagtgtgtgttggccttcgtccgatgagtcaaccttaagggatgctctgatcacttccattcattccctgatcatttcaatgattgctcaattgctgatcattccccgaattggactttgtctggccgaatgttcctggccaaattcttctgctgttgttccatcatcagcgagcagtaagtgaagtaaactctcttccgatagcgccatttcccattgtaaattgcatgtctgttgtggtgggtgccaaatgtaaaattcttaaccaacaaatgttcctttgacttgcctaaatttgcgaaggtccctcagaaatttgtacaccggaactgtcatcagacgcaagtaaatttgaacgggaatgaacgccaaagaaaagaaagcgacgaagcgaataagcaaagggttgcgcttcgcgtaaatgcgccgttcgtcgtaaccgccaaaaaaatagggaggggggagggattggcacgatgaaaaagcggcaaaaaaaatgccgaaaagactgaccgaaatcggcggccaaagtgaacgacgcgttgagaatgaggaaaacgcaggtgcaatattggaacatcagctgaacgcacagaagacgcggactacgcgtgaagatggcgatgatgaaaagggacttgaagcagaagaacaccgcaagttggagcagagtcagcgaaaggaccgtggaggggacgagggccgaagcggagggacgcgccggaggggcggcggaagcgacgcccgagggaccgcccggcagcagaagcagca

SEQ ID NO: 35383 - DNA, 1785 bp, Heterodera glycines
  misc_feature (853)..(853): n is a, c, g, or t
ggcaagaatgtcttcattaatcaagaacgaaagtcattggttcgaaggcgatcagataccgccctagttctgaccgtaaacgatgccaactagcgatccgccggtggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaacaaggtagctgtaggtgaacctgctgctagatcattaacccnaagtgattcctattcaccacctacctgctgtccctgtgggctagcgttggcaccaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacatgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagggcccgtgcttggcctagcacgtggcttaagactcaatgagtgtcagctcgggcaccgccagctttttctttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggtgttttggtgtgctggcgcgaacttgtggttctaattcgcgttttacggaccgtaactcgggcgcaccaatgctttgcatgctgtggcggagtgcctggattactgg

SEQ ID NO: 35384 - DNA, 1085 bp, Heterodera glycines
accgaccgttcttttttttcaacatcctgagctaaccatttactgtctaatgtctatttttataatttgacgttgttttgctagagccccgccgggattttgccagggtttccggtcccggtttcaattagttagtacacaaatctgaaagtattgaatgatttactttatgtacctatgtgccaacaacttttcatgaatgaaattatctgtgcgctacttgccaacaatgaaaagccataaaatttttggtctcatgaaaatttctggcataggtacacagaaaccctgaaaattctgtcgcataaacaatcgcattcttattcattccttagatttgtttcatttgatctttggccctccaattttgtaaaaatttgttttatttcaatttttgactctcattaatttgtaaaaactgtcttctttttctgttcaaaattacacttttacataaaaaccccattttagaagacatattcactcgatcaaagaacggcttgacaaatatggaggttgaggtgaaacagcaagagggtttctatctgaaggcaattgtgaccgatgtgttggagaattcgctggacgttgtttatgaccgtggatgccgaaagccggaaactgtggaattcaggtttcaaactcagtgaataagagggcatttctaataaggatatttccatccattcggagggcaaatgaatgaattaaactcggaattggaatgaatttggacatgagatgggtttggacaaaactattttccaaaaattatgaaaatttctttggcagttttcggggttgctgatcaagattattttcgttttaaccaattccaaattcgagaaattaatttttcgatcttttcttagagttcagtttaggcattggaaattggtcgaaatatataccgattcgtgttaagtgaacctgaaatttttattaccatttgaccccaaatggcaaaaattttccttttttgcgcaaaatcgctacaaattcctgttttttttgtggctccggcgctgaaattttttgaaaaacaacaccggtaaaaaaatagatagcccggagcaaaaaaaaaa

SEQ ID NO: 35385 - DNA, 1023 bp, Heterodera glycines
ttttgtaagaaactcacttgacaaagaaacatggaaatggtcaattccgtaaattcaatgattccaaactttcaaaagttcttttcttcttttttgttctttttcgctttgtccagtttcgttttggcatattgttcagggtgttcttttttcaaatgtgcccataaagctgaagttgaactttgctcagaaagtttaatttttgttgagcaataatggcatatgtttttcattaaagtgcgattttgcgtaaaatgttcccaaatttcgctaacttttgactaaatttgatgttaaatttagttttaaaaagtaaagctctaattactaataggatattactcgaattaataagattttataaatcgtgcgaggtgatatttaatttcgccaacggtaagaaatgactaaacaaaaacatcatattgctcaaaggcagcggttctttatttatattaaatttcaaaaaagaattaataaaatttagatttctccattttttggactttgataaaacttcgttatctcaaaatattccctattaatatataaaatttaaaataaatttcaatcaaaattctgaaatagtttgattatacgaaaaaaatttgtacgcacattattggatttgtttcttttgactgtttctttgttttgtccaacaatatcattttgattgtgattttggtcaattttgttgtccatttttctttttaatgtgtcttgttttgcttccaattctttaatttcttgtttatgttcttcttaaaaaagaaattaatatgatttgcagaaaagataggactggcaacatccaattcaagcttttttaaacaaattttaagaacaaagggtttgttatggctaaaggcacgtccgggaacttttaaattagattcaaatacttaaatttttgtagatttgcagaaaaaatgacgattatttgagtgttttgaaaaaaggacaaaaaagatactgtttcgaaacaacatctcgtgcccatttttaggaaagcaatcctaa

SEQ ID NO: 35386 - DNA, 618 bp, Heterodera glycines
ccccccccccccccccccgcgagacttttttttttttttttttttttttttttttattgaacaaaaaaaaaatattttttttttaaaaaaaaaaaaaaaaaaaaaaaaaaccccccccccccccaccccccgtgtttgttttttgtggggcccccccccccccccccccccccccccacaaaaaaaaaaaaaaaaatccccccccccccccccccccgcccgagaggggaaaggaaaccccccccccccccccccccccccccccccgcgaaaaaaaaaaaaaaaaaaaaaaagaaaagaaaccccccccgggggggggggggagccccccccccctttttttttttttttttttttttttttttttttgttttgaaaaaaaaaaaaaaacaactatctttcttttttaaaaaagaaaaagaaaaggaaaaataatttttttttttttttttttttttttcccccccccccccccggcggggggggggggggggggggggggggggggggacaaaaaaaaaaaaaaaataaaaatattattttttttttacacccccccccccccccccccccccccccccccacccaacaaaaaaaaaaaaacaaattatttttttt

SEQ ID NO: 35387 - DNA, 849 bp, Heterodera glycines
cacattccaatcaccgtggactcaaccctccagcattccaatcactgggactcaattctcctgcatttcaatcactgggattcaaatctccggcatttcaatcactgggactcaacccaccagcacttcaatcaccggggctcaattctcttgcatttgaatcactgggactcaaccctccagcatttcaatcactggaactcaatccaccagcattccagtcactgggactcaaatctccggcattccaatcactgggacctaacctcacctggtacttcggcatcgcaatcaccgggactccattctgtgacattccaatcactggaactcaattcttaggctttccaatcactgggactcaacccaccaactttcaatgacattccaatcactgaaactcaacccaccagcattccaatctctgggactcaacccaccaacattccaatcaacgggactcaattctttccagtgagtttattgcatggtattggccgaagagttggcggacatggaaatgctattgggtcggcgagaaatgatgtgcagtatacgcagtcgagattggacggcgcccacccagtttttgtgcgtcaaatggctgttcactcccaactgacagctctgcgtcaatcggctaaccaactatctggtatagcgacaaattcgtccgaacaccttgcttaaaaccctcaagcggagaacattctttgcatcaacaatccgcagcaacaaattggcaatttcagcagaatttgccgcggcaaacggttcgtagaattgacaatgtcggacatgacgattgcaattaccgttgtgacaggagaaacatatacgtagaaccaa

SEQ ID NO: 35388 - DNA, 835 bp, Heterodera glycines
gtccctttataccgtggcaaccgcactcccccccccccccgctctaccgccatccccaccctgtgccgtcctctcgtgctgccccccccccccgaactctttccccgtctcccccctccgctccgtcctctgtcactcaccagatgaactcgattggggttccatgtttacggaggccattctctccgtttgttgttgcattggttgttgtggctgctgatggtggagcagtgccaattggagggccgccgtcaccgggtcgagttggtgccgttggtggagaggagggggcggcggattgttccgttgtggctaaaagcaactttgatggaacatattatttctcatcagtcgcaccacagaagcagcagcaagtgccaattgttgttctacggagagaagggatgacaaagagacggaggacgacggagaaacgcccgggggaacggccaacggatggacggcggacagagaaacggaggaagcgcaagcggagtcgaggagcaacggctgctcttcatcttcgactgctgaattagtggaagaagatactctcggtttctgctggtaatctccatttggcattgttcctttctcagaaaccctttcatccctcttatcccaccccctcctccctcttactctctccactttttcttacacaactctctcccccgctttacctcccccccccccctccttccgaacccctcttccgccttttctccctcttccctcccctcttgtctcgtcccttggacctgggagttttctcaatgctcgacccgacattctgtccgaccgtgccccttccctgtctgtgttcctcttctcc

SEQ ID NO: 35389 - DNA, 811 bp, Heterodera glycines
gtcttccggttcggttattttacaaaaacggaaccgggagtcccggtaagatcccactgggtcccggtcaacagtcaattgagttataagaagggatagacgatccgatcgtcttttcagtatttctcattcacagtcaaggttagctaattagtgttatggtcaatttgcagccactctcttccccttttcgtctctcattgtctcctattctctccctctctttttaccccttccattctctccccttttccttttcctcttccatgtctctactcctttcttcctcatccccccttctctccttccttcttcagtgggatgatcaccaaaactgacactgtgtgaatattattccgatgtttaaatggtccaattcagaaaaaaacgatgaatgggtgagatctgaggaaaggatgagaaaatatgagtggaggacggacggaccgaccgaccgaagagattgtcccccaccaccgctcgtttccttttctcacagctcacgccccggcactctatggaagtgcaaattgggaatatgcacttcccgctctccggagatgatgatgatgaccccatcattcgacgtccggggccgttgtttgcgttgggggagggggaagagccgctgagggcgcggaggacacacaaacagccccagggaggggggggggaagccgagtgatttacgacgagaaacggaacagtcatcccacatccatccatcttcatatcgtcactcatcgtcatgacaatgtcatgtccatctcacatcacttcctcctcctcccctcctctgatcacttcattt

SEQ ID NO: 35390 - DNA, 748 bp, Heterodera glycines
  misc_feature (733)..(733): n is a, c, g, or t
tctctattttaattttttaatagatttttaaatgtttggattttttttggcttaccaaaacttcatcgaacctggttctttctattctctttctaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcgatattaagcttatttccagaaaatctcgcatgaattctcatttttatttttttaatagatttttaaatgtttggattttttttttggcttaccaaaacttcatcgaacctggttctttctattctctttcaaatcaccccaaatttttttttacagcttaactaggccctattaagcttatttccagaaaatctcgcatgaattctcatttaaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcaacgagctagctggctcaaaaaaattttcgaaaatctcagaatgggtttttatttattttttgcaaaanttaattcttaaatat

SEQ ID NO: 35391 - DNA, 1178 bp, Heterodera glycines
  misc_feature (44)..(44): n is a, c, g, or t
  misc_feature (1080)..(1080): n is a, c, g, or t
cgcgcgttgcttttctccgtgatcaatcagccaccggtgcaaangccggtttcagcgtagaaaagcggcgagatggatcgctgagaaatcgataattatttattgattagaattaaaaaatctgttaccgttccaactcttcaattacggtattcagaatgaactgtacaccgaccggaacaattgcagcttttgctttaataaagcataaatagattaaaaaactcgatcaaatatttgggcttgaagtatttttaattatttgtataagcttgataaacaatttgtttaaatacggttaattgtggtatttaaaaaaaaaaaattcttcaagaaaattttgaatttttcatgattttttagtataattttttgtcttttaaccgaataaaaatagcgtttaattatttatttaatattaataaaacaattttgttgaacttacttcccgtgtagtaatcgtcggccgtcttcagccaacccaaatcgtcgtgtcttaaggttttttcatataattacgcataattatgcattaattagtgctaataaaatcgagatgggcaggggtcgcggttttcttttcggctttttcgactttttttttaccgaaaccccctaataaccgatcgaccatttgtgccgatctcaactaataattacgtgtgagcaattaaatgaacgttgattgcacccggttttgtggaccatttgttacaattctaaaaaaaatttttaattttttaaaaattattttttaattttatggacctgccaagcacaattttgtgacgctttgccaaaaatcagtgcatttataaatataattagtaaaaataacttgggcattttttgaacaagtgacttaaagcattaaattaaaacggaaaaaaaggaaattttatttaaattcaaaaaatatttctttccattaatttataaggcaaaaaaatataatttaaaaaaaacttaaaaataaactattttatgatttttatggataaataataacttttttattttatttattgtgaatgaataaattggaaatgaatttaaaatccttttatttatttttattanattttcatattatacatattttttcagccatttaaaaattattctgcagatagagcaacaactgtttaatgttttgtagtaattgctccaaaactttt

SEQ ID NO: 35392 - DNA, 1027 bp, Heterodera glycines
  misc_feature (897)..(897): n is a, c, g, or t
  misc_feature (915)..(915): n is a, c, g, or t
atggaattggtggaaggttgcatttaaaatacccttttggtgaaatatttttgacacttttcaatttttttaatgtttttttgaagagacggattccaaacctcctgagcgtattccaataaaggcctaatataagttttatataacgtaatccaaattttagacgatttggatttaattattcgaaacaaggaacgcatacgtaaatacgcattccttgttatttggttaatatgatcggaaaattgtaatttgtaatcaatgtttactcataaatccctaattgtatccacagcatttattgtattcccatcaaatttatatgtttttgaacccaaatataataaaaaagttttttgaactgaaacttttatttgccatttatttccattcgaataaattatgcaatgctttgtgcataatttataagtcggatcttgctttataggatatatacattttaacatcatcagcatataatttaatattcactcctgatggtaaggcatcaggaagatcgttaatataaatcaaaaataataaaggtccaaggacagagccctgggggacgccagagccaacttttttacttgaggataaagaatccccaattttaacacgaaaagtcctattactcaaaaagctttttatccacattaaaagtttgccacattaaaagtttgccccgtataccaattttttccaatttgtataacagtaaattatggggcactgagtcaaaagctttctgaaaatcaatgtaaatacagtcaacattttttccattaataattgcatcgtacaatcttccacaactgttattagttgactcgttgtagacctattcctaacaaaaaccaattgatattccgaaattttgttgttttttagtagaanatttgtaatattcctgcntagaattttctttcataccctgcaaagtgagcagggtatagaaataggcctataatttttaggattaaatttaatccccttttttgaaaagagggaaaataactgattcctt

SEQ ID NO: 35393 - DNA, 1270 bp, Heterodera glycines
ttcttgtaagaattttcagatgacttgagaaaaagtttaaaccagaaaatcttgcaaaaatttttgtttcttcatcacaatttgcttttaaccggtttctcaattgaatgatttatgttttaaattaaaatttttttttgaaaattacggattacggcctttttgggcccaaataagcatgttattcaaggtctaaaaccaaacagaacttagtgccttctaacgctacgtttagaaagctatatgattgacaaaaactcaggtttccatgggttttcatttatatacctaaaaagaaatccctattaataaaatgtaattcctttaatttattttttaaattttcaattgaaaaataaagaattcttgtcgaaaaaattaatttaaatgtgacaacataaggagagatgaaattatatatcaaacgagcgactgggaaccgcttcacggtttccactaactcgatttgttttaaaatgttaaagcacatacccttgcacgccacgcaaatccgagttcagtttgaccaatgcttgtctggcatctgtactgtttgctgtctgtagaactaaatactttggtttagttgactttgtatgtattgtcccccctttgaattgaccaaaagtgcttaaatggattaatcaaaaaatatataaatttttaaatattcattaattacagcgtttcatatgttggtattcttccatgcgaatgatatcgctattttgaaaatggcgcttttcaattttctgaaaaagctccagaacttcggcatatccctccatctgttcctgtgttggcaaacggcaagcagtctttagggaggtcttcatgtcctgtaaaacattttattttttaataaacattttacttgaaccaatgctaaatgattattggatgcttaatgccatttttcgaaaattgaaatactcacaaccagaacaatcaatggtgatgaaccaatttcagaacatttttcaatgaattgttgtttatataaggaacgttctttgtttgggtccgtaatatcgttgtaaaagagttcaatgcgatccaatggccgtgttactacctaataaataaaataaacacgagaaatacattattcctggggaattaaagtaatcatttaatttctgtttttaatacctttgtataatcacttttggctaaaagttcgtcgaattttattgttagttctcctatttccattttgagcttttcaaattgagtatttaagtagttatgcaattgtgtgatggcttct

SEQ ID NO: 35394 - DNA, 1070 bp, Heterodera glycines
caggggaatcaacccgaaatgtcaaaaagtaaaagcggcgaaagaatgaagaggaattatgataaaaaggctggtaaagcgaagaattttgaaaatggacagccgatttttgcgcgaaattaccttggtgggccaaaatggatgcagggacgaatcttagaaaagattggagcagcaatgttccgtgtaaagaccgcccgtggagtatggtgccggcattttgatcagctcaaagctgatttgacttcgacagctgacaattgtgatcaggagtccgaatcggaaagtgagacagatgcggaatcggacgacgaacaacaaccgcaaccaattccgattgggtgtccacgccaagaaattcggcagaaaattgcgcctgagggaggtgtgcctgatcaggcattgcgccgatcaactcgcgatcggaagaaaagggtaatttttgacccctcgtgaggcgcattccgctcaaagaagggggaaggaattgtagtgtttaagtggatattttgaattttaaatgcccacatttcccgcccattttactgcccataaatatggaattgtttccacttcctttgctttttccaccattcattttgtcatttaatttatctgcatttattatttgtcctttgacctaccaattttctgtgttttatttatttggaataaatcaatattccctttaactgttgctcggacacaacacaaacgaataatgttaaaaagaaataatatgattccatcaaagaaattcttttgttacgtaaatattttttatttattcagtgtcaattctcggaatatgtacactctaataattacttagaattacaaacgaataatgttaaaaagaaataatatgattccatcaaagaaattcttttgttacgtaaatatttttcatttattcagtgtcaattctcggaatatgtacactctaataattacttagaattacaaacgcataatgttaaaaagaaataatatgattccatcaaagaaattcttttgttacataaatatttttcatttattcagtgtcaattctcggaatatgtacactc

SEQ ID NO: 35395 - DNA, 1075 bp, Heterodera glycines
  misc_feature (786)..(787): n is a, c, g, or t
tttggtgataatataagaatgatttggaaaaagatcccaccccggaaaatgtgctggttttatacttttgaaatcgcttctgctccgcccacttttcagctcgacaagttcatccgctcaaaaccaaaaatcattttaataatttcttaaataaaaatgtcttcaatgaacgataatgtaacggtgcaaggtgaaagaaatggacctcaaacggatatcgaagctgtgaatactgacaaggtccaacccaaaccaaacacccgcagcatgatcaaaaaaagtcgctgggacaataattgtgcaaaacctgtgcaaaaggatgctgaagaagcgccagctgtcaaaaagaggaaagtcgaggacaacgagctgtggaaactcatgaagggaaagtatctattgggcttctacctgtgtgcgggtaatttttaaaactttaacaaaggtcatttaaaattttaagaggattggaacaagctgtacttcaataaaggaaaggtgctgcgcgctgtggatcatcagcacttctctgtgaactttgagatgtgcgaagattgcgcccgaaagaacatttttgccaccgatttgctggccccaccaaaaataaaaaaatataatgagtgacagattcatattgatgaactttcacacaaattataatcatttattttaatttcaacagataaagcatcaattacgcgatctcaaatgtcagattagtgagaattttaacatatttcatcgccccttccctcctttctcagaacaaggtgtgaacttcacacnncttaactgtccgaacgcccccccccaaccaacttttgtcaccgttcaaaaaaaggtgtgaatttcacaccttaactcatccgcccccccctcctccctcaccaattcaccaccacttcatccaaaaccaggtgtgaatttcacacctggtcattgacctattgacccccattcacatttcaaaaaaatcccgacccacccatcaacacctacgggactcctccccaaactacgcaataggtttaggcttaaacctatcacccccctcccgcgcaccccctccaccgat

SEQ ID NO: 35396 - DNA, 715 bp, Heterodera glycines
  misc_feature (676)..(676): n is a, c, g, or t
acaaatgttctcgcataattaaacaaattaattttttctttaatttaaatttgaaaaagcaaaatttgctctccccagcccaaccaaacgtcttaaaagtctctgaaatttctttatttttttttacaaatccaagatattcctaaaaaaatttaaaattccacctacccgttccccccccccttcccgttaaatgtttgctaaaaattaatttgaatataagttactctccccaccccaaccaaacgccctaaaagcctttgatattttttaaattttttacaaaatccaaaatatggaccctttaaatttttgattaaaattctttcgctggtgttccttttgtcgttcatccttctccaaatccaaaatgctaacttggtaatccacattaaattccaaaaattaaggcttacaaacagtttttattgaccctcgtctcctgccgattattttttttacaaattggaatgaatcaccccttagcagttcctttaataaagcacatgcttctccccctcctcttctctcttccacggtccattgttctttctgatcactttctcagcagcctgatcagcgccacaatgcgatcagtcagcagcaaataaaccagtttcaacaaaaccacagacgccgaggcggaggggaaagtgaaatgcgcgactttctccgncggcgcggccccccccgggggctcgccgccgcgccgccc

SEQ ID NO: 35397 - DNA, 857 bp, Heterodera glycines
gggatcgctcctccgccggagacggcaaagacaacctccgatttgaattgtttcgactgaatgatttgcaaaatgtgcgactgagggaaaagttacggtgggaagcggtggacacttttggaaagggcgcggcggaggaaaagcggcgatccgatcagccgaaggtgggggcacctctgatcagtcagtaccatcattcgccatgttcctcagaatgttcgtccttcgtccgtctttcgccccgcggtgactgttcagtccgctgacattgtgcgcgtccgcgccgatgccatcgtcgacccgctgaagggatcactgttcgccgcactgctccaatcgccagcggaggaaacgacggaaaaagtgttggaagcaaagtccattttggacgtattggaaatggatgacgatgaggaggaggaggagaagggaatgtcactgatcagcagggccaatgtgaggagacagctgagagggatggcacaactgctggaggaggaaagtgccaaagggaacggaacggaagagaaaaggagcgccggaaagagagccgcgagggcaaagcaacgtcagcggagggggggggggaattccaaatgaattaaacatcggcattttgttttcaaattgcccttcctttaaaaatagtttgtgccaaatccagtccgttgcagaattggagcattggctgcaggcattgaaagtgccgcaaacattcgccgcccttcggggagaagccgaacgatggcgacagacgaaaagcgccatggcgggcgccgaccagcgaatttttggcacagggagggggccgcctttgaagggaaaactgcgcgagttggcccagcgactcgtcgcgg

SEQ ID NO: 35398 - DNA, 1526 bp, Heterodera glycines
ttatttgtctaaaatttttgtaattattttaaacacgtcgctaaaaatttcattgcgtcaaaaaaaatcatctggaaaatatcaaaataggtgctaaaatttgaaaatgccaaaacagatgctaacccccgttttagatgtttttaggtgctaaaatctcgctaaatcaaaaattgtttgtaaacaattttgataatttagaaaagaagtaacaagaaatatttcataacaaacttaaaattaataattttctgactttttataaagtccaaagaagaaagagcttatttggtttatcaaagtgaaacattttgattatatatcaaacaatgaatgctttatatttatcctaatttcttcatccttcctttctcctttttcccttcaaaaaatcagtccaccaaatatgccgtatcaaaagcacaatttccagttgttatgccacgcgcattttcgctggccaatttggtcttcagctgatggccaaattgcgcattgtacaatacttcaccgttgacaatgttgccgagcaaagtgccaaaaattcccaattccggggtcacgtcttctaaaaagtcttctccgctgctttcttctccgtcctctgcccaaataatgtgattctgaatttgcataaatgaatttataaaattattttaagaatttgaaaattgaaactgacttttaaaattaagctcacaattgatgcattttcccgactttaccttcacagacatcggccgtaatttttccatcaaaatgtatgccgagcgtttgtcagcatcgaaacttgccaaagcttcgagaatttcttcgccaaaataaattttcttcacttcattgttattcaatgcgtccgataatgcatattcagttaatttcattacaaaattatttggctgttttttgactctctaaaatgaaaacaattaatgaaactttaatcacatttataatgcattttaatttattcttttacttcaataagctcagaaaatgcctgattgttctcattcccttcaattctccacatttttgcaaacgtatctcggatggctttaattaatggcgcttcttcagggtttgggaaaaatcgttcaaccatcccaggctcagagagcacctaataattaaaaaatgggaatgtgaaaaataatttgaaataatttaaaagaattagaaaaataaaatcaaaaattattttcttggcatacaaatattggacaatgaatgtgacctgttgcatttttttcgagtgtgcaaatgcggcaacaagcgatggtgctttctgttcaattatataaataattatttattcaaataattattttatatttattttaaatgattagtaaaaataattatttattttttacgatcgccgtcgatcgttcaatagtccgtcgaacttccattaaatctgcgttgtcgctaagcatattttgctgattgaacacaacagcaacatcatgtttttgatcgagacgcaatgaaaaatcattctcgtcaagtgtaagactaaattt

SEQ ID NO: 35399 - DNA, 938 bp, Heterodera glycines
aaaatatatttcggatccccccccccatgaaacaaagccaccccacccgctttcaagtgattcttctaattcacggaatatgttatctcataatctgagctaaaattctaacgttgtgcatgaaattctttagaatggaagcaacatttttgttcacttcgtcgccccgcaaatatgtacgcccataattcaaataatccatgacatttagtagttccaaaataggctctgcttttcgtgacgcaatgattgcgagtgccgccatggcattggacacgagttggggatgagacggattgtctatggacaaacattcgacgagcggacccaacacgccggctgagatgaattcgttgatcaccagcatcacggcggcatcgtttttaaagccgtccttgagcattctatgaatttcagtcactgctttaagtttcacatccttgtcattgcttttcgctttttcgacgagctaaaattgtgatggatcattaactatttgtaattgtacattttaatcatcattaatgataaattaattatttgactaaattcaggatgttttcctattttggggtcgcacaccaaaaattaaattaaacaaaaaaaaaatcggcgcgaaatttcacaaatatcacataatattctcaagatgagccattcaaagagattttagcaacaattgttgttgcatttatgtgcccaaaaaatgctttacgactgcgtaaatttgggcgcgtttttgtggaattttttaaatttttggggtgcgtcgacccaaaacaggaaagtatcaaattcactttttgttgttggcccatttgatttgttggaattgcaatcttaagaaacaaaatcacttttctgctaaaaaaatattttttcatttatttttttctaaaatatttttcatttattttattattttctaaaaatatttc

SEQ ID NO: 35400 - DNA, 1323 bp, Heterodera glycines
ggtaattttgttttttcatttttttggttctcaaatgtctactttcactggttctggttctcagttgtcccggcgctcaaattaattcggttcgactttatcaaacgaattttagacctaactcatcaagagctttcgaatgatgccaaattatccagaattgtccgttctaataagattatgagggcctcattttttcgtttaaccagaatcgcttctgaccaactttctttaaccctaaatggatttgtcttatcgagagagtctttgcaatttactaaattaattattcaaaaaaatttcatcaaaaaagcaaattttgttttaattattgttgctttgttgcattaaatattaaattttatttattttttatatatttctaaattttggcacttttttaactcaaatttgttcaacagcaatgcttgcggtgccattctctgctcgcttaccttttgcgtcaccaaatttaatggcaaatgctcagcaagctgaacgtgcaaattttgaaattaatgactaattaacgatcaaaaaccgcaacatagtgacaaaaattgaaaacaaacccaaaagtgaaagaaaaacaattaaagtaaaattgaatctaatgagaagaaataaataccatttttctctaattatcacccggtctccatttaatcccacgtctccatttagcccccgtatctaattatcccactcctttctgaggaaatagaaaaataatccccccgggggaataattacataaaatacggtaattaattactataacattaactcaacaccaaaattcgaaaaaagtctctctaaagcgtatgtcggcactttttttacatgtgaatgtaaatctgatcaatatttttaaaatgatcagacaaattgtgtgttttaaacgtaaccactttttttgaggggttttccatgaataaataaatattgaaaatattattttaaaaaattaacaatttgaaaagagtgggtgttgatgataatcagctgaaaatcattctctcccataattgctgacactttcattcgaagtaatttttaattgacgcaatttccggaagcgtgggtggcatttacatgccaaaaaaatgtgtcggtgtaaatatatggcatttcttttacgtgttcaaagtatttttttatgggtattgattattaaagtagatgatgttcagcatattatggcgttattaatgagacattcacacataaaaattttggcaatttaagcatttccgttttgcgaaaattcacaatatttctcaatgttcttttttttgttgatgaaaaatgacacaagaaaag

SEQ ID NO: 35401 - DNA, 981 bp, Heterodera glycines
aattttaagaaataagaaaaaaaatactatggctcctcttaatttcttggcgcgcaaatggcagcgctcaaaggttgttaaggaaggtcccaaaaatcgaaactcaattttccgatggcacaaccaagtacaatttgcaattttcaatcaattttcattcaattttgactagggctaggaatttagctaccaccaggcgctcgaaaaaagacaagcttatcttagccaattcggactaagccggcgccggcctatggggctaagcctgttgcgcctggtaagcctttattcccccaaaaagggactcttgacaaaacaccggcacttttcctacaaattttgacctattttcattccaaatgtttttcaaatgccatcaaaaagtcggcaccaaacaaagcaaaaagcacgcgggcgcggcacacaacggacgaagcagaagccataaaatgatgtgttttgtgtcattcattaagttaaggttggaagccataaacacacacagcacgaaacgaaaaaaacgggcggggctttcattccgtcatccttccccctgagggctcatcagtcgcagtgccatttcttcccgaaaataattaagccatactccagcccccagtgtcccgtgtccccccccccccccccgggggggggggggggggggggggggcagggggggggggggggtgtgttttattttttgggggaaagaggggggggggggaggggggccccgggggggggggggggggggaaaagaacgcccggcgtttttttttggggggggggggggggggtggggggcccccccccttaatttagggagggacaaaaaacacttttttttgggtcttgggctccgggggggggggggcgcgcgggggttttttttgttttggggggggccgttttttgggggttttaaaaaaaatttgggggaaaaaaaaggggaaaaatttggaagaaagggggggggtgttt

SEQ ID NO: 35402 - DNA, 835 bp, Heterodera glycines
  misc_feature (755)..(755): n is a, c, g, or t
attttatttatttattcgctaataaaaagttatcagaagggcaaaaaccacttactccgacgatcgttcagataatgtgtcgtagagtaagtgatataatatatggatgatcaagaataaaatcaaaatatatgaataaagtgaggtcaaagtcaattgagatcgacaacataaacgccaaatcacttaaaaaattaattctgtttttgcttttccggttattaccctaatgaatttttaagttttgttttaaattgatttaaagaatttgtttttattagtcctttatcgagttgattccacaatttgttaccctcccagcaaagggaatgaattttttgcctagtttatattttaaaatgcatgtcaaaatcaatttctcaatcgtgaaccaaaaatgtaaatttgaaatctccaaattttattttaagctttgaatttatataagcctaaaattggtataatttttaaatatacaatccgtttttaaaaaaataggggttgggcgcgggcgggaattttggggctaacccgggaccgggggccctttttgggttgaaaacccgataatttttggcggggaaacccgggactagtcctggtcccggtcaaaaccgggaccttagtactcagttgtccgctgccaggtcccggtcccgctcaactctagttttaacaattcttaagctataatttttcgataaatttggatgcctaatttattctaaaataggtacgtgagaaaataatcactncatcttgcttacttttcttcaccaagttggccaagctcataagatatattttccgctacagattgatactcctttttact

SEQ ID NO: 35403 - DNA, 588 bp, Heterodera glycines
ttgtccgtaatcagagtctgcgacagcccgtggttttgtagtgaaaagcgcccccccctaaattcaaaaattttaaagttcaattaaaaccaaaatttgcttacataaattgtttaggcacaacttggccaaggaccgctttcctttgttaacctccattttcgttgggtcaacatttataccaaacatttcctcgcactctcgtacaaactgctcctccatagcggcatttccttttatcttactattaaatccgctggcttgaatcttttgcgccatgaattcagcgatgtacgggcggaatagttggtcgtcactttgctcgtattccagcacgcggaacaccttcgtgacgcggtagccctcatccaatgccgcattcagctcaattgatgtgcaagtgtcgacccatcctctttgctggtcagtgtgctcgcagaggtagtcgttgttcacgcccccagtcgggtactactttgcgcaactgatgcacaatgggaagcacaatctgtcgtccaccttcaccggcaacaccgggacatcgatgcgacggggaggcacaacccacaccttgagcagtgccaaggg

SEQ ID NO: 35404 - DNA, 1054 bp, Heterodera glycines
ataattccccgatgtttttttccgttaccgaccaaaccgaagaaagcaaaaacggcaaaaatggaggggatgatgatgccaacttgcttctcgaacgtcttcgtctcttcgtaaaaacgaagcacaaataatgattcattggcaatgccatcgttggccatggcagaaagagtttcattttgcaaagaatcggaatgattcatcgaaataaaggattgagaaggatctgtagaaatatttatgttggccatcgatcggatgatttttcttctgtttttgggagtgattgtcctctcctactaagcttgagccaaaagtaaaatttaaatcgtcatggcctgcaaagtgtgcccttcccggaggcgaatatcgatttcatctatttttggcaccttttcgggaactcatctgatggcacccaacccaactcaacgcaatttacgccccattcgcttttcccacaacaaaaggaaattttagagaaatgactaaccaaaaagaagcggggaaatatttaatggaagtcaaaaaagaaaggttttccgagtttatttcaaacggaccttttgttaatggatctgacaaatgagcggcgaattcgccgttccattacggcaaatgttcgctggcgcccttttggcttttgggcgaatatttgcggttttaagttgcgtcagagcatcgccagtgttcgtccccccgttccatcagtgtcactccccccccccttttggcatggcttttttcctctcctccatccggcgagtgtcattttgctcttccttttttccatcctcaaaaatgacaccttctgttggcacttttgatatgctttcagccttctcaacgggcattctctctctctccccttcccctctctctctcttcctcactaatttttactgacaactctctctctctctcttctgccaacaattccgggaggggcgcgagaaaagtccattcaataaaacaaaaatcagcaccatcgcggaccgaaactgaaaatgcgtgaaaaaactgcaaaaaaaagatggagggggggggggggggg

SEQ ID NO: 35405 - DNA, 1477 bp, Heterodera glycines
  misc_feature (66)..(66): n is a, c, g, or t
  misc_feature (172)..(172): n is a, c, g, or t
  misc_feature (1395)..(1395): n is a, c, g, or t
  misc_feature (1459)..(1459): n is a, c, g, or t
tttttcagtgggaattgaaatataaaaaggcgtgaattgagagaatttcatttctcgtcacatctnaatctattctctgcactattacatctaattgctgctgctcaccgactccatcgacaccgacacggcatggaagactcgtggcgctctcccctggaatccgcgtcgnccgctggacgatcacaaagaagctggcgccggagcattcggagccgtctacctgtgcgtgaacgaccaaggagagcaggccgcgctgaagactgagccggtcaacacgccacatccgctgctcgtcatggaggtaggcgggggaggaggggcggaaaattggccaattcaatttaaattttttttttcaccacccaggctcacgtgatgaccaagctgaacacccttcgagacggagacgagaagcacttctgccgctgcttggacctcgggcgcgatgagcaaaaggaccaacaatcgggacaaatgaagaagttcaactacatcgtcatgtcactcgtcggtcgtggcctggacggagtcgtcaaggatgccggtggccgcctcagccttggaagcgcagtcggcgtctcgatccagatgctcgccgctctcagaggactccacaccgtcggctacctccaccgcgacatcaagccgggcaactcgaccatcggacgtccggaatcaaacgaaatccgcctgctctacctgatcgacttcggaatggcgcgcaaatacaccaaggacgacgtgagtttgagtgaagcgctttgaaaaaaacaaaattaatttccctttaccctttttcagggcgcccaccgccgcccgcgcgctgcaaccatcttccgtggaagcccccgctatgcatcgattgccgctcatctcggactcgaatacagccgcaaggacgacatcgaatcgtggttctactgcatgatcgagctcttcaaaggcgcacttccatgggccaacgtgggggaaacgaaagaggtgagcgaatgggggggagggataatcagaattctgatttcattgtttttttcagatcggcgaggcaaagatcaaacgccagaagaaacaaccggaagccgttcgacaccaggcaatcgccgacttgctctccggatgcccgaacgagttcggccaggtcctcaaatacatcgtgagttcgttcgttttttcaaaattaaaaactaacaaattaaattttgcaggacatgaagtacaacgacaagcccgactacgactggatcatcgcgacattgcgcaacagcctcagcaacgccggcgtccaggaattcccctacgactgggagacgacggacaaaaccacgccgcaggtttcgagttacttcacctgatgagccgtgcagcagcagcagcagaagaagaagaatcgcncagaagcgtcaccgtgcagaattgatcatatgaccactattactgtattgtatgtattattttngtgtcatgctgccatccc

SEQ ID NO: 35406 - DNA, 1069 bp, Heterodera glycines
  misc_feature (56)..(56): n is a, c, g, or t
ggtagaacagaggaacctcggagggaatacggctacaaggagggaaaatttgtggnggaaaacagaaaattgcccctattcttcccacagggagtcggcacccttttgacctattggttggagggcattgactctggtggaatgataagcgaccgctcagccagcgacgacccaatgcaacggtcggaccaatgacatcaaaaaagaaaccctaacaacgaaataaccattctttttttaatcattttttaaactcgctcaattatttgttgcacttcctcagtttcaaatgtacagacatataattttaacacaaacagaaatttggagaacaattgatgacaattaaaaggggaaaaaaaccccaaaatttaggaaaaaaaaagtaaacagggggtaaaaaccaaaaaacttccccaaaaataaaaattccccctccggggggggggttttttcaaaaaaaaaggggttttggaaaaacccctcttaaaaaatttttaaaaaaaaaaatttgggggttcccaaaaacttttttccccccaatttttttaaaatttttgaaaaaaaagggggtttttttttttttttgggggaaaaaaaaaaaaaaaaaaaagtctttttttttttttttcccccaaaaaaaaaaaaaaaaaagtggaggggacccccccgcccccccttctcccccggagggggttttttttttttttcggaataaaaataccgcgggggggggggggggggaaaagaaaaaaaaaaaaaaatcaccctttcttttttttttttttttttttttttgcgtccccccccccccccctattttttttgtggatggggaggaggagggaaagaggggagaaaaaaactaaaataccgatgggcatgctgagagcgcgccggccccacccccccccccccccccccccggcggggggaagggggagggggtgtgtttttttttttttttttttttttttctttccccccccccccccccccccccccccccccggggggggggggggggggggggggggggggccggccccccccccctcccccccccccc

SEQ ID NO: 35407 - DNA, 1425 bp, Heterodera glycines
ataaggtaattttaaaagcttgttggataatttaattctttattactattgatatttgaattaaagtcatttgtttgtattaaaaatattcattaaaaatcaattagttaatgtttattttgcaaaaataatcaaatgtttaaaccaagaaaattattaaaataaaaataaatcagtataaaaatataattaaattatcaaaaaaaattatcacgaaacaaacaatttatcaagaaaaacaaatatgagtgtatgcatgataacatatgctaaaattaatgatataattagggtaatatagcaaaaaatttaataaaaaacagaaaaactcaaatacagccgaaagcaaataaggtccatgaagcaagaaatagaacaaccacacggcaatatcaatatttaattaattaaattcattccaaaagtttaatacatatctaattgacaatatccttcgataaatagtaattaatattcaaaatctattaaaaatgaataagaactttatgacttaaagtccacaaatcaaacgttttaatggcaaaaataattcaaagaaactgaaaataaaaaatgaatgtataattattctgcaataagctttggcgcgtacatttgatttttcattttgctgtattttttgatgttttgagttactaatatcacattatttaatgggaggaataattttaatttcaaaaattaatagttagattctaacatttttgttatggtttttctcaattcgttaattttcttattttttgaattttgtatcattaataatatttgtataatacagtatcttttaattttattttttatttaacgtttatgttgggataatatatttcatttcatttatattttatgttgaaaattttgcttttttaattgaatatccaaaagatcctgcaaaataatatcagaaaatccatattttcaaatcaggagctaaagtctacataataaaataattattaaaatacaatcttaacccgaagttggctaaataattttaattgaaaaaacggaacgaaaggtaatctataaacatttatttaaatttaaaaaattaattaattatgtaaaaataaaaacaacaaattaaaatttaaaaaatttgaatgctggctaaaataatcaattttaaatgaaggaatattgaatattaatacaatattttttttttataaaatagaatattttaaattaattgtctaaaaaatgattgaataaaaaatgaatattaaataaattgtttatttgcagttgctaaattattaatttattaaataacgaaaaataaataaatttatgaattttatgaaaattataaaaatataatcaaatgggtaaataaatataaaacaacaagaaaaaaagaattcttttaaaaagtcacctaataactaaacaacttga

SEQ ID NO: 35408 - DNA, 165 bp, Heterodera glycines
aggcgcaaaagatgtaataagtttttgaaaactatttagagctatttcctcaaattaggtgacagtggtgcccaccggccatgaaaaaatgcgagtgacagtgtgcctaacagcccgcagcaatggacataagctcaagccctatgtgttggtcaacagaaagcg

SEQ ID NO: 35409 - DNA, 946 bp, Heterodera glycines
tgttgcacaacggactcgaacatccccttacttgtgcctttactatcttacaaaaaccactttgccaccttacatttactttttgaactgggagcccaaaattgactcggtgtgttcaatcaaaatttactatttttacagaatttggattcaattaattaattaatcattttgcagagttttcggccacccttttgcattgagccggccaagtttgaatttgtgccgcgcgtgcatcggctcaacgaaattgacgcgttgttccgcttgcgcatcatttacatcaacaaattggtccatttctggaagtactccaaggaccagcagttccgcatcccgtacattgacaacaagtacattgacttgtaccggcttcgtcaggtttccaagaattttttttcgtaaaaattcaatcaatgttttacaattccatggtatatatgagcggagactcattaatggttttaccaagatttccgggacccaaagttcacataaaatgatgtcaccgccatgagtattcctaccaagattcctggatccggagatttctaacttcccaacatttctgtatacggagatttctgaaaaaactatcatttccatgaatgtcctgccctcctggtacacaatatccacgaaacatggaaaaattttccgaaaaatccactaactattaaatttaacaagtgtttaagtcatggattcgaataaattttgggtccattttcgccctaatccaaatggagacgcggtattcagcgccgtattaattttcatgttgtctattaccctccttaccatgaaacttaatttggaaaaaactgaaatttcccgttttcagatggtcgacgaggagggaggcctaaagcgcgtgaatgactcgcgccgctgggcacacattgccaaatgcctgggctttcgcggcaacgccggccaaacaatg

SEQ ID NO: 35410 - DNA, 1268 bp, Heterodera glycines
tcttggaaatttctgcttcagcagcgtctgttgtcccaatcgataaactgaattcaaaaccgttgaaagtacccattgagaggatggttagagtgccggacggagtcccggacataagcacgcttccgaaaggcaaaaacccgtataaaaatcagcttaatgcgcttctgtgcattgtctgtctgatttacaacgaaaaacttgaaaatgagacggattataacctacttaaaggcaaggaccatcttcaaaatatcagcaaaaatacttctttcccgggagatagaatggattctcaaaaaagtccgaaagtaaacggaaaaaatttgatgggaacggaaattaaggattttttgggaaaattcgacggaattgtggcacaattgaggacaattgtttttcaagggaccgaggaggtaatggagacggacaacatcgactttgccttgacctgggatatgcagtgcggcggactcggaccggagcatcgaaattgcgtccaattgacaaccgctgatttggacccagttttggagagggccggattcggactcaaggtggccgaaggcaggctgaagccacaaaatgcaaaatttgggcttaaggtcgtgggaaccccgttgaaggctttgttggccacttttctgttaaaaaccaacgccatttcttcatctgcagccggcagaaagttggcacaatcagtgattggagcaccagttgggttcgaactgatcactttcatcggaagccgcgaagaccaaatcaaaagtggccgaattccggtggaagaagatttggaggccatcctcgagaaatggaccgaatgctgtgcagttacacggacgaaattggcaaaatgtggatttggcgccatcaatgtgccaattccgcgctcaattgaagacctcccagaaggagaaggaaaaccgtggaccgaactgctcggaaaagccggatttgtgctggagaaagtgaaggccacgtcggtgctgcgcaaacaccaattcgttacgtcgccacgcataattattggagactcaagcgcaaagcaatttgaggacttgtggccgacttctcagtttattggcgccacccaaggaagtgtttggagatgtaattcgggcattttgacgcagtggccctgtcgtcaaagtcaaagtgggcgtgattataatcgggcgtgacgctctgatcagaaacgaaacggccgacaacgtcatgggagaaagattgaaagactcatccaattgtgcgccaattccaacatg

SEQ ID NO: 35411 - DNA, 835 bp, Heterodera glycines
cggaccgacatttgcggaccgacttttgcggaccgacttttgcggaccgacatttgcggaccgacttttgcggaccgacttttgcggaccgacatttgcggaccgacttttgcggaccgacatttgcggaccgacttttgcggaccgacttttgcggaccgacttttgcggaccgacatttgcggaccgacatttgcggaccgacatttgcggaccgacatttgcggaccgacatttgcggaccgacatttgcggaccgacatttgcggaccgacatttgcggaccgacatttgcggaccgacatttgcggaccgacatttgcggaccgacatttgcggaccgacatttgcggaccgacatttgcggaccgacatttgcggaccgacatttgcggaccgacatttgcggaccgacatttgcggaccgacatttgcggaccgacatttgcggaccgacttttgcggaccgacatttgcggaccgacttttggggtcataatttctggatttaattttcaaaaaaaaaattttttcttaaattggatgatcatctgaatattgaattttatatgtgatttttcggagttaagcaagttaatgcgaatgaaaatatgaaaaatttataaagtttttccaaaaagttcatttttcaattcctcttggtgctaaaaattttgatcactttatatcatccttaagtagtgatctgatcaacttgtgcaatgcattagtttataaattcctgatttacaagaattatgttgtcattgataatgaatgtgagtaattcattttaattttgttttttaaagatataccatatattattatatct

SEQ ID NO: 35412 - DNA, 1511 bp, Heterodera glycines
ataaggttttttcaatggctttaaacttttttatattttctgttgtcattggatactaattctgcttattttaagttaactttacaatctcaaacagtaaaattaaatttatagaatttctttatgttataactttgaatactctcaaaatgataagttttatttattgtttatttgtaaaatttttcaaaatatagaacaataaaatatttgtgtttttttatttaaatttactaaaatattttgaatttaaaataattttcaaaattataaattttttgtgaatttttatttcgaaatttcagatattatttgatttcaaatgttaaaatgggagatctgagtaaaaggaaaatgttaatttctactaagcaaaaatttccttaagcatttattaataaacaagcgacacaaccacgccggaatcagaagcccagaactgagcatgaaaattaaattaaataacgatagaaataaattataacaattttactgataataataaaagaaaggcttaaagcaaagtaaaaagcctattgtattgtctcgaggtcacaagaaaagcaacaagataacattgattatttttattgaaaaaatattgtaaaccaaaatattattaattttatattaattttttcttttcatccttttaactattttagtgaatgaatgttatttatctcaaatggattttacgaaatttcccggtgaaaaccgggctattttacgaaatgcaaaaaaattacgtacgaatatcaacgaaatcggcgtggcgcccactcatagaagcaaaaaaataaatttgaaaaaataaatgataatccaagtaatagagtttaaataattcaaattaaaatttttataaattcataataaacgaaaaattaaatttttaattttcgtataattattaagtaaaagaaatcatttataaaaaaaaaatttaagaaacaaaaattcattcaactggtcggcaaaaagacgaaaatattttgcaacaaaattaaatttgaattctctaattaataaatcaaagtaacacaaggaagaaaaggaaaaaacatacatctgaacatgatattaaaatagtaaaaaaagatttaaaaaaataatattttacaatttttaataaataaatgattattcattacaattagtacaaatctaatgaaatataaaaaaagtaaaaacaaaagataactatgcaattaacaaaaacaacaaaaagcacacaaaaaataattaataaatgagtgaaaaaagtaatcagattcaaaaaattaacttcgaaaaaattatatgaccgtaaaataaaaaatatggtaatttaattaaaaaataacaaattaaaatttataaacgaaaaagaataaatgtaatttagcattgaataatgtaatataataaataatacaataaaatagtaatcattttttgtacaacatacaaaactaaattcacaaataatagctattcaattctttcattagaaattaaacatattaaaa

SEQ ID NO: 35413 - DNA, 951 bp, Heterodera glycines
  misc_feature (946)..(946): n is a, c, g, or t
tttttcttattttcttatttatttatcgagcaaaccaacggcacattagtgctcttacatggtgcaaaaatgacaaacaattaaatttgatcaaataaaaaatacaaaatgaataccgtaataaaaatgaataaaaataatcaaaggtttaaaattcacaggcgattaaaatatagtgtaaatgtggcacagaaaatttcctactcagaactcattgcttttagcaaattcctgaattcctttgccttattaatttgcaccgctaccagtggaagattattccagttttttactattctattgaaaaaattattttgagttttggccgtgtggcgctttactcgtaaaagtaaaggcctcctgcgcctttccgagaaaagaaacttttcccagcatcgaggctggtgaaccctttaattattttaaaagctgttgttaaatcattgatttttcttctttcttctaatttgtgtaaatcagtgatttttagtctttcccaatattttttgtacacaaagccacattttctaaatgcttttctcgtgagaaacttttgaacgcattcaattttatctatatctatttttaagttagggttccaaacttctgtagcatattctaattgaggtcgtacaaaagtttataggctgctgttagagtctttatttccctgctttttaacattctcaaaatttggaaagttctaagatatgcatttcgtacaattttgctaatatgttctgaaaaatgaagttttgagtcaattataattcccaagtcacgtgcattatcagactctgaaatcatttttgagttaataaaatattcttttttcatattattttttcctaaataaagtacaaaacattttccagttgaaatttctaacccatttatttttgaccatttttcaaaagcctcaattgctttatctaaaatgatttgntttat

SEQ ID NO: 35414 - DNA, 201 bp, Heterodera glycines
atactgtatcagcaagtcataaatgtagatgtttttgaaacaaattgcaaacgccaacggatattctccataataggcatagcctaagtaaaaaaaagtaatttataaatggctattaattaatttaaaaatttttattaccttcataatccatgtttcgattgctgtgaccgggctcatagccatccggcataaagaaat

SEQ ID NO: 35415 - DNA, 708 bp, Heterodera glycines
  misc_feature (702)..(702): n is a, c, g, or t
ctaaatgtgaggatttgtttctcgtagtgtgtttagctgtgtttggatggaattcgagatattgttgatctgattaaaatgtctttctacgtctctcccggcgcgttctgcggccctctttgcgacatcaatttttgagtctttggtatcttcagccttggcttctctcttcccccgttgttttttgattttgtaatgatggctgaatgcttcgttaattttgtttcccaatcccccggcggttttaaaattcatgtccggtaaataaacttgagtcgggacactgctgtcgttttcccatactttaataaactcttgaccgtttataccgagtgcggtgaatgagtaggggtaaataattgatgagagagctactgaccaatttgtgcccaattccaaagtctcggggagtcgtactgtgaattttgatgtactgttccctggtcccggtgtgttcgagggtagcacaatgtaaaagtcatccatctattttcactcattcctggttataaaatattccttttattaaatttccttccaaatcttcgatcctgtatgaatcgggtgtcgtcgaattggcaacaacaattttaaacaattcttcggtaaagtttgggaggtatccctttgaaaattttcccttttccttggtaatacgaacgatatcaccgattttaaatgttttcttttttaaaattttanattcct

SEQ ID NO: 35416 - DNA, 838 bp, Heterodera glycines
gccgccgagaaattttgtaatatttaaatgcgatttgcttacagattttgtctaaagaatgacaaatttagcgatttttagccaggagacgccttttttttgtttttaaaaaacgtttttttagacgcacttttcttaaaaaacttttggggataggggggccggcggtgccgataggcgccgccgggaaaaaaatttatgaaattgggagttttggtagcatttatatcaactaaataaatcatatcacaaataatttaaaaagtttggggaagcctgaaaataaaggacaatcttagaaaaaaggacattttagctttctaagatccggcccctccaaaaaaggaaaaatctttaaaaaaaggacacttacgagccctgaataataataatgttttcccttgggcacaaattccgatcgctaataataatgtgactcaaattctccgaatgttcggacctccaaaggcacttgaaaatgtcaacgacgaccaattcgcccgcatttgtggccaccaatcggagaatgaacaactgaatttgtaagggcggtggagcaaatatgagagaaaaactggacaatcctactgtaataccaccgtatcaaacaatacgacccatgacaacgcataaaaattttaaatttttgtgaatttttgggaaaatgcccttctgtgttatttaaatggcattctctgctcaattccaatggttttaccccgtccgatttgaggaattcgtccacaaatttgtccaccgaatgcgcactcggcacccgaaatggtcttttgatgaattgtggcatttcgtcctcctccgccatcgcccacttttgttg

SEQ ID NO: 35417 - DNA, 845 bp, Heterodera glycines
  misc_feature (808)..(808): n is a, c, g, or t
aatgaccaacgaagcaggaaattggtgtttgattgaaagtgaccctggccttttcacagaattggtaatgttatcagacacgcttttctgaaactatttttttcaattctcgagaatttaactttcggttaataccaaaaatgcaggcatttttccggaaaaaaggtttaaattttccattttccccttttagataagtgggttgggtgtcaaaggaacacaagttgaggagctgtactccattgacgatgagcagcatctgtccagcttaaggtcagtctccctccctttttcccgccatttttcttttatttatctttttcatttttagacccatttacggtctcattttcctcttcaaatggcgtcccggcgaagaattggagggcactccgatgcccgacgcccccgtgtactttgcccagcaggtgggcgctttttcaaagcattttttccaatttaaaacaaatgtatcagaaaagaattttggagaaaccaattcacataaaaaattatttaaataatttatactaaaatattcggtgttttcccgttttggagcgcacgccaaaaatttaaaaaaaaattaacaaaaatgcgtgccaattttcgtgcctttctgtggttttttttgtgtgtgaaccccaaaacaggaaaattgtgtaccaaccattctactatgcatttcttatacatacttcctgggaccacaattaatttttattaattcctccatttttccccaattccatcgtcgcattgttttcttcaggtgatcacaaatgcgtgtgcctcccaagcactgatncaccttttgctgaacattttcgtcgtccgatgttcaa

SEQ ID NO: 35418 - DNA, 597 bp, Heterodera glycines
ggaattttgtcgaaataagtgccggattaggtttagggaccaataaaaagcccaaaaacttagcaaaatcttttatttttacacttttttatttaaaacaaataataatttgtaaaatttaattaattttgaccgaaaaataaacaattcgaactttgcacaaattttgtcgatcatacaatggaggcggggcatagcttttcgaaccggagaagcagtggtctgttgtgaaagtgagaaaatgaaaataattcgtcctttataattaaaaattgatgcgcgagaggctcagtcagtctcgagaaaatttccggtttttgcggactcaaatctcggattatggacccgtaaatccagactcctggtccccaaatccaggctcgcgaaaatccagacccctgaacccgaaattgtagaaaaaccaggcttctggacaagattcttgggctcccgctcccatgagcctggaacctacggtaatccaggcccactgaacccgaaaatcagtaaaaatccaggcttggggacattggattcaaggaaagtccagcagatctctggacacagccagatagatcccatgccaactctctacat

SEQ ID NO: 35419 - DNA, 79 bp, Heterodera glycines
cccaaccagagcatcttcctgctggagcgggagcactgcatcaccgaacacgcggtgagcgcttgccggctgcgggaca

SEQ ID NO: 35420 - DNA, 878 bp, Heterodera glycines
  misc_feature (825)..(825): n is a, c, g, or t
  misc_feature (841)..(841): n is a, c, g, or t
  misc_feature (866)..(867): n is a, c, g, or t
aaaaatctgtaacaaatatccccgagggtgtcagctcatcgtcacccacttgaagtaaatgcgcccatcatttttcgtcggccctttgcgatttagacaatgttcgcccgcaatttggtctaactgtttgacatcggcggccgcttcgacgagcaaacgccactctttgccgaatcggtccaaatagcaattggcactgttttcgttgtcaattgcatcggcttttggtgtcgtcgttgtggaaaagatcgtagaacaattgctactgtcttcagctgcagttgtgctcattgtcagcaccgacgacgaggacgacaacggcggagtggcgggcggtggcacccgaaaatgttcaaaagtggcatcgaatggaatgtctttgctcagtgccgatggtgccaatggcggaggagtggcgggggatggcacccgcgcaaatgattcattttggttgggcaaatcgccgatttgaatgtcttcgacccactcaaagttcgaaatggacacggatggtgacgacggcacaattgtcgaaaatggtgtttccgtgccatatccgcgagagtggcacaaactggcgccttcttcagtgccggacaatgcttctttctctgtgccattgttgttgctgctagtgttggcaatgccagtggcagccagcgaagaagccgaatttggcacagggaactgctgaaaaaatattaaaaattattctttttgaataatttttgttagttattaaattgcttaaaattcaaaattaaatttaaaaagtcatcaaacacatattagcggggattttcaggtccctttttcacgggcccntgagatcctttttgancaattttgaatcataattcgatgannaagtgaaaatt

SEQ ID NO: 35421 - DNA, 1014 bp, Heterodera glycines
agcggagggggatataaggcatcgagataagctatcatcaagaggaagcgaccataaggaaagaggagagggaaccggagggaagagagagaaaggtgtgataatgcggcactctcagacatacgacaatcattttcgatttgaaaaagctctgcaaaaatcgcgtaaattttattacattggcattttgaatggcactattttttctacgaatgttgctgaattgtctgcttcttttcaaaatcaaaaatgattgtagaatgtttgtgcatgaatttcagtggaggatttggagtttattatgctaaaaaattgttagagaaaattaaggtcctagtgggtgttaaatcttgatcactcctgatcaccctgaagaatgacctctgaacacagaggtgcaataaacggaacgagacggagggcggacgacccaatctgacgagcgccacaggcggttgactgcggtggtctgaagggcccccgccaatcaatcagtcaaccgcctgcggatcacgcgagaactttttccgggacccagagtctcagcccaactattggccgccgtagtcgaatgtgcgctggttttaagcgcaataaaaaaaaatttaatttttaaatttaaataaataattaaaatttttcactgattttaagcaattttgcaaaatcttctgatttcaaccctaaaaactgattctttcaccagcacaagtttttggactataactttttcattgtcaacccagtcgaataatattgatatcattctaaagcttaaatataattacaacttttattttttttaattcacaaattttatgttctaaaaaaatgaagatggtcatttatgtctaaactgcataagacccaaaaagttttatgtgttaaattaattccacttctaccattcccacttactattactgtttcagataataacgatgcaaagtgaagcaaacaagcaaaaagacggagatttggttgacaaacaaaaatgttataaccaaaaatttg

SEQ ID NO: 35422 - DNA, 805 bp, Heterodera glycines
gtgcggacagaacagttaccggaaatgagagcccattgttacgcgcggtggctaatattgacagcggcttaatcttttcaattacacttattcattatacgaattaacataccgggataaagaaggcgaaacaaagaatctaaaattttgcaaaaattattaaactcttctgtcatggttttaaattttagcaatactcacccaatagtggaaatcgtcaagctgtcgctgaagaattcgttcatgctcggtgcgaagagtgttgtgatcgacaagaattcgttcatgttcggtgcgaagagtgttgtgatcgacaagaattcgttcatgttcggtgcgaagagtgttgtgatcgacaagaattcggttgtgctgtaattgtaattttttttgttatttccccatctgttaaacctctcgagttaaagaagacactctttcggacaattcgtgattgtccgtttgtatttgttgcgcttgtttccaaaattcctccatgtcttcaatttcacatccgttccgaaacacctaaaaagttcatttttgcgttttcaattttatttctgggtattttctcggtttaaagaatccccatctgcgtgtagtactacggtttcattttaccaaattaaaggcgtttcgccaaaaatatgtctatttataaatttctacacctacggtaactaccgatgtaaacatggaccaagaaaatagatatctggttccaggttaacaggtcaaatttggaaatcaaaaagcaatattcgtccaaggattccataaacacctcgggaggttgtccctg

SEQ ID NO: 35423 - DNA, 1538 bp, Heterodera glycines
  misc_feature (45)..(45): n is a, c, g, or t
  misc_feature (49)..(49): n is a, c, g, or t
gatacttttgtcacttcgtcctagcaccaacgacataacaccgtntatntagggtcggggtcattttggcgcaggcaagtttaaagattcataacttttttttaattcgaccaaataaaataatgttgatattaatcaataggtctaaatgttctttattagcctgcaaaatttcaaaaaattatattaggttttaaaaaagatatggcgcgctgcgccaaaatggccaggaaaatgcaattttttgaggttttttggccataacttttttgtttctcagctaaattttttgaaactttgcatagacaccgaaaacccgaaaattggacacccaaatttccgaccccaaattcaactgccaaagagttcctaaataatttgaatttgaatataaatttgtggatttggatcctttatccgtgggttctttgaactgacactaataaaataacataattaaaaaaaataacattaaatctatcgttgggagcaaatttctcgtgaaaaaacaaaaatatcggtttgggttggcttaacgaaaaaattagagataaagaaaagctccgagtaattctcggctaaacaacattcagtgcagtgttagctaaggtgtggattttaagagtaatttctcgaacaggctaaatctttgtaccatcaacaaatataaacattgtttatcaataaatctcaaaaaatttgtcaagcttcaaaaaagtttgaaatgaaaaatgaatttttgttctaatatttgagtataaatttaaattgcttccatttattattgcgacaattttcggaaaatttggcattttacgaaaggacttggcaagcttatagacaagcaatcaatcaaattttattttttgcagagggccatcgttcatggttactacagtatgttatccgcataaaggcatagtacaggaagaatttttcacgccgccacattggacactttctgaaaaaggaaactttgccgggagagaggtccttcttcctaaggtattttgtgccaaatttgagccaaagtgttgaagaccggttcaaacagggccaaattgtctttccataggaccaatttctacaaaattggatctgcctggaccaaccctttacaaaataaacttggtcccgtgctatttctatgtaagtccttcaaaagttgatagaatctgggccaggatagtgaaaatcccaggactggtcatcaacattgttagaattgctcaaatttggcacttattcatgtttttttggggtttccattatcacctgtacggcacatgactttggcctgggtcgggccggcacagctcgcgctgttgccggttgatgcgtcggatggactgcacaattcggcgccgttccgtccgcagtttttgcatcgtctcgcgcgacagtttggcccggttggccaaacactcctcgtccccctcctctccctgcggttggatttcgtttggctgatcagcaactgattcgaaatgattttgatccttctgctgctgttgttggtagtgatcatgatgatgatg

SEQ ID NO: 35424 - DNA, 451 bp, Heterodera glycines
tggacagttttaggttgaaatttttcatttgatggttttttatataacgccctttttgatggtttttatataacgactcagcaccaatataatttgttaataattgtcaaatggaaaaaatgtttggagatctgaccgggaccgagaaagaaggattgtgaatggcatttcagccaaaacggtgattgactcggatttctccatagaaaatgaatatttctcttcaagcaataataaaataaaattaattatttattccttcaaaatctgagttttgggacaagatccgaccggaaaccaccaacgagcaaatgaagaaattttgagaatttaccaagaatgaaagtgcagtagtgaaactggttgcagtttttttatattaaatctcaatcccgaaattcttaaaattattttaagacctttttttatacttaaatattttgattgttaa

SEQ ID NO: 35425 - DNA, 1551 bp, Heterodera glycines
ggcgcgcaaaggtcggcgatggcatcgcaccgaccacgacggtggcgttggcgatgatgacgaagccgcccctgccgccgctggggaggggcggatgattttttagcccctccggagactgtcccccggggggacaatgccccaccaccacccgaatcgatcatttgcatatttagcggcggcgcttcccaatcgctcttcttcacccctcccacccaatcttttttatgggctggtggtccccccccccccccggggcccaccattttgctgctcgcattggcagtttttaccttcgatgaatatattggatgatgatgatataatgaaggaaggcacaattaaaagtaaatgcaaaccaaaattttatttttttgaaattttgaatttaattttaaataatgttagtttttagtggaaagtcggcttacctactctccataataaatcaattttcgagttttttattagatttgtaaatgcaaacaaaaaaatctttaggtgggaggtttaaatttgggattttatatttaaataatttttatttttattcggctatgctcggctatgaatctactttccattccttcctaaaatttacacttatacttccatataaattattgccaagttttaaaaaccaatctaaatttttatacaaattttcattttattttttactccctaataaatttaatttttttgagtttttttctcttttttccattcgcctaaaattttataaagtaaattcagcagcgtgtgtccatcctttcacaaatctcattccctgaattatttcactgatttccgctctaactgattgcccaaatttttggctaatatcgttccaaaatatttatttgcaaaattggccccattttcttccaatatctctccccctccaattgggctcaaatttggacaatccatttcctcctattcttatctgctgttttatgctcattctttgaccttgtacattcattcattcattcacatcaaattgtcaatttaatgcacaacttttgacatatcttttccttatttttattatcattttctgactgattaatttttgtgtccataaaatgattttctctctgatcaaactcatctgtctttggccatatgttggggacataaaaatttaaaatttctcgccccatttttcactcattgtttattgatcaaaactcatgttcctcttctgagcatgaagtccgatactatcatgaaagtctcagtttttcttcgtacaaattttgttcagagttccctggtcggaatccggaattatgatcactagtgatggaacatttttgtattaaaaattcactgatcaaaactcgtcgagaatctcgattctcgagttttctactgaaataaaatacacgaacattattattatttttttgcattttttggcactgattttcgcctgcctacttcgccataacctttctgattaatgcttttgatcatcttaattcccattcaatacttaatcgttatgcgttttgtttgcctgtttgctttttcctaatcaaa

SEQ ID NO: 35426 - DNA, 1099 bp, Heterodera glycines
  misc_feature (28)..(28): n is a, c, g, or t
aggaggaagccgtgtcataaatcggganttgtctttcttgtcatgtcttttattattaatataaatttttgagaggagagtgcagcgaggaatgaatatgtgagaatggtgttgcctttaaaagaaagttatttaattataacaaaaatgaaaaatgacttcaccactttttttagattttatatagctatgcaagtgagacttaattcattcaaagccttttaatttctgtacataaatgtttttttaaataaaaaattgtctttcgaaaaggcaacttgctgtctcggtgtccgagtgatcagtcaattgaaataattatttcctatagcaaaaattaaatagaaagcatgaaatttacctcaaaatggccatgagcaatttcagttcatttttaataaacacaaaaaccaaagaatctgccagtatgcgtcgctggtgaaattttatttttttttaaaatattaccacgaaaaattataattttcataatattattaataaaagttaataagcttgaaacttcttccaataccaactgattttcttaaacgacttgaaatattcatgttaaaatcttttattttgcacattgctggaatacatacagaacatatttccagcattattactaaattaggaatttcattaatttttgataatttaattcgaataaatttgttaaattttatcccctgtgaaacaatttttgactattggtcattaaaaaagataatttcatctattgttaaaactgccaatctgaaaaataaaataaaaatgtaataacaaaatttaattagaaccgaatgaattttctcattatttgaaatctaaaaataattatatttatttgtttttaaagattgttttacctgccatgattggctacagttaccgttgttatttagttttgaaattgtttagaagttttggacttgaatattagaaattaaaaatttgtgatattgttttgacttatcgcttttttatttgagcgaacatttaattaatccaattttgaaaaaatcatatatttcattttctttagtgtaagtgccataaagtcaaggcgttggtccaaacaaaacgaatttga

SEQ ID NO: 35427 - DNA, 995 bp, Heterodera glycines
tttttccgatttattgcctttttggcgttttttccgaaaattccatcaaaaatagaataaaatcgggaaaatacactttaagaaatgaattgaaaatttttcagaaaaaacatccctaagaattgaaaaaatttcagaaaatacacccaagaattgaaaaattttctcaaaaattgatcgccaaaattcatttttttttttcttgataaaaaattctcggtttaaaaattttccttattcgaaaaacattataaaatatttaataaccatttaaatgaccaaaattaagtttttggttaagttttacgtgttttgctccctaaaaaaccttagaatttttaaatgccttttttcatgcctttttcgcgattttcgtgccttttcgtgccttttttcaattttttggtgcctattatagtgcctttttcgcaatttttggtgcctttttatccgagctctaataattacacaccctacacataagtaccaaaatttttattaattaataaaattcaggaattccgtgaaaagtttgcaaaaatggaaatggaattgaaaatggccaaattgtaactcgaaaatgtgaggagttttgccataaaaattcgactaaaattaagaaatttttaaaattatttttagaaggtacttgaacaaaagttaaagcatcaggaaatgatggtcgaacagaaggcattgaaggaaaaagtgatcaaaattgaacagaaaaatgaaaaaaaatgaaagaaattgaaaaaattttatggaattcttattgaataattcgataaaattaatgacaacaaattcaaaagctgaaaaatgagtttatggttttaattggtattttattcaaaaatttaattaagctacttcggatcaactctcaaaaatagaaaatgatcagaagactctatttgaaaaagtcagtgaattggagaagcagcaaaaacagcagcacgaaaacacgaccaaaggcgggggaattttaagcg

SEQ ID NO: 35428 - DNA, 970 bp, Heterodera glycines
gagaaagaaaagaatatattgaatttgaatcgattaattttcgtgaaatttttaataattcaaatatttgttcccaattgttctcatttgtccattttgccgtttcgatgtctccaccaaaacgtgccaaagtgtcagccgatgatgatggggagacaatttccgacgacggggagccatcaacgtccgcgggggcaaagcgaaagcaaaaggcgtcgaaaccacgccaacggaaggcgcatgaggcattcattttgctggtggacgtgggccgttcgtctgccgaaaactcggcgggggcacagagcgatcacggcaccaccactgacctcgaccgatcggtgcaaatcgtcgattgggtcctttcacgaaaagtgcgaatatttatctgggaagcggggcggaggatggaaaaatgttcatttgcaaaaaagaagggattccttccccatcccctcgggtttttctccgcatttccatgcctgaacaaaagccacactttgctttgtctcgacagattttcaccgaatcctccgatcgcttctctctgatgttcttcggccacgaaaacacgtccagcgacgaccatccgaatgtttacgtgcacaacgaacagttcgccacggcgcggatcgaatggctgcacgtgttgcagaacgaagtgcagacgaacgtcaaatgccccggcgattgtctgaatccgttggcactttccgcattttccccccaatttcagacgtcgacgccctttacgctgcgttggacgcactgaaagtgcactttgacgacgcaaaagaggcgggcgaaccgatgagcggagcgacggtcactttggtgagcatttgagcggattggacgacgagcgggcggtgatggacggagtgggtgacatcgcggccggctttcaagcgttggactgcgatttgctaattgtgtgagggaaaaaggggggggggggggggaagggggg

SEQ ID NO: 35429 - DNA, 1225 bp, Heterodera glycines
aaacaaatacaacaaattacggacttatttctgctaccactgcgcggcattgccctgacaatcgtgaaccatataggtaggtattaacagaaatttttttttgaaaattctgaaatttgcaaaattttcaggaatccggaaactggcgaactgcgcagctgtggcactgctgcagcgctgcatggcgaccttgacagcgtgcagcatggcatatgcccgtcctcgttcgtttgcaagcgtgacgtgcagcgacgaaagcctgcaacaaaaggggaggaagcgccgcgcgtatgctgttcgccaatcgcattttgccctgatgcgcgactgccgcaggtcgacccccgcactcggcatgcaaaacggtaagactactttaactaccgtaatccatttaattgagaggcgaattactgtgggtacggctcaattatactgtaacaatatcccaaattttcgttatgtctagctgtttgtctgctgacgtcaaagcatcgccaactgctggtgcagtgaaaaggcatcaccattactatggcgatagtgacaatgattatggtaactgtaccccaccgtacacctgccagccgtctaccgtatccggcatttttgtgtgctgtaaggtgccaccgatgacgggaatttaaggtcgtaattacatgacctctatttcgacccattaaattttttgtaaatgtatgccaggggaggttattcaatcgaataaattttttgaaatttctgggtccacaaaaaaattttaaatttgcattttcggaggcctcaaaaactttgaaatcatcccatggctgctccatttctggaaccaatgtgattattatagcagattatcccagtgataattcattctctgaggacagatgaaacaggaaacaaattctgattccgaaaacttgaattttccatgaaattttttaggttttcacactttctatgaggggtaagagtcgcaaaaataaaaaaatttcaactctttcattttatttccttaaaaattttcaaaaaattagtgcaatatccatcatctattttattcatcgaatatttaaaatttaaatatttttttttagcctaaaaaatctctgtccgcctagatttctgtgcactttagttaaagcatactgtattatagtttttcataagtatactgtatattattttgatagatgtatgtcacttatttgtgttaataaatttctgaaag

SEQ ID NO: 35430 - DNA, 770 bp, Heterodera glycines
ttaacaaccctccccaaaaacttgtttttcgtgcgttttaggcctgggatctcaggaaaaaatttacaaaaactatagataaaacaaaaaaaaaattaattgatcgaatctaaatatttatgcatgccaaaaattaaaaaactgtaagctttatttttctataatattttaatgaaaaatgtataaaatacaattttatcaaaaataaaaataaaataaataatttgaatgcttgttcattcctgcacactggtcagatctgactgtctcaaattagctttgttctttttaaaatttttgtccttttatgatttgggaaaacatcggcagataaagtgatttattataatccttttccatggaatgcgataaagtgtgataatttgaatagattagagctaaattttgttgtgcagcagtccatcagccagtcttttctgttctagtgctgctgttggttctgaaaagaaacattcatttccacccatttcaactcgttaggaaaataaaagttcaattcataaaattaattaaaaaatatacgggagtagttaccccacgtctatcgtcgtcaggcgtgaaaatgattaatgaccgtttagcctttgatgtgccgccgcgccgcgcgggggtttaccgcacgagacagtgcctacggggggatgtgaagagatgatgtaaaactttttggcaaaaaaacttttgtcaccgatggcggtgattaatgatcatttgtgggcggcgcggggcgcaaaaagtgctgcggggca

SEQ ID NO: 35431 - DNA, 1035 bp, Heterodera glycines
gcacttctcacaaagggggaagagtaggcgctgattgaactttacaggcattacggtaacgctgaggttgttgttaggaggcagaagtaaaacttttaaaattcctttgtaggtgttgtctgatggtttgcgccagttgactatttgctcattttgtggcaggttgatgatttttgggtgtccgagcgggtagcttgttgaaaaattggtccacgggtagaggctggtgaagtccttgtagctgattttttgtcccggttttattgtgtgaattagttttttcacatctgttcttcctccatgaaatgcgtcccgaattttgatgggtgaattctccttccagttgttgaaaaattgtttcatcattttgtcttttttcaaccgctcgttgatttcgtgttcccacaccacctctaagtcaacatagcgcctcagcatttcgtgcttctttttttccctctgtcttatctcacacagtttctttccgttcggcatcagcgtctcctcatccatattaccaaaacactcctcacacccatgccagacacacccattcacttcaattattttgtcccgcttcccatttgtgcctttgatgtagccgtccacttggtacacctgcccgcccttctcttttgaaaacgtattcgccgtaccgggagtgtgccgtctggatgttgaggttgagtgcaaagttaagtatgcaagctttggcgatcgtcgatggcttgccacgaggatgtctattcctccgtgttttccttccctttgtgtaagttgtttgaattcccgacgtagttccacgagggcgtgggtgaggattaggacgtcgttacagcagtattcgggcagtttttctttgaggtcgaatttttggtgacagttgttattataccaggtgatgaacttttggaggtcagttttcatcatttgatttggacagtagtcttcacgtggaggaaggtgctggaggaccttatcgtagtttgatgatttgttgaacatatgaggaaagtattgtttatccttaaatta

SEQ ID NO: 35432 - DNA, 1171 bp, Heterodera glycines
gattaagcttatgcttgaacctaggcttagccctaagcttaaacttgcttgggcttaggcctaagcttaatcttatgcttttttgtaatttttttattgtactaactgctattgacgccacccccccctaccccaaagaaatacgctaattaattaatcatttcataatttaaatttaagttgcgttgacggttactacggagaccctcggcttggcatcaatttgccttgcaagccatgcccttgtccgggtgggccgggctccggcttccaacatgctgactcatgctatttgacgccatcgccgagtccgacagttacatgcaattgccggttggcgtttaactaactaactaatttccaaatggattttctctcgctgtgtattgtgtattgtttgatcacttttgtaggtctggctatgctggcgagcgttgtgatcagtgtgccgtcaattattggggaaatccgcgcgaaatcgggtaaaattatttgcgtttgattcttatcagttttcttcttatcacaatcctcagcacattataatttcaatttgcacatatttagcgcctcatgtgaaaaatgtgcctgcaatgggaacattgatttgaatgtctgtgattttgaagatgcttttgaaatcaaatatcaattttctttattttgatttttcctgaaaggtgccggagagttgtgatgcgacgactggggtctgcttgaaatgcttgtacaacacggtcggagtccaatgtcacctctgtgtgaacggattttttggtgatgcgcaagcacgcacatgcacacggtggggagcgggtcgggacgggagtaatttggcaaatgattttatcggacatttttctaatcttttttcagtttcgttttcaataatttgggcgccaattcgagtgctggctcttgcgatcgtgtgtctggccaatgcccatgttatgccaatgtggtcgggccccagtgtgaccagtgcgcccctctccactacgatttggccagcggaaaaggtggaatgcgcggtttttaattttgaggttgatggatggcctcgccgagggaggccgggggggggggaggggagggcggtgtcagtgtctttgtgcctcgacatttttgccgcccagccaaaattgaacatttgcgccgttcatccaaaaat

SEQ ID NO: 35433 - DNA, 1089 bp, Heterodera glycines
cagcacgccgccactcactggtagcaccggatgttactcgacatcgaatggttcttcgacatcttggagataggcaataaaggagaattcgagaatgccgcggaagtgtcagaaatggggaagcttcctctttcgagagattaatcctggccaggcgaaaattttcaatgaataaattttatgttatgaacaattagccaaacaaattttttccgaaagcacatgaataaaggcgaatatattatcactgactattatattattgatatgttatatgaactcttacaggtataaaatacgtgtaaataaaaaaaagagacaaatattctaacaataagtttcagttcaatcataaaaacagccaaatggtttttaatatatttgaatttaacatgaggtaaaatcaaaattatatttcattatggtaattttagccattatttattactgtatactgcattaaactattagaacctttggattactgtgcatttacgataacctcgaacaatgtccattcgactgagttgttaaactttctcaagatgtgtaaccgtcatttttttctcacttcgatcactttttggtccagcggatgtttctcatcgacggttcgcttttagcgtgggaaatgttttacgcacaaacgaagtcaacatatcgcaatcatttcacattgctattcactctcgcatctctcctcggcaaacgacaatttcatttatattgtataagttttacatattatttaaaatataccctttcatgcttttatgacgcatttttagtccaacatctaatgctatcagccttgcttcgtcaattaccaattcaattttggcattattatcttttaatattttttccattttgtccatatacctaatcctgctacgttttgcatgttcttcatattaaaaatgatttttggtgtaattaattctcaaaaaaaatcaataaaatataacgattctataagcctttgtaaatttctgtttttttttggttgcattttttaataaaaatacccaatcgtttctttttacgaagcttcattgcttatttataaattctgagataaaaaaaact

SEQ ID NO: 35434 - DNA, 911 bp, Heterodera glycines
tgcgtggaaaccggcgtcgaagcaatagcctcaagagcagacatgggtcgaccaaaatcgtcgatcttcccttttttgctgcatggcgacgtctcagtattttgagtggccaatgtgatctgtgtatctacagatgacacactgtgttgcgaagtcataattaactccgctccggcttttgagggtctgccccttcttttacttccgatggaagaagccggggtgcttaattgcaaagcaccaatattgggcgtgctggtgcccgggtgcgatgccaccccatcctcatctgcactcccgtctgggacgggtgagcgacctgggctgacagattgctccgtccgctgttggtgacgctcttgtctcttccttcttaaattactttgttttgaaggcatctgaaaacaaaaatgaatcaatgatgtgtacatgcggcaaagtatttaggaaaagcaaccattaaaccacattaaatcaaatatttatcaaaaaaattgaaaatgtgaaaaaaggatgtatattccttgaatgccaccatgatgccgctgcgaatccataagccagggctcgcatgtccaactttcgcacggtgggttgcgacgaaagaggccggctcacacatcccgtaagaatacagatgaaaattaagcattgattggcgaattcaatgcaaaccacaatccccgaaggggcaggtaatctgaccaaaatcctcaaagggcaggtcacattttggttgactccgatatcctacgttacctctcaccagtccactggtcttggtaaagtgcgggaccagcttcgcaccggattttggccggtaacgataaggaattcattgttaacctttcggaccacaatcacccaacggggcaggcccacgaaacaccatcctcaggggcaggtccgca

SEQ ID NO: 35435 - DNA, 888 bp, Heterodera glycines
  misc_feature (33)..(33): n is a, c, g, or t
tcacatcatttgtcagcagcagcgcccatattncacacatcgctacaacaacaacaaacatcaaaacaaacaccgcttaattatgtaactaattggtgtcgccatttacgggcacaaaaacagtgggggaaggaaattaattgtttcaaaataaaaaattgccgccttcccccccccattccaaaatgggatgcaaattattaatttttctacaccttccttttttcaattcattcgttgatcacactgtgtcattgggaaacacgcaagcccttttatttttgtacaaaaatgatcatgaaaattggtcaaaataagtgggccatttatttatacgcgcgtgttaattaagtgggtaatttgcttactcaaatcgcaacaaatttgccttaattgactttccctatgctttacacatttttcgccctcaccacgcattatttgtaatattaaaacacccgcagcagcaaaaaagggggacaaattgagtgcaaaatatggccaattctaaaatggggggtgacgcggaataaataagtcaattggagaaaaaacggcggaaaaaataggggggtgcgggaaaaaggcaaattatgcaatgtggaaaagatagaaaaggacaacgacaaattccccggcagccctttccgctaatttcgcccacttttgtcggcgccgccaaaaaggggaacacagaaattattcccatgggccaaaagggggggtgggataccaaagcacaacaacgtgttcttggatcattttcagcagttagtcagggcgggggcagcagcaggggggggggggaagtctcgccgtccccatcgggcggtgctggggggggggcgacgacggaacacaacatgccttgatggagggggggggggg

SEQ ID NO: 35436 - DNA, 920 bp, Heterodera glycines
tcctcctctcagatggtcggccaccacggcggcggtgccgtgccggcgttggtccgtgaccttcggctgtgcattggccgtggctgtgagctgcgtctgtaccaggtccgacaacgcgtgggcggcgatttgctgttcccattggtcggcgtggtgcacactgagcagccgttgctgaacctcaaatggtcagttaattttgcctttgtgtatttaagaaaaattaaaataaaatttagtcttccggacttttctgcttttaaaaattgagatttttttggatgagtggcgctttatccgtttgaattttcattaatgatactttcatttaattcgtctatgctatcatatattatctaaaaaaaaattgtcccattttatgctcgacaattgggcccttctgacaattgtcggcgagacgggccgggaacagctccaactcctcgaattgtaccatcaccaacaacaacagaagaaaggtggccaaaaggagttgggtaagaccagaccggaagaaaaacaaatttaacaacaaatccatccatttgaggagccgcactgactgcaagtgccgacattggccccgccattcagctgctgtataacagtgccgacttcaaagggttggccacggggcgaaatgtcagcgaggcgagtcaaacaaataatgtttttaaaaatggatgaaaaaagcaattccccccgccgtttaggccatgtcaatgctggccgactccgtgtgcctccattcggtcagtcggccaaccgccgatggcgccgctggtgaacagtcacagcatttgctatatttactgggtcgtaacggcgtgttcaccgttcagctgatggaccaagctgaacagctcgacttgctgatggccaggttggtcccatcaacgggggactatttattttgcgaa

SEQ ID NO: 35437 - DNA, 944 bp, Heterodera glycines
gaccggggacctcagagtcatcggtttgcaactagtggcgagaaatacgaccctgcgcataccgctccgttttatagagaccaaaccgtattacccgtcaattatttaaacgatgacacaatttaaattcccattttagtcatcctccgccatactcaggtcagaagtgcttcgattactacatttgcactctcgtttactttcgtcctccgtcattttctgttttcgttaggtcgtttctcctatgaccgctccgaccgttctgtccacgacgagcagcaatgggcaagctatcaacaccctccaaatgcaccttcttcacggttaattagtgcatttcagcatttcttgaaatgcgtttcaaatccaattttctaggcagccaaattcacgctgggccaagttggacgaaccatctttgggaggagaaagccaagcgaccaatgggccacccccttcacttctcaacgatttaccaccaaattcccaaggacagcagcaaaactatgcgcgtaacgcgcgcttcaatcagaatgcagttacatgggaaaatcgtaagttgggcaaatggtaactttttatggattgtataaacaataaaaatgcatttcattcgagagtttgtttttcgtcaggggcgtatctagaaaaaattttcggggggggggggggacccgacctgaagacctttttttctcttcaactgaagacctttttttgctgtttatgttggccgttttaaggcagaaaaacatgtaaaaatagtggaaaatggggtccggcggtgccgataggcgccgccgggaaaaattttggaaatttgagtgctatttgttacgaaaattgcctataaaatttttaagtgttcgtttgggggggggaattcgaaaaaattttccattatttgctggaaaattgttagaaattttcatttcggggggggg

SEQ ID NO: 35438 - DNA, 1029 bp, Heterodera glycines
tgtgtctggacctctcggggaccggatacggactagcggtcgggctgccctcgttatgccgttgagaaagggtagttggtttcggccggccgcccgtttccttagtgcgctgaacaaccgactcagaaccggagcggacaaggggaatccgaccgtttaattaaaacaaagcattgtgatggccggagacggtgttgacacaatgtgatttctgcccagtgctctgaatgtcaaagtgaagagattcaaccaagcgcgggtaaacggcgggagtaactatgactctcttaaggtagccaaatgcctcgtcatctaactagtgacgcgcatgaatggattaatgagattcccactgtccctatctactgtctagcgaacccacagccaagggaacgggcttggaaaaatcagcggggaaagaagaccctgttgagcttgactctagtctgacgttgtgaaatgacttaggaggtgtaggataagtgggaggctctgccaacagtgaaataccactacttctaatgtcgttttacttataccattatgtagcgcctggccatcctctcgggtgcccagttctagatggaagcctgtgcttttgtgcgggtgagctacgtggaagacatcgtcaggtggggagtttggctggggcggcacatctgttaaatgataacacaggtgtcctaaggtgagctcaatgagaacagaaatctcatgtagaacaaaagggtaaaagctcacttgattttgattttcagtatgaatacaaaccgtgaaagcgtggcctatcgatcctttagttctttagaattttaagctagaggtgtcagaaaagttaccacagggataactggcttgtggcagccaagcgtccatagcgacgttgctttttgattcttcgatgtcggctcttcctatcattgcgaagtagaactcgccaattgttggattgttcaccctactaatagggaacgtgagctgggtttagaccgtcgtgagacaggttagttttaccctactgatgaggac

SEQ ID NO: 35439 - DNA, 870 bp, Heterodera glycines
atagcactaaaaaacctcatttttaggggggtgtaaaatgacaaaatgtattcaaaaaggtaaaaaaattaggccaaatcagtattgagataaataattttttaaataaaaaattcttgttaagaaaacaattaaataaatttaggagacaaattttggagaaaatttttcatttcctagggatgtatttttgaaaaatttcaggtcgattcaaaaattttaggtcgattcttagaggtgtatttttggtgttacgccaattgcggaccgtacaattgcggatgacaattgcggaccggacaattgcggacgacaattgcggaccgtacaattgcggatgacaattgcggaccgtacaattgcggatgacaattgcggaccgtacaattgcggatgacaattgcggaccggacaattgcggatgacaattgcggaccggacaaatgcggacgacaattgcggactgtacaattgcggatgacaattgcggaccgtacaattgcggacgacaattgcggaccgtacaattgcggatgacaattgcggaccgtacaattgcggatgacaattgcggaccggacaaatgcggacgacaattgcggactgtacaattgcggatgacaattgcggaccgtacaattgcggacgacaattgcggactgtacaattgcggatgacaattgcggaccgtacaattgcggatgacaattgcggaccggacaattgcggacgacaattgcggaccgtacaattgcggatgacaattgcggaccggacaattgcggacgacaattgcggaccggacaattgcggaccgtacaattgcggacgacaattgcggaccgtaaaattgcggttgacaattgcgga

SEQ ID NO: 35440 - DNA, 799 bp, Heterodera glycines
accaactgttaggcgtacagcaacggcggcacttgcatccgatgcagctgttcacgggctctctaaccctatttttattttttttctatctcttctctgaaaggagttataacaatttttcacaacagttttgcatttaacagacacattctaaaatttctaattagtatagtagtccaagcctattattattttttttgactagtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcaccaactggtaggcgtacagcaacggcggcacttgcatccgatgcagctggtcacgggctctctaaccctatttttattttttttctatctcttctctgaaaggagttataacaatttttcacaacagttttgcatttaacagacacattctaaaatttctaattagtatagtagtccaagcctattattattttttttgactagtctctgaatggggttatcccagttttagtatcctttttgaaaaacaaaaattttaataactgatacggtagcccaacatccattgccccaatggacccttcgggttgtcaacgggagctaacaattgatgagtttgtttggtttcttttttaagcaattttccgtcattgctcaccaactggtaagcgtacagcaacggcggcacttgcatccgat

SEQ ID NO: 35441 - DNA, 924 bp, Heterodera glycines
  misc_feature (810)..(810): n is a, c, g, or t
  misc_feature (883)..(883): n is a, c, g, or t
cgttcacctccgccctttttgctgtggtgcactattttgtcgaaaaaggacgatcccaacgagctttttgaaaagcgaaacttttgactcaaaacacctcaaaccctagagaagtgtcgttcaaactccgccatttttgctgtggtgcactcttttgccgaaaacgtacgatcctaacgagctttttgaaaagcgaaacttctgactcaaaacacctcaaaccctagagaagtgtcgttcaaactccgccatttttgctatggtgcactcttttgccgaaaacgtacgatcctaacgagctttttgaaaagcgaaacttctgactcaaaacacctcaaaccctagagaagtgtcgttcaacctccgccctttttgctgtggtgcactattttgccgaaaaaggacgatcccaacgagctttttgaaaagcgaaacttttgactcaaaacacctcaaaccctagagaagtgtcgttcaaactccgccatttttgctgtggtgcactcttttgccgaaaacgtacgatcctaacgagctttttgaaaagcgaaacttctgactcaaaacacctcaaaccctagagaagtgtcgttcaaactccgccatttttgctgtggtgcactcttttgccgaaaacgtacgatcctaacgagctttttgaaaagcgaaacttctgactcaaaacacctcaaaccctagagaagtgtcgttcaaactacgtcctttttgctgtggtgcactattttgccgaaaaaggacgatcccaacgagctttttgaaaagcgaaacttctgactcaaaacacctcanaccctagagaagtgtcgttcaacctccaccctttttgctgtggtgcactatttttgcgaaaaaggacgatccncacgatctttttgaaaagcgaaacttctgactcaaaacacc

SEQ ID NO: 35442 - DNA, 77 bp, Heterodera glycines
taaatgcagatattgaattttaaagttgcaaattctataaatgaaaaaacccaaaaaatattcaataatataaataa

SEQ ID NO: 35443 - DNA, 724 bp, Heterodera glycines
ccccataattttggcgccttggctcggggggacttcccccaaaaccaaaaaattgatttttttcagcgttcctttggggttctccaaccatttttgggaaccaaaattccaagcaaaaaataaagtcgaggtatatggaagctattcccgaaggattcggtctcctcataaatctgggcgcatcggttcggggggactgccccgagaacaaaaaaatcgattttttcaagtgtccgtttggggtactcaaccatttatggggagcaaaactccaacgcagaattaaagtacagactatagggaagctattcccgaaggattcggtccgccccccccccccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgatcagtttctgaaaaaaaagttaagcctaaactttttggcctgtttaaaaaggaattaaaaatttttaaaaattttattcatctcccttttcgatagaaaaagcatcagagtgcctaaactaacatgtaaataaaatttggtgcgtttcagagcattttctgaaaaaatatttatgaaataaaaaaatcgattttttcaagtgtccgtttggggtactcaaacaattatggggagcaaa

SEQ ID NO: 35444 - DNA, 1012 bp, Heterodera glycines
ttttctataataaaatactctcgatcatgagagggagcgttgtgcgtaatggcccttttattttttaatgaatttttaaattgcatctgtatcccaaaaaaatggctttctcttttttgggtaattttctataatacaaatactctcgatcatgagagggagggcggtgcgtaatggcccttttattttttaatgaatttttaaattgcatctgtatcccaaaaaaatggctttctcttttttgggtaattttctataatacaaatactctcgatcatgaaagggagggcggtgcgtaatggcccttttattttttaatgaatttttaatttgcatctgtatcccaaaaaaatggctttctcttttttgggtaattttctataatacaaatactctcgatcatgagagggagggcggtgcgtaatggcccttttattttttaatgaatttttaaattgcatctgtatcccaaaaaaatggctatctcttttttggataattttctataatacaaatactctcgatcatgagagggagggcggtgcgtaatggcccttttattttttaatgaatttttaaattgcatctgtatcccaaaaaaatggctttctcttttttgggtaattttctataatacaaatactctcgatcatgaaagggagggcggtgcgtaatgtcccttttattttttaatgaatttttaaattgcatctgtatcccaaaaaaatggctttctcttttttgggtaattttctataatacaaatactctcgatcatgagagggagggcggtgcgtaatggcccttttattttttaatgaatttttaattgcatctgtatcccaaaaaaatgcctatctcttttttgggtaattttctataatacaaatactctcgatcatgaaagggagggcggcgcggaatgccctttttttttttaatgaatttttaatttcatcctgatccccacaaaagggttttcccttttttgggaaattttctataaaacaaa

SEQ ID NO: 35445 - DNA, 1112 bp, Heterodera glycines
  misc_feature (7)..(7): n is a, c, g, or t
  misc_feature (1081)..(1081): n is a, c, g, or t
attttancgattggcaaaaagccatggttaagcaccgccacgtcgtaggaatagcgtttgttcacataatcgacgggagtcatttcttttgtgtacacataaacagagaacgactaaatgaattcaaaacaaatacaattaatataaactttttaatattatttaattttttgaccaaataattaaaaaattatttttatttatttaaatgagagtaattaaaaatgtaaatatttaaactcgaccttgaacaccattcgtcccataatcttgacaaataaaaaaattacccaaattaatcaatggcttaaatgtgcactgaaattacccccaatgggtcctgatcaacggcgatcactcgttggttcaacagaatgtcgcggtgttggggcaaaattgttctcaggtcgttggacatgatcagaggggcggaccaaatggcccagatggacatttgcactttggcctggtcaacggtcaattcggtgttgccgacgatcaactcaaaattaattggggatgctttttggatcgcacagaacaaaaagaacacattttatcccaacaaaaaaagtgcgatatccggccatggacagcctatttataataactagagcccttgacttttaggcacgaattccttaaataggcacgaaaatgtgaaaaaaggcataaaaatgaacaaaaacgtcagtaaggcacgaaaaattgaaaaaaggcagaaaaaatcaacattttggacaaaattttttttgccaaataaacaaaaaaatttccaatataacttctttttttttgctcttagggccaattttttttattataaccggagcgaaaaaggaggaatttttctagcacaaaaatgacaattatttgctattttggtgttaaaatttcaaaacccaaggttaacggggggtcccgcggtgccgttaggcgccgctgggaaacatttaaaaaactgaaaaaggcatgaaaaaaggcaccaaaattgcaaaaaaaaggacactaaaaagttcaagctagaagcttcaaaccaagttaaaaactcgtttttcgtgcgtattaggctatagctagntagcaaaaaaaaaggcatgcctcaaaatccg

SEQ ID NO: 35446 - DNA, 1059 bp, Heterodera glycines
taataattcaaataaaaaaatgtaatttattattaataaaataaaaaatattttaaatgaataaaacaatgaaaacacgaaaaaaatggtagttattaattaaaaacagcgttggaaattattaattgaatattcatttaatttgaaattaaattaatttttttacaaattcaaaaaataaataatgaaattctttaatttaaaaaaataaataaatttaaataatttataaaaaatatttgaaattaataaaacatgtaaaagcaataaaaaaaaatgcacagaaaaataatgttacaccgtccggattcgaacctgcccccccccctcagaacatgtcccagaatccccaatcacacagggattctgaggtcttgacgatgtcaaaagtaaaatctgatcacgtattcgtgatcagcggcccaaataacccctaaagacatatttttggaagatttttgatggaaaaattttcccactcaaaaatcctggtcacccccctgtggtcccgaatctcaaaatcacttttatttttataaaaattcttaaaaaagtgataaaaatgtaaaataaaatttatattatagagaaaaaaattgcggatttttgtagtattttacttttcccgaatagcttttcagaaggcagctacgaatttttttctgaaaaatcgaaaatttccagaatttctggaataacttttttcatattgatgttagaaaacccaaataaaccccataaaattctccttatttttctctatttttaaagctttattatagttaaatcgatgcaaccatcaccgagttatgaattttccaatattcacccaaaatcccgagggccaaaaaattgccaaaaaataaagaatttttaaaaaattccaaaaattatgaaactgaaaacaaacaccatattcgggctcagcatagtaatttaccccagaaaaatatttttgacccccattttcaacccaaaaaaaatttccgaaaatttctagggggcctagctcgaaaatttttgaaaattttacatcatgtagtacaccattcgatagag

SEQ ID NO: 35447 - DNA, 891 bp, Heterodera glycines
ttttgtacggaacttacaaaagaaagtgaagcaacaaggcttatggcaggtaattttctcccctttatttaaaaatttttttttcaaaatttaagcgttattgttctgatccggtgtttgctttgaatgttcggatgctcacatcagtcgcattcgttccgctttgtgatgtcaggaatgcagtgacagcacttgacatggaatttggaaatttggcggcttttcaacctctcattgattggtcagaaaataaaattttcaattttagaataattttttaggcttttggacagttatgttgggcgtcctcgtcccaatggcacatggtcgcaaccgttgttccgtccggagcagtggaacgtctaccaacggacattggatggagatgcgaggacgaacaacaacgcagaagcggaacaccaccgtttgcagggcgcgttcaattgtcgtcatccatcgttgtggaatttcattgatgttcttcgacgtgaacagaaaattgccgaccacaaatacaattctgcgatcgctgattgtcacctgataaaaagcgaggcaaatatttggcagctgatagacgaattctgaatatggttcgcaattacattccattgaatgcagtgaatgatcatgattatcttccacccattccccagcccaatcaatttcacactattttggaatttcttcgaggtatttcccaccattatcaaatgaaccccccttgaaaattgttgttttttgttaccatttatttattgttttttatatattgataaagcgttaggttttttgatttgttgattttaactaagttttgaatttcatattttttgttgattttaaccaagtatttgatttttataattttttttggcgccgaaacgggag

SEQ ID NO: 35448 - DNA, 954 bp, Heterodera glycines
attcgccgtccgattgtttttccaattctttctgcaccatataactcaaaaagtgaatcattctttcgacgatcggaaactgctccgaccatcgacatttaagcactgatcactcactgataatcttcctaaaagggtgccttttccgatcgctgcgtttgtttctctctccgtttattcgtccatcgatcggttaaccgaaggattccttaaagaatctttaagagaaacccgtgcaaaaatgatcagcagaattgcggcgttattcccaattttattgttcgattctgtgcacttttccattggaattgaaaatgtttggccgccaaaccatgcggcaataaacgaacagagaaaacacatcgacgtggacacgagttggacaggcaaagagcaaaagacgcaacaggtggagaaaacggggggaaaatggaaaaatgggtaaaaaaaaggacaaatgggtaaaaatgggacaaatggtaaaaaagggacaaaaaaaacagatcggtcttgacgccagtgacaaagaacgcgctgtggtcgatttgctgacggagcggaagcagctcgccgcatcagctcacggaaatgtggcggcagcggaaacgagcgatggaaagcgggcgcaagtgcaaagatttggggacaaaggcggaatagcgcaagtggaggggcacaggtgggacaattggggaggcaaaagcattggcaaaaaagggaaaaggaggaaaaggcaagggtaaaggcaaaggaggaaaagcattgacatgaaaaggaagggaaaagctgctgaattcacatttcgccataaaattgaaacagtgcgcaactgaaaacaaaagagaacgcggaagggcggcacgcgttgctaaaggcggacggcaaatacgaattggacacaatggcgaaagggtcgctgaacgaaacgaaagacaccgaattcgaaagcgcaca

SEQ ID NO: 35449 - DNA, 907 bp, Heterodera glycines
  misc_feature (550)..(551): n is a, c, g, or t
gatagtcgcttatggagacagctttgaacttttagtgcactattgtgaaccaatttagtacaaaaatccacaatattttatgattttaatcgttaaacttgttactgaattcttataggaaaaggaataatcctgaaatgtcacaaaaacattagctacttgaaggggaactgatccaggcgcaaaaatgcagatcataaccaagtggacaatccgctggatccacatatttgactgcgaaaaatcaagcaaaaggtatattaattttaagctagcaaagagtcaatcattaggggtgtaaaaaagtctcggtctagataagtctcaaagtcggagcccgcgcctgacttcacaacaccgcgaatgttacaaccaaaatcttttaaagagtcgtgccacagagtctcgctcaccgccgcccaatagtagaaaaatcatcttatttctagtatttgcgtataaacgttctgtctcttattcgtatattgtgccttgtatataaacattgccgcccccccccttccgtgccggtgcaccccaaaacattggnnccccccccccccccgaaatgaaaatttttaaaaattttccagcaaataatggaaatttttttcgaattcccccctcaaacgaaaattaaaaagtttaataggcaaatttcgtaacaagtagcactcaaatttccaaaaattttttccggcggcgcctatcggcaccgccggacctcccttttccactatttttacaagttttttgccttaaaacggccaaaatttggtcatttttagtgaaaaagtgcagttgttactcagcagtagaaaaaaagttattggttaaatagcaaaaaaaaaaagaaggtcttcaggtcgggccccccccccgaaaaatgtttctagatacgcccctg

SEQ ID NO: 35450 - DNA, 1183 bp, Heterodera glycines
atataaaaaaaaacaattacagattaaaataatgaaagatgggtatatcaaaatggagtgaaaatcatggcaagagcggatttgctaataacaaaatcaaaaagttaaaaatgccatgccaaaatccgttcccccaattgcacaaaaagcgggaaaaagtgtgtgtaacaaactcattagcagcagataatgaatgatataataattgatagagtaatgacttggaagagaatgccagcagcataacgggttgtaaataatgcaaaatgggccattaaaagcaaaatagcgcaattgtgtgacaagatgaagaagagaactgaattatcacgaaatttttgattacaataacaaaatacagtaataagaaaatgtgattcgttagtgtaaaaaggaaggaacagtagtaataataaagtacagtacacataatcaggcagacacagacataaaagttgcggggatggaactgtgaaaaggtggaaaaataggagcagaatgatgagcatattcattcaatcagtcatcaaattgtcaactttttgccctctaccgtacacatatgggtttgctggcgaattgccagtgaacttttggcgtagtgtctccaaggtgccgtgccggtcactttctctacattattgaaccattgtgtacagtagcgggcaggcctagacaactaattataagcaattcactaattgtaaatgtgtccaacacatataggagacaacaacaacaatcaaaaacaacaaaatggatgtttccaaatttgggagaagcgtgtgctcacaatcagcagtcgcccctactaattgtaaacagttgcggtcgctgtgggagaccgatgctgtgccggcggcgagtggtgctgttgctccattttgatttcgtcatcgttgttggcagcgacaacgggcacagtcagttgcccgtcagaatcgtcggcgactgttgcgactttggccaacgtgccgcccccatcactggttgccgtcgtcgtcgttgtgttcgcttcaatcgcagctgatgatgaagcggcggcggcacatttgtaacaacagtaagccgaaatttgctgtacaccgcgcaccgaaatgtccacacagcacgaagtgataccatgcgggcacagcctgcctctcattggatccaacgggtgaactcgtctgcgagatagggg

SEQ ID NO: 35451 - DNA, 667 bp, Heterodera glycines
ctagaggacaaaatggtggaactgatcgaagggtacccctctctcgaagaaaagcaatggcattttcactggtataaatgtggttaataagttcaaaaagattcattttggctataaatgaatagcaacttaaggatacggtataacacgaaataacccagtaaaaagcattggtagaatgctttattctagttacacaaaataaaatgggagttagtgtggcctattgatattatgtgttgttgttttgcatagtgatcactgacctattatgatttcaacaccatttgttatgactattgtttgagtgtcaacaatatgagtatgaggcggggatctgaggttcgaatccgcttggctgcggagtattttttatgacattgatgaaaaatcatagattaaatgaaggttcatgcataatctgaactcagatgcgtgatcagtgcattttttaaccccaaattcaatgtaaatttatttttaaaaaataattaaaaaaatcgaaaaaaatcaagtagttgacaaaaaatcttagataaaaatcaatgattttcaaaatctgagctcagattcgtgatcagcgcattttttaagcccagaaaaaatatacaaaaaatttttaaaattttttttcgtcgggacaccaattcttaatggttgcctgtta

SEQ ID NO: 35452 - DNA, 929 bp, Heterodera glycines
actatcctatcacattacattgccactgaccgattcgcttttagtgctttccttgcgcatctccaccgtcagcttcggctgactgtcactgctccccgtcatttcctcccgcgtctccaacttttcaacaacccttaaaccagacagtaaatgagtttgctcttttaaatgcattttatttaattaattgcttggccatattatatataaaaccagaggagccaacaagttttttttaatggaattcccaaaaaaatttggttaaccttcaaaaagcgtgccaagcaaaacaaaaactcttcgggtgccctccccgaaatttttttctggatacgggcgcctggcgctgcgagccatagtcaaaaccaaaaatattttcaaacaaataaaaaatatatataaagtcatgccatcgcacacgtacactttctctccgtttgcgtcctccccctcaacggccgtcaccaccaccacgtcgtcacccgccgccacttcctcaacgatctcctgttgctgcggtttttgctcgtcgttgttgtcagcgtcgttcccaccgttttgacctttgtcctcctccaccaccaccaccaattcattctgaggcggctgcgttggcggcgccaaatgcttcgcatcgctctttcgcgactcgacggaagtgtcactttcattctcgtcctaaaaatttcaatttttaaaatttttatgcaacccccgccacataaaccgtcgtacatcagtgtacagtccagccgccttcgttgtccaagtcgatggtgaagcgacctaaacaacaattcatgaatgctaagaaatataaatataaaccccgaaatgaaattttagtgtatgggtgttctggggtttcaagtatagatagtctgaaattccaaaatctggtaataatgcacaagaatccatgaagtccg

SEQ ID NO: 35453 - DNA, 408 bp, Heterodera glycines
ttgagataaataatttttaaagcacaaattcttgtcaagaaaataaataaataaattttgagatgaatttttgaaaatttcatttcttagggggtatttttgaaaaatttcggatcgcttcttagagtgaatttttgaaaaaaacttgggtcgattctaaggaatgtatttttcgtttttattgcatttttattaacaaattttggacaaaacgccaaaataggcaaaaataggctttttcaaaattttttaagctttttaggcgctaaaaataaaagcctagaaaataggcactaataactcgaaaagtagcttaacaacaacccaaaaaaaaacatgtttttcgtacgtttcaggccacggggagctcaggaaaagaataggcttttgcctaaaaatcccatccct

SEQ ID NO: 35454 - DNA, 987 bp, Heterodera glycines
attttacagaaaataaattatttttaattttttcattcattttttctatttttttaagttacaaaattcactcgcgttacaaaatcaacatctttaaaaaaatttcttaaaagtaattccaaatccatccctatttcgtcgtgcgatatttgtggatgaactttcaaaaaaaaagaagttacgaatggttttcaaattttgttcactgatttgttagtttgactctttcagttgcagcagcaaaaaaagcgcgactttgacttctgttttttcaactgcttttcgttttttgctgttttttgtgcttcttctttcgccattttttcctccgattccgccggattttccgctgtcatttcttccagggaaaatatttcctcaatttgttcagaattccttgaaaaaacatccggagtaaagaatgccgtttcgtctgtttgtcccgagctttttgacaattggctaaacgatgaacgtgccgttgtcatcgttttttcggagctgctcgacgccatcgtcccatggctttgtgcttcgagttgctcatcaattttttccaccatttcttcgggcgaagaatgtgccgttcccacaatcggctgcgaattgccattttcttctgcttttggtgctgtatcggcaaacggagatggcaccggacatggttcgacttcactgctgtccggaattgccttagacaacggtgaaagtggcagaaacaccgaacattccgtggacgcatttgacgcccgcacaggcgatgaagtggacggagtgccaccgataaattcaaacattgaatccaaaaatgatgacaaagtccccaacacgggatattccgagtcgtttgacaatgcctcagacgaggaaatttgaacttcctcgatttcgttgttgtatggcactgcagttggtgttgaatgaacttcctcgatttcgttgttgtatggcactgcagttggtgttgaatgaacttcctcgatttcg

SEQ ID NO: 35455 - DNA, 1191 bp, Heterodera glycines
  misc_feature (257)..(257): n is a, c, g, or t
ggtgtttattaaatcagaaagtgatttggcttttttgcccttcctttcctttctcctccttccccaattttgcttttctccttttttgctccgtcgctttcaaatgtgaaaatgatctgcgcattgtccgcattgttcgtctccagaaagtcgattttgatcacaatttcccatgcgcggaatgcttgcgcaattaatcccctgcaaaattaagcgcaattaagttaattatgcaaaagcatgtaataaaacatgtntaatgagtgctaattcaaattggcaaattgtgccaaattttggctgacttcgtttcgccatgagtgaactgcttggggtgcgacgcgttcaggttccagaacaatgtcgaacgttcccaaagttgcgatgggtctaaagcgaaaaaaacaaatgcgaataattaagtaattaattaattatcggactaattaaaaaataataattattatttatttaaaacacagccagtgccattgcattaaacactttgtgtaatgcaagtgccattctcggttggtaactttgccaagaaattagtttgacttttgatttttagggccaaatttccggcatttttctttactccaaaataatcctggcaaatgccataattcatcgatccgcccccaccttgtgctgtgtagccctcgtcagagttggcacagcgtttccacgacattttttgaagggttgccaagtcgacattgcccgtctgccggtagcccaaaaagcgttggaaatgcctaaaatatttgtgatttttaaaatatttcattttgaaattttatttaaacgcacttaacgccatgggaaaggccattctcattgtgcttcagatgaccaaattctcgcagataagtcttaaaaagaatcatttgaatagaaaaacttggataaatttcaaaaaattattaaattttcaataaaatattttttcaaagaaatattcatttttaaattcaaatattttgttccctaaataaataagatttttcgaaaaatttcgcaagctaaaaatttttttttaaattgataaaaatactcaatagttcttcaaatccttcaaaaataaagacaatatcaaataatgttaaaaaagaaaattttaattttttaaatatttatttaattaaaagagaaatcttccatatttctctacactttccacaaatt

SEQ ID NO: 35456 - DNA, 1043 bp, Heterodera glycines
aaaagaataattatttatctttgttgtcttataactttttaaaacaacagttaagcgatgatagtgaacataggaatcgatgtagaatatttttctctatcggtatgttaaatttggtgtggatttaacgtgcaggaaaaaagttaaacgtcacgaagtaaatgttgctctttacagcttttttttcttttttaccgtccatggtgcagggactttccccaatcaaagacgcttccaattaacgatcatcctcagtttaccataattttccatactaagtcgaacatacgttcttggcataaaccaaaagattaaagtttaggaaatttgtaaatacaaagaaatgagcaaacaatgatttaattaaaagtttaacaaataaatgatttttaacgtttttcaaacaagcaaattaaaaaatggaaccttttatagtgcgtatcagttacgcagggaaattgcgcccctatgaactcgcagaatatgaaactattgcaatgttaaaagtgcgtgtcgccgttttcgaggatgtgcctccgatccagcagcgtcttttttttcaagtagtcaatttgtcatagaaaaaagtcataattttttcattttagatcaccaattggcgaacgagggagtcatgtccaccatggtgcaattctcattcgtgtggcgccgcctggtggcgaactcgtctgatgtgccaagacagttcggaatctccatgttttttttgtggttgatctccatgtttttttgttgttcatctccgttgtttgtttgttttttgtttgttaaagtaataggatcccaaattcttatttttttttgtttgtttatggcattagaccttctctaatttttatactatttcaaaaattttcactcttttaaactaaaacctaagtcgttgccgcttatcctcttgcgcaattgcatcaaatacgcaaacaacggtttgtcatccatcgaatccaaagtcgtgaagggcagtacaaactgtgcaagagagagaagcaggcggtcggtgacaaacaagtgccgtacat

SEQ ID NO: 35457 - DNA, 947 bp, Heterodera glycines
cgcagagcctcttcaaaaatttttccattacgcaaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaatttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagatttgcggaaattggaattaat

SEQ ID NO: 35458 - DNA, 1690 bp, Heterodera glycines
ggaaagataattgtatacgcttaataaaaataattcaaattaaaaaaataaataccttaaatgaattaataatttaaattaaaaaaagaattgtttgtttcttattgatttgaaatgtgaggccaaaaaaattagaagaataaaatttaaaaggtatttttttataaaagtaaaaatactactttaataaaattataatttaataaaatttaaattaattcgaaataaaaaattagagtataaaatatattttcagaatacaaaaaaataattaagaataaaagcagaaaaaagaaagagataaattcaaatttaaatattcattatccttaactgttataatttgtgttataatatattttgtttttaaaatataaaactgatttaaaaaaatttataaaattaatttttacaaaattcaattttttttattagagttttaattattagtaaatcacaacaattaagaaataataaaatttaatttatttttatcaattgcttaattaattgattatttacttattaaaatttctttaattaaaattcttaaagtaaattcttttacataaaatattattatataacaaaatgccgacaacatctacaacttattcaatgagcttctcgagaaatgaaatatattaaaatacattttcttaataaataaagtgatactaagtagaaaactaaaaatacttttttttaaatcaaaacatacaaatttttatttgtacttgaaatgatccaacatttccaataataaatattaagactcatagaaaaatataaataaaaatctcatgatttattctgttaacattaactaaaattatttgtttttatatagatttgaatcaggagctcaaaaatgtgaattaaattctacttacaaaaaataataccagaaaatgggaaaatttaaaaaaagcaatttagatgaactttatttaaataaaactattttaaatcgttctaagtatattatataattattcaaaaataaattgtaattgaataaaaaatatttaaaaaaaagaaaagtgaacaaatgtttaatttcttatacaatcttttgaaaaaaaatttggtgcaaaacttatgtaacaccctaaaaaaaagaaaaaaagttatgcgtagcgaagacatatgaagattcaattttttaaaaactaaaactatataattataaattaaaacaatattttaatgaccaccatcttgcagcaattagtgcttaggcgatcaaaacataaaagtaattttaaaaacaaattattatgcgaaatgaaaaataattggaagaccataaatcagcaaagcctaaacaatcaaatttttgtgtcaaaatcagaaaattaggttaggtattgacaatactaaatagaatatataggcataaccagaaaataaacgaatataactaaaagaaaattaattgtattatctttaaaatactagatataaaaaacaatttaaattgaaaattatatgtacaacatatttatggaatatgaaaaaatactacagattgattaattgtttcaaaaaagcaagtcgaacaattttgtcaaaaagaaaatatggcgtacaaataaacataaaattatcaattaaatataaactaaatactaatataaaatcagaagacgcgttaatttgattttaatttaaattaaacctctgttaa

SEQ ID NO: 35459 - DNA, 129 bp, Heterodera glycines
tctctcttactttctccctcttctctctctctctccccctcacccctctctctctcttactttctccctcttctctctctctctccccctcccccctctctctctcttactttcacccccttctctctc

SEQ ID NO: 35460 - DNA, 681 bp, Heterodera glycines
  misc_feature (653)..(653): n is a, c, g, or t
gatgagagtgagaaagggaaaagagaggtggggatggagcagacgagcgaccaaagagtgggcacgcaaatggtggacgggaatcaggggacgacgaaagcatcgaaaaggcaaaagggggagagaggcaattagctaagtcaattaggactaattagccaattgattaattgggcacggttggtcattaattctttccaacacctggcaaaagcaagcgcatgctcaacaccaactgaaaatggagagaaacgactgaattaaatggatgaataaagtaatgaaatgccttttagacaataaacgaggccaggacaattggaaacggacaccgcgtcaatgtcagaggaacggaggtcagaatcggacaaagcattctcaatgagaggaccaatcatagaacgatgctaacaaaaagacaaaaggtaaggcgaaaacattaaatgaatggccaaaaagggaaacaaacaaatgctaattggcaaattaagcctaattagcgactaattaattgctccccaattggctgctaattgactcactcacatgccttgcggaaacgtaaggtgaaacgccgcctaagcgaagcaaactgtcattgccgcacttcgtctgtccgcaaacactcgccgttcctcccaattgacatggcnaccggcggcgtcgtcacaactgaccaaa

SEQ ID NO: 35461 - DNA, 449 bp, Heterodera glycines
ctttggataggtttctaattccaaatctgacctatcactcatacagagaccgacaaccaaaggaaaaaacgaagccgcattttttgaccgcgcacaccagaggaccgaagcgcagaaggcacaaggacagcggagaaaagagcggcgccaccccgcccgggacggggcacaaaaagaccgaaaccaagcagaaaagaaagggagacaaaagcacaacacaaaaggaaacacagaagcacacacagagacaggaggagggacgaaagcagagggacacgaagaagaccaaggcacagcgccaacaggcagccacgaaaaccgccaaacccaaaccagaacacccacacaaaagaaaggacaaaaacaaaaaccgccgcaccaggagagagcaaacagggccagcaccccggagccaaccccaaaaaccccggacacgagacccggcaaaa

SEQ ID NO: 35462 - DNA, 852 bp, Heterodera glycines
acttcctctcttcaccatttcaagccccggccacttacaattagcattagaacccacccccatctccataaatgccattccaattttttccaattactctatatatttgcctattccaattccctcccaggtgacaatttgctgacggcgatgagcgtggcacgcgagtgtggcataattcggcccaacaaacgctcatttttgctggaagccaccaaggcgcacgatggccaaacccatttgacgctaaagcagtcggtgtcctcctccgaggaagtggtgcgttgtggaataaaacttggatacagttactagtgctgttcgagaccgaaaatttcccgagaccggttccgagacttgaccccgagactagatatcgagaccgagacccaaaaaacccgagacttttctcgagtcgagaccgagagtctcgaacagcactaacagctaccctccgtcgccccccccaaaaaaagttgttttgacaattttctctgggaagcgtttttttttgccacaaaatttaagtatgattattatatattacagcttgaattcgatgagaatgtgtccttctacgatgccgaacagggcaccggaggaggcgtcagcggaagcggtgttggcaaactgttcaacaataataatggggacggaagaattgccgagtccacgtatcatgtggcggtgtccgggccaacactgagtgcgtttggtggtggtggtggtggtggtaatgttcaaaagcaataaatattagctcccattctcaaggcatcatttgcgagcagtacccggagatgcttgagcggttggtctgcgtgtgtgatgtgtacgcgcgaatgtccaccg

SEQ ID NO: 35463 - DNA, 878 bp, Heterodera glycines
  misc_feature (6)..(6): n is a, c, g, or t
  misc_feature (14)..(15): n is a, c, g, or t
agcatnttggccannttctttttgagtaaaaatttcaaaaatcttccattgtttaataagatttgagatgcttaaaatttaaaagtgtgaattttattataatggaagcttggttaggtagttgccgagggtataggaagtcggggaagcttaaaataataccccgattaattttgtcggggacggcatttcttgcgaaggcttggaaaaactattattttaaaacaataattcattttttttcatctctagcggctcatttttttgtcttttaaaggctcgagttttggattggattttcgatggtagcctggggttactttgtatttttgtatattgaaaagtaggggtagttggtagaagaagaaaaaagtgccattgaaaatcaaaaaaaaaattggcagaatttgaaaatgaaaatatgaatgatccaaacttaatgccattttttacttcccaattgtacttttttccaaaaaaaaattagttttttttttgtttcaaaaattctgtgattcttaaaaattatttaatttttaataattttaatatatgtataatggtgaatgaatgacggctctaaatatacttctgaatccaaaatcaaaatcttctttaatttggtgcatttctctatattttagtgggttgttagcaataaaataccgtaattttctctgtttaaaaaataaatgaaataatttaaaattgtattttcctaattatggcaattattactctgtatggacacagaaagtgcagtaggagccagaatagtaatactgctcgaaacctaaaattttctgagaatctatacgagagctagagccaagcgcgtagccaggagggttggttgaggggggcattttggctatata

SEQ ID NO: 35464 - DNA, 1163 bp, Heterodera glycines
tgcccctgttgcagcgccccgttttcattgccatttctcatgaaggcgcatgctcctgctgctcgaccggaggcacattctgctcattttcccccgttggctcaatttgagcattcccgtcgttggggctttctcccccactgccgaacgcaaagttcacattttggacgtactcctcaaaagcggccatcaaagagttgctcattcgctcctatttttcccaaatttattttctgatttttttttctctccgtttattttccattattctctttcttttttttccccactatccgacctgaccgctgagccaaggctcaatttttttccacagtccgtccacagcggccgccatttccaatttaatgctgccctttagctggtcagctgtttcgcgcatctccttctccgttttgctttggagttgttcgaccaactcgcgcacttctttcgcaactttttcgtcacgcgattttgatttttttgacaaaagcgcttctttttcgagacgttccaattcatttgaaggagaatttttcccagaagacattttagtgattgaatttaattctgaaaatgcacaatcatagtcaagtgtcgaattatttaaataaagtgtgagggacaattatcatcaaattgtaaaaaaaaaaaaactgaaaatttttttccatcatttttattttattttatttatgggacgaaagggatatgtacagggtctatgcgctgcctcaattgtgacgcactggaccaactcttcttccttttatttggtccacatgcgcacttctggtcactgtactgccctcaatttgaatctcccacattctttcgcccattggctgtaaaagtatccccgcaacccattttccagtgtgttctttgtaccatattaagtctcctggttcaaaatttttctgatttctttgggggtgcgctgtttctccagttcgctgcagcggtgccaattctctatcaatgtttgcctcaggcatattctgcggcatccttatcttgtccaatgccgtccgcaattctctgcccaaaaattggtgcgctgggctttcggcacctgctgctgcgcaaggggtcaccctgtattcctgcagcagggtaaactgagcaactttggcactcatgccttctgccaacaattttgt

SEQ ID NO: 35465 - DNA, 967 bp, Heterodera glycines
  misc_feature (830)..(830): n is a, c, g, or t
aaaagagacagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttcggcaagaatttttttcgttagcatttcaaatatcgtgtgagtgtttggtagagccagactagagaaggagaatgttggtaccaagtttgcggtcaaatccccaagagaaaaaagagatagccattttttcggcaagaatttttttcgttagcatttcaaatatcgtgtgagtgtttggtagagccagactagagaaggaaaatgttggtaccaagtttgcggtcaaatccccaggagaaaaaagagatagccattttttcggcaagaatttttttcgttagcatttcaaatatcgtgtgagtgtttggtagagccagactagagaaggaaaatgttggtaccaagtttgcggtcaaatccccaagagaaaaaagagacagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcanatatcgtgtgagtgtttggtagagccagactagagaaggcaaatgttggtaccaagtttgcggtcaaatccccaagagaaaaaagagatagccctttttttcggcaagaatttttttcgttagatttcaaatatcgg

SEQ ID NO: 35466 - DNA, 826 bp, Heterodera glycines
cagcacagcgagtcgcttaaatgcacaccctcttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccacctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggtaagcacagcgagtcgcttaaatgcacaccctttgacacgtaaaatattccaaaaaaagagatagtgattttttctggattaggccggacaaataaaaattaccagctatttgaaatgcagtgggcaagcacagcgagtcgcttaaatgcacaccctttgacacgtaaaatattccaaaaaaaaagatagtgatttttt

SEQ ID NO: 35467 - DNA, 530 bp, Heterodera glycines
gtggccaaaatacctgggctattccgtttgtcctcctctacggacactattgtggtcgtatttgcgattggggtcgtatttgtcgttgttgtaacaggaggagaagtcgtccgttgagaaattgggattcgaatcaaaatccgcttttctattttaggtgattcagtgtcagctaaaattgtattaattgttaagtgcttttcttttgtattaataaacccagccaaacatatgcaaggggtgcgccagtgacaaattttgatacgaaattccgaattttgtcccaaaaaatgaccagttttgggataattttttaaagaaaaataagagcttttaggggccggcgatgccgataggcgtcaccggaattttttttagggttttaatgaatttctcaaaatttgtccatttttaaaattttccttcttatcctcttcgctacgacccaccgcttgtcgacccctttttttctctccccgactacgaagcccccccccccctcttccggagccatttatgacggggggggg

SEQ ID NO: 35468 - DNA, 923 bp, Heterodera glycines
tctattctacagggaatttttaaatttattctctatgcctacaaaatggctatctcttttttgcgagaaattttgtacccttaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatgggcattctattctacagggaatttttaaattta

SEQ ID NO: 35469 - DNA, 538 bp, Heterodera glycines
agagagaaggagagacagtgtatgtctgcggagagagtctttttttcactacatagtagcatatccagcgcaaaaatttccgatagaagaaaggttgaagatgccatggcggcggggggagcggaggggagggggcggagtaatagttcgtttgtactccctctccctcccccgtcgcgtatgcatttcgcagtcaagacgggcggataactccatcccccgccgctcttccgaatctctgctgctgctgctgctgctgctgtctttgcttcatcttcttcatcctcatccaccaacaaacacgcaaaaatattcatcccatcccatccgtcgcccctcgggggcgctcctccctctccgtctctgtctcaaggcttgttgctctctctctctctctctctcccttctcctttgtgtgcgtcttggcgcggtgtcgatcgcttccccccgggtccaagcagcgaactctctcccctccgcccccttcgtcttctcccatccgctccctccccccgctccatcaaactcattccccacc

SEQ ID NO: 35470 - DNA, 1425 bp, Heterodera glycines
gctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttgttaagccaaaaaaaatccaaacatttaaaaatctataaaaaatttaaaatgagaattcatgcgagattttctggaaataagcttaattgggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggttatacgattaatattgtctaattgatttggaaaatcaaattgatgagaaaagttattaatatgatcgaatgaggaaccattgttgtaaatcattgcttttgcaaatctgatatcattttgtgatcagaagtcccaaaaacctcgttgtagtcttgataacacaaaaaattttggctggaatccagattctccagaattacgtatcttatatttcatttaaattgattattcaacttatattttcatgcgttttttccccagggcttcgtcgacagaaaaattgaaatccggtgaatttacgttcacgaaatagtgaaaaaggtggatgatcagtgcaattccgaggacatgttgtacaggctcaagcaaatctaataccccgagaacaactttctacagacatgaaactgaagacggaaaagtaaaatgagaagctatgggccatccaaatttttaatattacatcgctttttcattttctctctcgttttggttcgggttgagctaaattattttaaaaaaggtaggagaaggaaccaattctttttaattaaatggaatttttaattgaacaataaaaaaatggcgggaaaagcgccagtgaattgtggaaaaaaggaaaatttt

SEQ ID NO: 35471 - DNA, 1238 bp, Heterodera glycines
  misc_feature (34)..(34): n is a, c, g, or t
cgcaaatttttgctctattatataaattttattntacatttttatccctttttaaaaaaaagttataaaaataaaggtgattttgggattcgggaccaaaggggggtgaccaggatttttgagtggaaaaatttttccacccaaaatcttccaaaaacatgtcattaggggttatttgggccgctgatcacgagtacgtgatcagattttacttttgacatagtcaagacctcagaatccctgtgtgattggggattctgaggcatcatttttttgggggggcaggttcggatccggacggtgtaaattattttcgttatatttatggttatttttaatgtttttaattcatttaaaagagtgtttgttttataataaaaaataaattttttaatttaaattaaattattttttttatgaaaaattttattaaaattaattatttttttaattaaataatttcatatatttttttttcagaaattaatttcatttcaatctaaataaatttcaattattataaacttcaaagttttttttaataataaaaagaggcatttattttacaatttttaaaaattattaatgcatttttgtacctcttctgccatttgttgtacctctctcttttaatcacagttgtacctcttctaatcgctgttgtacctcttctaatcactcttctaatcgctgttgtacctcttctaatcactgttgtacacttctgaccaatgttgtacctcttctaatcattgttttaccacttctaatcgctgttgtacctcttctaatctctgttgtacctcttctaatctctgttgtaccacttctgaccaatgttgaacctcttctaatcactgttttaccacttctaatcgctgttgtacctcttctaatctctgttgtacctcttctaatctctgttgtacctcttctaatctctgttgtacctcttctaatcgctgttgtaccacttctgaccaatgttgaacctcttctaatcactgttttacctcttctaatcactgttttaccacttctgaccaatgttgtacctcttctaatcactgttttacctcttctaatcgctgttgtacctcttctaatcacagtttttacctcttctaataactgttgtacctcttctaatcactattgtacctcttctaataactgttgtacctcttctaatcactattgtacctcttctattaactgttgtacctcttctaatcact

SEQ ID NO: 35472 - DNA, 993 bp, Heterodera glycines
tcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcgggcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgttgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttgggctgctagcctccagtatggggtttgctgtccttctgttcagtggcgaatggggcatcagcacgcggagtgcattgacaagctcggagtagtagccagagttcggtcatgaggccaccctttcggggtctggtacccggatcgggggagtactgttta

SEQ ID NO: 35473 - DNA, 662 bp, Heterodera glycines
ttattcatttttcattcgctactccaaaagcaaattcatttaatatttatttcaaacccttgcccacagtatccccaaaactctcccctacagtaccccttagtcccttcgaatggaataccgtacacttttggacagtttgttgctgagtttgctgctcattttggacacttttcaattggtcagtttgaatttaaagagagaaaattgggtaaataaaataaagcgaaaaattcaaaaaatccgaagaaaaaagaaaggcaaagaatgcgagagaaaaggccgagggaatgccaattaaaaggaaaataaatgccatcgtttgtccctcccttttctttttttccggcaaatgtgtgccatttgttctcatcagactatggcaccgtttggcaaaatgactttaattgtcctccctgaaatttaacagcattttgtgtgcaccgaacgcgtcattttggacgaggcgatgccaaaagtcagtgcccaatacgactatttcgggagccgattgtccgcccaacaaccggtgaatttaaaaaagaaaattgtgacagagaaccgttgaaaagtaaaaaaaaaatttagcaaccgtacggaagtgccatgggatacggaggaattgccggacgggacagtgagtgggggggggggaatggggc

SEQ ID NO: 35474 - DNA, 348 bp, Heterodera glycines
  misc_feature (307)..(307): n is a, c, g, or t
  misc_feature (325)..(325): n is a, c, g, or t
tgaaaattgcgaaaaggtcgaaattatgaagttttttccaaagaaaattttttccagactagaaaatcatttcgttttttgtaaggctaatagagcatatgaagagctttcgaatgataccaacaatcttggatttggatgccaaagaaaagttatagcgaaaaacataaaaattttggaaaatctgcccacagataacacacacaagtaccgaaatttcatgccttttaattaaaattccaaattaaaaaaagatgaccagaaaacttaaaaaattcatttttgaacgttttcgactataattttntgaattttggatgaattntttcaaccttcgtagactaatcg

SEQ ID NO: 35475 - DNA, 1127 bp, Heterodera glycines
atgcgaataaaatacacaagtaaaaagaaattgaaaatagtaaattgaaaatataaatattttttaacttgtataaaaaatgcatatgcaattatctaaaatacaataaaaatacacacaattaatcatttatcggccagggcatagtggaaaaactttaaaatcacaatattatagaatttccaaatgaataaagtcagaataaaataatttgcttaaataaatatagacccactgaatcaaccaaataaattattataaaatttaaaaaattaagaaatattaaatttaattggataaacgtctatacttgacacatataatcaacaattatttagattttacaattatccctcgtacggcaaaaaaaaaagattttcgacacaaattccattacaaccgagtcaattttgagcctccaattcagaaaagatttgaatgtatggcaaagttgtttttgtaagatagtaaaaaaaacaaagggcgaaggttcgagtccgctcctcaacattaatatttttatttatttgtccaaaaaattttaaaaaatgacaattgtaaaaaaacgattgaaggtttttcccaaccaacttgggcaaactttgtatcaatcaaaatctcttgacgaggtgaagcttttaagcaaatgctatgcaatctactaagtttagggatgggacaattatcaataggctataattttcagaaaaaaatcatattttctgcataaacatttcgaaatctttataatttcagagttgcctatgtatggctaaaacttcagctcttcttttaattttgcttttgtgttagtgttttatgtatttttattgttagaattaaagtaaaataaaagaaaattattagaaaagaatagaaataatttaactcaaaaaaagataaataaaatttaaataaataaaaataaatttaagatgaaagaaattgcttgagaagaagtttttaaatttaaataaaaaattattaaattttctgatgtaattaagattttttatgaagttttcaataattatacagcgacaaaagtttaatattctcttggatacagctaaaatttatactcgtgaggcgcaagcctaagtatgcacaaatgtgcccaagcgatc

SEQ ID NO: 35476 - DNA, 358 bp, Heterodera glycines
catttcctttcacctttccctttgggggttgtaagttgcatgcgatgaaaaggccgaaggtaaaaaaaggaagaataagtggggagggaagcgaaatgaatgcatcggcaggaggagaaaaaagggggaggggagaggcagtgggagagaaggggctggtaggcgcctcacagagccaataaatgccccccccccctctccccccgccccattttccctccgtccgccgttcgttcgtccgccttctttccgtcccttttcttttcccttttttttcttttgctcttctctcttctgtctcacagtttttgtgtgtgtttgttgttgtttatttcgaagagacggaaaatcgagaaaa

SEQ ID NO: 35477 - DNA, 1074 bp, Heterodera glycines
  misc_feature (57)..(57): n is a, c, g, or t
  misc_feature (121)..(121): n is a, c, g, or t
  misc_feature (134)..(134): n is a, c, g, or t
  misc_feature (709)..(709): n is a, c, g, or t
cctatgaatttatattttctatgaatttttaaagtttttctcccaggttttaagtgnaaaagtggtggtgtctggaaaaccttttcaccagggtttaaaaaatctaggaaaattagtaagnatttgtagtgttncgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttaatgaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaattnttagaaatttttatttatttttgcataattaattcataaatatttttttcagaaaatgctctgaaacgcaccaaattttatttacatgctagtttcgcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaagggcggggggggggg

SEQ ID NO: 35478 - DNA, 1313 bp, Heterodera glycines
  misc_feature (34)..(34): n is a, c, g, or t
attctatttactcaatcgaaaggaccacaaattntggctcattgatctcgcattggatgccaccacacacttgttatggtgggtaaaaggggagcagcaggaggaaaagccacttcaaatgaacttggttccgcttttcgagcttaattaatgagttgggtgggccaaatttgggacaaagtgcagcagagccatttttgaattggtgcagcaatttgtgaatttgttctccgagaatttgaggaagttttgagcagccgaccaatccctggagatggcatttaaggggggagggaaggcggaagatgaagccgactttaaaggtcaacaggacataaaagaggaagatcaattgaggatgagcagaaatgccattgtgagagagaacggggccagataaagcagctgaaagaacgaacaaatcagtgccagaagaatgatataagtagagaggcaaacagggcacaatgccaaagaggaggggcaggaacagataaatcagcataaaccattagatcaagccggagggggtgggggggaacttgcacataataaggggatgggaaaacggaaggaaagggattcaaaaaattagcaaataatcgccgaaaggcaggccatgccgtaccccctatcttcaattgcgattgaatgccaaaattttgaaccaatggaggatcggtcctttctgtttttcattaaaattcttttaggggttcggggtggaggagtgcgtgccaaaataaggtcctttccccgagggcaaagagattaagcggacaaacatcgctccggcgtcttcatcatcaccatcatcagctcatcgccatgagtaagagggcacattaggaggatgccacctttaacctccccccttttttctgtttgccgtcctcgtcatttccatcttttaacattcggcgccgcctctgctgagaaaattgtctccgatgagtggcgagagaagtaagacaaaggtcattcaaccgagaaaaatggcataacataatgtaattctttggcactcggacaaaaagccgacttagccgaggacggacggggcagggcaccacagcgaaagttgggtggcccctcaagccccgcgggaatgccctcccccgtctcgctactcgtctttgtcgtttccgggaataaagagggcgacaaaatgaatgcgaatgattggcacatgtttgaagtgccggcggaaattgccacagctgagctgcgcggcgtgcaaattggccaaagttcagacggacgtactttgacttttttatttggcaaataaaagcgtgccaccattgtcccat

SEQ ID NO: 35479 - DNA, 883 bp, Heterodera glycines
tttttgctttttggtagggtttgctccagattttgaaaattttttcaaaattttttcggcgccgaaaaagtcattttatatagggcgccgaagtggccgcgccgaactggccgcgccgaaaaagcccgcgccgaaaaagctcgcgccgaaaaaaccccaagccgaaaaacccgcgccgaactgctgccccgaaccgtaaaagtaatgcctagtgaattctttaatttagtgcaaatatataactggaaatggttttctaacacttctctctttctatatccctcttttctctctctctcttcctcactccttttctttctttctctctttcgttttctccctcctctctctcgctctcactctatcttctttttctctaagcactaatttttctctcattctctgactccgctgttctttatatgttctgtggcgtcgctttggaaagtgacgccaattaaccagtgagaaatgccgaacaccaatttagttggttgtactatattggtgagcatcgctgacatgagcagtcattttcatttcactccatttcttccaacaatcaattttcatattcgaacacagaaagtttataattgaattattttaatatatatgtttatttgtcgagaagttaatgttttttgcaaagagtaaaaatttaattgttttagaaattttggcactattttgggaaattttgttgttatccacatttttatccatatattagacttttaatcccttttttttttattttacccattataaacacgctaatttatttcatatatgaaggtactaaaaaaaaaaccccaaattctttcttgatttcttctggtgaaaaatgagcatgggtacttttgcgccccaactttaaaaa

SEQ ID NO: 35480 - DNA, 862 bp, Heterodera glycines
ataaatcataaaatgtgatttaatttggtgttttttcataatttttcaatctctcctccgcttattcgtcagcccaaaaacggcttgtcgccttcttctcgggaatttttgctcaatttgctgtattttgtctttgcaattgcccaaaaatcgtttttcggcttttcttttgatttaagtgaaaacattcgtttgaatttgctctttgattcattttcttcttcattttgccccgattcgttttctgcgctttttgcaaattcatcattttcctaaaatgcatatttttaataattattttaaaaatccaaccgaaaattcatttgcttcttcgcccaacaaaatgtttttggtttcacatgtaatgccccgcattctgagctcatccattgcttttctctgcttctcctcaacaatgccaagcaaacccaacattttttgatcttttctctcttaattaaatttcaatttaaattgtttttaaattcctttcactttcaaatgttctcctcagaattccaacggtgactttgtgaaagaatggaagcgacggaacattgtcaatttgttttgaggtcccgggaatgcattttttgttcaaataatccacaattccacgagcagtcatccgtttttccggctcaatgttcagagtgttctaaaaaatttgaatttaataagagtttgaaaaaaataaaaacaaagttttttgtcatttgagactattttacgtttttctaagaattattgaatgtcaaggcaattcatcaactttttttttgaattaataaccgacggaatcccgactatataaacggaaatgacttgagacccgacatttaaaaaaaattataattatatt

SEQ ID NO: 35481 - DNA, 405 bp, Heterodera glycines
aaataataatgatgtgtgccacgttttgcaatttgattaatatttacaaaaaaaaaaatgtgtaatataatttaaatgtatatttgaacatatttttatgtataattacaattaatactaataacattcatttatgtttaaaaaaaaattactccatttattttaatgcttctttgaagtgtcgacttttataagcctcaaaaatgatttattttatagactttgaactgcaatgaatattattgtacttcttttcattttatcggcttatatggccaaatttggccatggaatggaccggcgaccggcaaatgccgacggaaaagagacgaaaagcaaaatcagcagtcgggcaccattccaatcaacacaagcaaatcagcaacaaccgcagcaacagcagca

SEQ ID NO: 35482 - DNA, 951 bp, Heterodera glycines
cactcactgaacggcggtgacctttttccggccatgtttagttgcataatcaaatgcaaatttggccaccctttcgcactttactcgcgtcataattttcaagcactcaattacaccttaaatttccacaatttcaataaaaaggctctgctctctatggtttgttggtggtgctcacctggcaccaattcgtgctccatgcgcgaatattcgccctccgtttgctcgcgaatgatgacaaagtccaacattttgttgtgccgtgttcggatgccttccagggctttgatgtgcacaacattggcgaacaggtccagccgtttgcgcagctgcgtgttcaacccatccgttttgtcgtcaaggctggactggatggcccccttcaatgcgacacaattgttccgggcaatcgagtcgaccacatcttcctttatcaattaatattttcttaattaatgatctgccaaaaacaatcactgacaatgctggccgatctcgagtagtacacttcgctgagaaagacttcctcaaactcaattggtattccggtcgccttgacaatgtcttggacggcataaactagctcaggtccaacaccatcgcctaaaattgtgcgggaataaagatggaagttggtgaattttgtttatttgcctggaattaatgtgcatttcaattttttagcaatttcaggcacagcaattgcctgaagagaaaacattcaaattttagcatcgaattttcttacaggtgaaatggttgtaaatgatcgttttatgagtgggcaaaaaatacgacgagagaaagccgccaccaccgacatcgttttggggatggaaactcaaatttttttgattttgttcattcgttttccttaaacgaatttgaaaaattttttgcatattatgccaagttttttttgaatttcctttcacctgttaaacaaaaact

SEQ ID NO: 35483 - DNA, 1448 bp, Heterodera glycines
cggggggcggcgacggtcggcgcgccccgcggggggccccaacagattggaattggcacaccgcccccggcccccgcccattagggccccgggacaacaccgacgaccacaaatgctgggggcaaaaaaaggggggaggccggaggaggcgggtgcccctgcgcaaattaatccaattagcagccaatcgattcattcattcattccattcattcactcactcactctcccctcactcactcatttactcacacactcatcaacgcgaacagaagcatcagcagcagcacaggacgaggaggaggagcaggagcggaagctgtccattttgggggacggggaacccccgcgggggcaatcgcaacaaattgcgcatcaattcttgttttttttaaaaccacggctgctcctgctggccctagtgtgccggtggaagcatcaaacattgtgccaatgccaatgtgtctgtctgtccccataatcagttttctctggccataatcaaatgtactgcttcaaaaatttcaaatccatattacgccgtcaaatgcacccagtaaattttgaattatggcattgtgccaatgccaatgtgtccgtcatcattttttatcctggccataatccgtgtactgcttgaaaaccaagatgaatttgcatttaaaaatacattaatgccagaaaacttttttgtttctaaactattaattttttaattttgaatcgtggcgttgtgccatagtctcgtttcgcattgcttcgcagctgatcactcccctgtccctccctgataggaattgatgaaatcttgaattttgcttcttggatcactcccctgctcgaccatcattaggagttgagcaaaactttgaattttgcttttttgccgtgttcgaatgccaaattttgccgatatttttctcgacttccacccacggcatttttaaatttgccacaaccaaacagcattgccaatttaaattataatacctttataaatatttttgtgttatgggcaacagctacaaaaaaaacccatgcatttataatttaatacatttggctgatcaaattttaattcgttgcccggcaattacaaattttaaaaaatccccccccccctcccctccaccgacgccctccgtgccagaaattgaaattccttaatttcttgacttattggagcagtttagcaaatcactctgctaattaaattttctaaaaatttattctgtgcaatatttacccgttctcagtcacaaatctcagaatcccgactaattaggcatttttcatggcgtaagtcattttttgataatttaaaattaattttcttagaaaaatcagcagttaatcttggtttacattttctttttttggccccgtttttgggataacctttatttagcctcaacaattcagtgatctgggctcaaattattgctttt

SEQ ID NO: 35484 - DNA, 660 bp, Heterodera glycines
aaaaaaaataaaaaagcaaaaaacaaaggaatcttcctaccaaataacgacagggacaagcgcccaaagtacgatttcgagaacagagaaacgagaaagccacaaaagtagaatttctagaattgagagaccagcagaaccgtgctccgttttctttgcttcaatttcaatttggtttgtagaatgagaagatacattctgagaatcgtttgagcagaagcagtgttggaaaaaaacaatagcaccacaattacaccggcaatattgaacagcggcgaaaaggtttggcgattcggtgacccacgaggaaaatctgaattttggattgaagtaaaaagcgcatctcaaaaaggcgggttctagtcggttttacgcgtcccatggcattttacgcgtcccatgacattttacgcgtcccatgacattttacgcgtcccatcacattttacgagtcccaacaacactttacgcgtcccatcacattttacgcgtcccaacaacactttacgcgtcccatgacattttgtgtccatggcggggatggcattccgaggccccaaaaatttttggaaatcggaattccgtgccatccctggtctcatggtataatagttgtcctaataactaagagaaaaacttttttttttgtcgggcattcag

SEQ ID NO: 35485 - DNA, 1321 bp, Heterodera glycines
  misc_feature (76)..(76): n is a, c, g, or t
  misc_feature (89)..(89): n is a, c, g, or t
ttcccgctcaagagacagaagggagaataggtttaatcctttttgagttcagggcagctcgcgcggcgatggcggngaccatcggcggncaaatcggcgatgaacgatggaggaaatttgctgacacggatggatgctccgtggcgctgacatttgctttcccttctgtccctttccctcaattgtacatttcatttccatttccttttgtttcttttcgtttattcatttctaaaaatgtttcctctcaatttctttttgtactggaattccggctgccttttctctattccattctcaaatttggggcaccactcctatgcagctctctcaaattgaattttgatccgctggtgcgcaagtggttggattgggaaccgaagggcaaagccgttctcggactggcgcaaaattcttcaatgttcatcgaggatcgcggacgatcctatggaaggggggagctgtaagggattggcccagcctcaaaacaattttcatttccctcatcagccggactttccactttccattatcgcttttcttatctctttcatccccaccccttttccgttcccttcacacttttcctttccccagcgatcagttagtcgtcggagtcatcggattttaccatcgatcaattaattcacttttctcatatcgtccgtccatggaatatttcgatcacatattttatccggagaataaattagtctttaacatcgaggcaatttgggggatttaacatcgatcccagggcccgggatccatcctcccaaatcgtcctccctaattattcggaagcggtgagtcgtctgggggacccacgcgcctccctcactctcggctgagttgtctttagctgacttgtccagaagccttttcaataaccattcttaagcgttttttggtgaaactaggtatttactgatgtattgttagttcaaaaatgggccattcagacgccgccgggtaaatttaaaatattttttttatatatgtgaaacgaatttttggcttaaaaaacgtttttttttgtgtattactcatcaaaacgaatatacagaaaaatattaaatatttaatcctcgtcgtcacattttatttcactttaggcgttcaattgatttttaggcgtcccattaatgaccatcctcagtcttagggcattactttttacttggtcaatgctaaaaaatgacttgaaaatcaccaacctttacatttttagataacttctctgaatttcttctctaaaatatgaaaaaatcggaaaacaattcagacgacgacgaaatgtcattagacaaatgcaagcaaa

SEQ ID NO: 35486 - DNA, 930 bp, Heterodera glycines
atttcatactttaattttcctcaatcttattttacgatttttattgaaaaaaatgaccgtcacatccaacaccgaattccgactcatcgaatgtgtgccaatccttgaggaagttgctcgtgaatttggctgtattacgccactaccaaaccttgggtatgtttctttcgttttacaacactaactccagcatacagtagccatcgtgactatcgtgtaagcggatgtatgatgattcgcacgctgacatcgttgaatcgactctacattttcgatgctgaagactgtattgaggttaatgtaaaatatgtttcatattttattgctattttaggtgaagggtttcttaaggcaagaggacggtacgagccaaaaagtggtcaacgaatattatgaaaaatatgatggactaaatggatttgctgaatttattcggaattgggcctttacctttttctgtttccatgcctttgatgatgatgacacacctgatgaagactaatttcgttaatatttattctatgctctttgttacaaaccgataaacaaatccatcagggttatttgaacgattcaaaatttgcataatattttcgaaacccaatccgacggacataaaataaacgaaagtaattacatagtgaccacaaacattggacaacaccgattgaaaccgcctcttattatagtaaatctttttaaaattatcggataaatattttttgatcaagctgataggcatctctccataagagtcaaagaagtaggcaacagcaggagactgtgcccatatcgcacaccaatgagttcccggcatacctgcagggtcctgaatggaaatacgatgagcgaatgaagcaaaaataagcgtaccagggtaacaatcagactgcacggaaatcttgaacaccttggcaacccatctgcggg

SEQ ID NO: 35487 - DNA, 1097 bp, Heterodera glycines
  misc_feature (84)..(84): n is a, c, g, or t
  misc_feature (950)..(950): n is a, c, g, or t
  misc_feature (974)..(974): n is a, c, g, or t
  misc_feature (1047)..(1047): n is a, c, g, or t
atagattatattctgcatgaatccttcgctaaatttcccatttatcttataaagtcagattaaattaattactccgatttgttntagaattggtccaaatacgcttgctaatagcttttcttttcgaaaagagaggcgaggaaaaataaaggttgcatccaaatgtaatttttttttacattgaagcatttggatggcttgctgtttacagttggctaagtcttatttgcaagaagcagcacaacttttgtttgggccaacgaccccaaaccattcgaatagcaatcgattgggctgactagactccatatttgcaggaatagcaatggcaggtctatcttaaaggcctgacgagttatgtttcgacaaacatcctgtacaccataaatcgattagcaaatttagtcgaactatataaatttttcaaaaaatgattcatcttttttatggttagcgcatatgtctctagctttatagaaacggttcccgaatctgcgaggaactactttttagagaatttctatagattattattttgcatgaatccttcgcttaaattcccatttatattataaagtcagattaaattaattaccccgatttgttttagaattggtccaaacacgcttgctaatagcttttcttttcgaaaagagagacgaggaaaaataaaggttgcatccaaatgtaaattttttttacattgaagcatttggatggcttgctgtttacagttggctaagtcttatttgcaagaagcagcacaacttttgtttgggccaacgaccccaaaccattcgaatagcaatcgattgggctgactagactccatatttgcaggaatagcaatggcaggtctatcttaaaggcctgacgagttatgtttcgacaaacatcctgtacaccataaatcgattagcaaatttagtcgaactatataaatttttcanaaaatgattcatcttttttatggntagcgcatatgtctctagctttatagaaacggttcccgaatctgcgaggaactacttttttgagaattctatnagatattattttgcatgaatccttcgcttaaattcccattatattataaa

SEQ ID NO: 35488 - DNA, 753 bp, Heterodera glycines
ataacctataaatataaaaatcgtctgtgaaataatatggcgattgcgcacagccctccgtctcatacacaagcgctgttgtgaggtataaaatttctcaaaaatagagatagccatatttctgggatagagtataaatctaaaaattccctcaaagtataaacggtatattgcgcaccgccctccctatcatgctcgagatcatttgtatgtgtataaaatttatcaaaaaaagagatagccatttttctgggataacctttaaatataaaaatcctctgtgaaataaaatggcgattgcgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaagataaaaattccctccaaaataaaaggtctattgcgcccccccagcccaaccaatctaaaaaccggcgcgaagcgcccgtcttgagcctcgatgtggactaaaaacccctaataattttttaaaaattcaaaaaaatctctccaaccaattcgatcaaatctaggtagcgaagctcccaaagcgcgaagcgctttttcccagctaaatagccgacggttcacgcacccgctagt

SEQ ID NO: 35489 - DNA, 929 bp, Heterodera glycines
tttgatagaaaaagcatcagagagccttatttaactttaattaaaattggtgcgtttcagagcacgttctaaaaaatatttatgaattaattttgcaaaataataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttagaaattaataaaaaattttacattcagaattactggagttagcatcatagcagtgcttttccttgtctttttgatgccctcgcaaaatctgggtcgcttctgatcagtttataaaaaaaaaagttaagctaaaatttt

SEQ ID NO: 35490 - DNA, 931 bp, Heterodera glycines
cattggaaggaggagagacggaagagaaagagagtaacatggaggagaaaaaggagcagcaactgaagaagaggaaaaagaaaattgcagctgaacaccatcagaaacaacaacatcagcagaagcaagaacattggaaggaggagagacggaagagaaagagaggaaaatggaggagaaaaaggagcagcaacggaacaagtattgctaatggatgtcggaaatcccccgccaaaatcccgaaaaataggggccacagttttcaaaagaaaattcattcattcgatagatagcaaaccattttatatatccgatttatttatatatatttgagaggtttttcttcataaaatgcatttgatcacggatgaattatgatcggtcgatcgatcattcttaattaattcatttcttctgcggctgatcactgtttttgttcgtttgtccgtcactcatttgtcagcagacgacgcccctttttcgctgctttgtcccgcttcttgttcttcttctgctgatggcggagacaatggccttaattaagcgcaaatctcaaatttggatatgtataaaaacaaatcccctttttattgctcacccaatgcaattagtggtactgaaaggccaaaagaacacattgttagaattgttgtcccaatttccgtcttcccaattgaccgctgccgtctccccaattttgcatcgtttcattatccatcggttgtccaattcattttcgttttctttggtcaatgtcagcttttcctttgtccattcgttcaccaattcaaacggcaccatttgcattgacggcacgcgaacagaaaaatgaatttcgtaactgacggaagaaatggcattggcacggcgaaaatgctaaacaatttgataggaaaaaaacaatcaatcatttgtcgaattatgccacacc

SEQ ID NO: 35491 - DNA, 939 bp, Heterodera glycines
gaaggacgagagaggagcaccaggcttgaaatatgctctcttttaaaaattctttatctctttatccttccgccgacttttctgggccccgctattcattctcactctctctctctcctttcttttctctctccccctcctccgttctctattctctcttctctctccctctcttgctctgatcgcgcgccaattcattcattcatttatcccatatttaattcattttgtacaaaaatttgatcaaatttctgtcttttgtttttgtaaaattttgtaggatcgagcaaaaatctaaattaaatttataaaattttcaacattcaaactaaagaattaaattttttacctatgtataaatctgaaaatataaactgttatggtgtaaactctattttgacctttttcattttttgattgtgttttaatttctgttttttcgtcaaatatcatatgcacattcataagactttgacggtgagatggatgattaaatgcttaaaaacaaaattcctgttttctgtcccccgttcattgattccgccatttcctaaggattattcaaaggttttttttctttgatattatcaaggtttaattttcgttttaaaactagctttaatcgcctgattcgataatataatgcttaattaatttttttggcgacatgtatttaggtaccggaattggtgcaaaaggcgattttttaaaattttacattttgaaatagcactaactccctgctggtggacaaatttaaggcttacggctaggtttacttcctcttgctgctttttcgacatgaaatttcatattcttttttcatggctcacccaaaagcacaatagtacattttctttttttactaatcattggcatttgcgcttatttgtgctgctcgccatttgctccttctcctcctcctcctcctcctcctcc

SEQ ID NO: 35492 - DNA, 1172 bp, Heterodera glycines
taacgatttttggtgggcgacattggaggtgtacgattctatattccgtctattacggttttgccgtttgagtacgtccgtgtatattgtatacgtaccgtattgtattttgtatccgtagggcatattcaattccaattttaacgcctaattttgtatacccacgttgtgttgcgtttgttcataaactttgttaaattatgtgtacctattaaattttattagtagggctataaaatattttttaggcgtttttgtgatttttgttatttttcatgacttttttggtacttaccgtatatgctctaattatagcccagtctctattaatcccacagtctccaattatcccccagtctacgaggtgttttgaaaaataatccctctatcataagcccccagtctctaattatccccccttttctgaggaggttgaaaaataatcccccatgggctataattagagcatatacggtatgtatattatctgtgtacagatttcaaaaatcttttttgaaaataaacttgttttataggttttcggggtcgggaaaaccgattctggcatctgttttgacccaattcgaaccccgaacccggattcgaacaaaaaaattaaaatccattttttaacaaaattcacacattttatacacaaaatcgcttcacattaaaaaaaataatgactatggcacgataaaataaattattcatcctctgaccaggagtagatgaaacgtaacattttaattagagaccggcgggaacgggttaagttaacacactttgatttatatttgaatttattgacattgtatttattacgccaatgatttattgacacttttctcttgttccgccatttgtgagtttgggctctctgtctagctcatcataaatttagtttatgacatccaatttttcatcattttctacgcggattggatacgaatttgtggtcaaaggcattaatcgagagtggttcccacataaattgccaactgtattcatgcttttttcatttcgatggtcatcttttgcttatggacgacattcccatcccacccaaatagatcccggaccaagactcggaactcaactatgtaggtggaggaagactaaagccgatggcaggaccatagaccgcccaatttctgtttcgaactccgaca

SEQ ID NO: 35493 - DNA, 882 bp, Heterodera glycines
agaaaacatttgagaggaaaaattaatttatgccataaatgttaatatcaaaaataattcacacaaatattttggaaattttttccctctgtcatgccaaatcttttgttgaattaattatcgcttttacaaaaaaaaaaatatttttcatttcttaatgcgctgctctgttgctgaattaatttaacatttcatagtctatctgtctcattttaaagcatcactttggcgagactctggtctataaaaagttgtaagtaggacaaaaatgtaattaaaatttcataaaaatttttgggtcacatggaacattatgaattccttgggcaaatttataaacaggaaaatttttattttttaatatttaaattatggatttcagcaaataaaatagctaaccttttattttggcagctaaaaagaaatttttaataattttttaagaatgactcaatccagtaataaactttttttctttttggctgccctcgtcactgtcacccaagcggtgaaaaatgccacaacggaaacaaattctgtggaacaggtggagctggacaaatattttttgggctttgactttttggcttatataatcaaaaaaaaatttccaaaaaattgaagtcgtttatgaataattgaggaaaatttttgaaaataatgatcaacaacaaaaaaatgaatatcccatgcgggaatttttccatcacagacataattccagtcacagttgaacaaatatcacaaaaaaataaaaattattttagcttgcgataaagacgaaaaaattgaccaacgcaagaagttttggaacgcaataaacgaagcacaaaattactggaccgtgcgtggacaaatcatatttaaaatagcatttgttaa

SEQ ID NO: 35494 - DNA, 866 bp, Heterodera glycines
tccgcccccaccccaaccacctcctttttggtgggctcctagagggcgtattccgtgcgaatttgtgcctcctcccttctgtcgatgcgctgactctccgccgcattgccccgttcttcggcgaccaccaaacgctgcagagaatggctgtactctgaaccggagagaaagagacgacgagttaatgacacacacaaaccgtagtaattaatgactgattgtataaacggaaaaagacggaacgagtcgtttttggatgcaattcattcccctcgcccaaatttttttaaatttttcaaataaaaattttttcttcgtataaaagtttcaaggaaacttttcagcgattcaaaaaaaatcggggggaaacgacctctcaggtcattttcactcttggagattcaaaatttaaattcaaaagaaaaacggtattgagtctgtagcaagtagggtgcaagttagctatgtactttaaccaaatcattggcattggtactcgaataaaagtataaaatttcattgatttccaattaaaaactccccgccccttttgttacgttttattgcgtttgggtccctctgctgctgctgttgtcctccttttccgtgccattgtcgtgtctccaaatgggccaattttgcttcgtaaatgcgtcgattgcccgcattcattggccccgcaatgcaattgcgacggcgcaaccgttcgcgcagttcgtccagccgaagcatggcgaattggtgccgaagtgcgtccaacacggcctcgtcagagtggcgttgtacagcttcatcgtcatcaccatcggttggctcaccatcactctataaactcaaaaaattgttaaattcttgaagccgcgttt

SEQ ID NO: 35495 - DNA, 1021 bp, Heterodera glycines
ttaaaaattcattaaaaaataaaagggccattacgcaccgttctccctctcatgatcgagagtatttgtattatagaaaattatccaaaaaagagatagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccattttttgggatacagatgcaatttaaaaattcattaaaaaataaaagggccattacgcaccgtcttccctctcatgatcgagagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattacccaaaaaagaaaaagccatttttttgggatacagatgcaatttaaaaattcattaaaaaataaaagggccattacgcacagtcctccctctcatgatcgagagtatttgtattatagaaaattatccaaaaaagagatagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaaattcataaaaaataaaaagggcattacgcaccgcctccctctcatgatcgagaggatttgtattatagaaaattacccaaaaaagaaaaaaccatttttttgg

SEQ ID NO: 35496 - DNA, 1068 bp, Heterodera glycines
  misc_feature (38)..(38): n is a, c, g, or t
  misc_feature (46)..(46): n is a, c, g, or t
tcgccatcggcgcctcatcattgccgggacaatggtgngcgtcgtnaagcaaaggaaaagacagcagggggaggaaacaaacaaataaaaaatggcccaaaggaacgaaaataatccaaaaaagaattttaattgtgagtaccctccgaagcaaagaaattaaccacaaattgcagttactgtggtgactgtgctggtgcatgaggtgccccacgagatcggcgactttgccattttggtccaagcgggcttttccaagtggaaagtgagtgccaaagccgaactatcgcttttccttccccaagcccatttgcttccctcttcccaggccatgctcatccaacttttaacagctttgggtgcccttgccggctgcgttctttctctttggcacgttgacgcggcagcgcttgcggaagcggccgaacaaagttgggcaattccattcactgccggcggtttcatatatattggaactgtacgtttatattaatccgcttaatatgctaattggctctttcctttgaggtgtcaatgatccccgatttgttggaaaaatcaactgtctgtcagagtgtgaaggaaatttgcgcacttcttctgggactagcaatgatgtacgccattgccttctttgaatgattgcttttccgtgggttgggtgtttttcacttttcatgttgtattcacgggaatgtttttttacttaaaaagcagtcaaaaaattatttggggttggggattcattaatgtattccatttgttaacaaattttgactgcctatgtaaaatttgttgccaattctttaatcattcattaatttatttttaaatgaaaattttataaattaatgcgtacaggtaataaacagtgaaccggattattgtattaaatttattgttaatatacacaaaattgattgggctaacataaaaattaagacaatagtccaaacttaattaagtaaatacgagattcttataatgtgttgattgttctatgaattgttagtaagtgccgttccagaaagtcgtcagacaagattctccggccattccggcacataa

SEQ ID NO: 35497 - DNA, 845 bp, Heterodera glycines
attggaaactctgctgaattccgagtccaaaataactttttgatgagttgtccaatagtttagtattgtaatagcttaaacatggattagcagtacaaatcagtcatcgagagtttgagttcaattgaatggccgctttaaccatttggctgccctaaattaagtcttcgacagccaaacttcgagtttacaaaaaaaaaccatcttttaacaaattttaaagcaaaagatttcttgaaatttcaaattcaaaaattagactaaaattttgaaaatggattgatttccgtacagttttgcccaaaagtcggtcaccggctgcttcctgctgctgcttctgctttgggtgggtcgagagccgggcttcatgcccggcttcggcgcactgttccccgccgacttctacaccgactccacctcggccatggcggtggccattctgctgtttttgttgccagctgaaaatcccctcggggcatccgccggaagcaaaagcaacagcaaagagcaggacaacaccacaaattcgagcagttcacgggagggcgacaacaacagcaacaacaatgacgacaatagcatggctggaaaacggcttatggactggccaacaatgcagaaacaattcccggtgtgtttttaagtgctgctgatctcacttttctctgggttacaccgtatttcttaaaatagggcctccgtggctttatttttcaacccccccccccccccggggggggagggctttatctcagtgagggccataatttagtggggcggggcgggaggacttcattagggctttattccagagcggctctaattagggagggggctctatctca

SEQ ID NO: 35498 - DNA, 1001 bp, Heterodera glycines
  misc_feature (56)..(56): n is a, c, g, or t
  misc_feature (75)..(75): n is a, c, g, or t
aaagttccacccgtaagaaagaagatttctggaaattcctacaaagaaacgaatgnttcaatggtgtaaaatggnagtacttgagaaggacccccccattactaaaagggccgggtccgtctgatagatgtttggacccaaatttttttaattccttagaaatttagaaaaagattaaaattcgcttacttcacaggctacaatatagttattcgaaaacaaaaaaagaaatgaataacttaatattataatattaatattctgctcgagattcttggtcttggttctcgtgtcgagaaatttgtcggggtttttttttggcgtctcggtctcgattctcggggggggtgggtcaattcccaatttttgggggtttagaaccgaaaaccagtactttgcagcttacgccccacaaaaaattttttatatataaatttttaaaaccaatttttatactttcggggtcactgatcactagggctggtatgtctatcttggcagattttatcatttaaaaatattagccctattaattatatctcaacttctattcacattcggaaatttaaaaaatttgggtccaaaaatatttgagacggaaccggcccttttagtaataagacggaactgggccaagacggagtaaaataggccccttctgacgggtccacctggtttgggcgagagagaatcagcagggaatgacggggctgaagttgacgaggaagggaatagggagcaaaacaacaaacactccttgaactcattcaactcgaggtcggtcatttctatgatttttaagatgatcaatatatttcaaaaggtccaatgttcgaaatgcaatttctcaaaagatttttccaaattttgtcggtgcgtttgccccgaatctcggcttttccgtccgaaaggtcgaacttccgacggagaatgtctctgtggaccaacatttgtttaccattttgctgcctcccgaatccgcgcaacatgtaatttttgaa

SEQ ID NO: 35499 - DNA, 1371 bp, Heterodera glycines
tcatttcgacgcgcaaaactatgacaagaaaatatttaaaaaatacaattgatttattcttaaaaagaatttttgaataatttattaaaagcaaattaattttttatagcacacgaatgaacatatttaaaaaattattaaaaactcaaatatttaaacgtaaggaatttaaattaaattcaaaaacaacagtattaattatcaaaacaaaatcaaaaaattaaaattatattaaattatctttttgaataaaaactaaattctagtcaaaagaaaaataaaaccctccttttaaaatttttcaaaaaaaattttcaataaccaattaaaatttttaaacacatcacaagactcccaattcatcaagtttagaaaaaatataatatttttaaagtacacattgagaaaggcaactcaattttatttttaaattgtgcaaaaaaatacattacattaaaataaaataaaaatatatataataaataatagaaaacttaatgtagattatcaaaattaatttattgattattttttgtaagtaaaaaatatatattttagcaaatatcaatttattagaaatgcattaatatgctatatcaaaaaataaataatcttttaattttattaaaaaaaaaatttaatcttttaaattgaaaaatgtaatatttattctttagagtgacggaccaataaagtccaaaaaataaatttacaatttcattattttttatcggataacttgtttattttaaagttagttgtattgaacacaaaattttggacatttttattattgctcaaaatttttcaagtgttttttttataaaatttgcgcaaattatttttaataaaatatcactggaaaatatttttagagttttaatttaattaattgatctatatcgtaatttaaatttaatttagctttattaattagaaaaatcaaaaaaatattataaagacataaactttcaattatataattttaaaaatatttattttttttattaaaatattcatattttaatgttgttaatttttaaatcggatttgttattttatttttatttaatcacgtagcattgttgtaggttcatctaatttttccgctgcgttaattggttatttcaaatataaattaattttaatttttttaaatatttttcattaaaatgtaagatattagcagaaatatttcacaaatcttttttagaaaattcagttgttaatggttcactgactcaatcagcacaaaataagactaaactttcggatattgaattaaatgctggcataatttgcaatatattaagagagctcccccagggaaattccacttccccggataatgttacttacattttataaaaa

SEQ ID NO: 35500 - DNA, 1159 bp, Heterodera glycines
ctacgaaaggctgttggaatcaccggcggggggaaggcacgactcgtcaaaaatcaggaacaacgcaacgccaaaaataattttgaatgactgacaaacggcggatggatcagctcactcattgtttaaacaattcaactgctgttttgtatattgtaattgaccaattgtttttgtgataaattagttttttttgataaaaataaactcaccgacaaatccaatgcgtgcgtcgcctgtcttcgccacgtcgaacccttcgccgccgccgcctcccccgccacctaaacggaggaataaaaattaaacaatttactgggaattgaattttaaacctttggggctgattaattctcgtcgtaatttggctaatcgtgctttcagtaagccaaggtgacccttaaaacaaattcgcatgagaatcagtattttgtcagtaaatattaatattcttttaattttgtccagttaatccaagtatagtaatattagattgtaatattaggtcttatcataaaaaatgatcgttttttgttttttctttttaaaagctgctaatggaaacaaaattatgtaatatctgatgataagctttaaaatgagacattaaatttgttcttaaatcgtttaaaaaatatgaatttaaatagagtttggtcaaaaaaattagcatactttttacatcaaaaaagcaaaatttttggtcgttgtagatgacatgtaacttggtcaatttatcaaattcttagtgcttaacaagataaaatttaaatttaaaaaccttgaaaagaaaactaaaactttttagtttggccaaaatttggagtttgttagcatcaactcctattaatggtaattaattgagacgaaataaagttcatttgattcgtttttttgtgtaaaaagcgatcattttttttatatgaacaagacttaattttgtaaaattctatgcctaccatcgtcgccttattcctttgcgtcctcgccatctgaattcacataataacaaaaagaagcatcttgattaattaccctcattttcgatctcttgaattttttcgagtattgacattttgaagggcaaagggaatttaataaacttattctaagataaataaaagaaaatgcagtattttatattcccttactatatatt

SEQ ID NO: 35501 - DNA, 340 bp, Heterodera glycines
gcgacttttagtgacgaaaaatcccaaaatagttaactaaaatagtgagtaaaaatgccaaaatagtgacaaaaagtccgaattagtgacataattttcagccaaaaattgagcaaaaataatttattcactgattgcagttgcaaatgagtaggacagggatttttaagagcaaaaaacccaaaatagttacctaaaaaaattttaaaaattaaaaatttttgccaagaaagtaaatttttgtgaattttttttttcatttcataggagtatattttgaaaaattttagctcgattcttaggggtgtattttttttttatttttttaggtcgattctta

SEQ ID NO: 35502 - DNA, 925 bp, Heterodera glycines
agtccccctgaaccgatgcgcccagatttatgggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaatttttgttgaatatttgtcgtgctctgaaggggtggagggggggggggggg

SEQ ID NO: 35503 - DNA, 1098 bp, Heterodera glycines
tggagagtcggctgagaaaaagtggcggaatgaaccctccttgggtgacagaggcgattaattttatgaatgaacacattccggcatttaaagatatgtttgacaaggtgatgttgtaccttgcaagcctttctataccgaacctgttttatttgaaaaatagggccgaattttgcttttatgttacaaaagaatgcctaaattaaactattgattcaaaaaaaatccctcgcaggacacattctacaaattcgtgttgtttgtgctcattgtctccgttctgttcgtctttctcatggtcagagtgttcaaagtgcgcgtctgcgaccattgcacgcgcgatgtgttgcgcgaacggcagtcgcgcgactggcgacctgccaatccgttccgtttcccatggcaaattgatgccaacgggcgcacggcggccaaacagtgccacacgaaaggggagtgagcggaagagaaagacgcaacggagagggacagacaaaggattggggggggggggagagaccgggttatggtccgagaaatgatcaaagtttcataatgacagaaatgtgagaatttggctgtttcgaatgaggcattttgaaaacatttcgtttgtaagcattggacggaccattatccgctgttgttttgaatatatttcacaatttatgcaattgactctcttcaatcttcgcaaattcctcttaattccaatgctttgacgcagaaatgctttaatatgtagccgatttttcaaacttttctcacctttccattcgttttcactgtcctttttcccattattttttccgtttttaataaatttgttctcactttactttttttccaaatttaaagcagcagaagcaccgtaaaaatattcgtaaataaaattacccaataaattgttaagttttatctttttaggcatgtactctccgccacatgttggccaacttcgattgcgtcgtgcagtcgcccaccggcacaggcaaaactttagcttttatgcttccaacgcagcaaattttggtgcaaaagaaactgaccggcgcaggagaaggggaaatgggcagaaaattttctttgatgaaaata

SEQ ID NO: 35504 - DNA, 1292 bp, Heterodera glycines
ccccacgaggccgcgaagcggccgagtgagtaccttgggcgcagaaaaattattaaggaggagggttcattatttatttatttttttacaaaattaattcataagtatttttacagaaactgctctgaaacgcaccaaaatttatttacaagttgaataaggcactctgactcttatattatcaaaaagggagatgaataaatatttaaaaaatttttaattcctttttaaacatgccaaaaagtttaggcttaactttttttatataaactgatcagaagcgcaccagattttgcaagggcatcaaaaagacaaggaaaagcaccgctatgatgctaacgccagtaactctttatttaaaaatttttattaatttttaaaacttcactattttatttttttaatagatttttaaatgtttggatttttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggatatttttggcttaccaaaacttcatcgaacctggttctttct

SEQ ID NO: 35505 - DNA, 1770 bp, Heterodera glycines
  misc_feature (912)..(912): n is a, c, g, or t
  misc_feature (936)..(936): n is a, c, g, or t
  misc_feature (941)..(941): n is a, c, g, or t
  misc_feature (963)..(963): n is a, c, g, or t
  misc_feature (980)..(981): n is a, c, g, or t
  misc_feature (986)..(986): n is a, c, g, or t
  misc_feature (1011)..(1011): n is a, c, g, or t
  misc_feature (1016)..(1016): n is a, c, g, or t
  misc_feature (1064)..(1064): n is a, c, g, or t
  misc_feature (1100)..(1100): n is a, c, g, or t
  misc_feature (1113)..(1113): n is a, c, g, or t
  misc_feature (1173)..(1173): n is a, c, g, or t
ggaaaataaattgttgatctaagcgctgaataaatttatttataagggcttgatcagatgatcatttatgaatacctatccttaaaatgtttctaaatttggctgaattttacaggtcttttcatcgggagcagcttgtcccccccccggaaaattttatataacaatttttttccaaacctagacactttttgcaagaaaaaaagtttttgaaaattttttttagcgattgtcttgaaaaaacttagtaattcactataaattttttttgtgattttcttattaaaatctttctaagcttttttcttaaaatttcaaagatggtattctcggccggcggccgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccagattttatttacatgttagtttaggcactctgatgctttttctatcaaaaagggagatgaataaaatttttaaaaatttttaattcctttttaaacaggccaaaaagtttaggcttaacttttttttcagaaactgatcagaaaagggaccaaactttgcagggatactgaaaggaagagatttaagatattttaaatattatatagtaagttgatttaaataatttttatngaaaaaatttttttttgggttttnggggnagttatgttgaaatgatgggtntagatttatggggaganngaatnttttgggaatagtttttttatagtntgtantttaattatgggttggatttttgtttattataaatgtttgagtatttnaaagggatatttgaaaaaattgatttttttgttttnggggaagtgtttnagaaaagatgggtaaagatttatggggagattgaattgttaaggaatagattgattatanggtgtaatttaattatgtgttggatttttgattttcataattgtttgagtaccccaaacggacacttgaaaaaatcgatttatttttgttttcggggcagtccccccgaaccgatgcgcccagatttatggggagaccgaatctttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggcgagaccgaatccttcggggatagcttccctatagcctgtactttaattctgcggtggatttttgctccccataactgtttgagtaccccaacggacacttgaaaaatcgatttttttgttttcggggcagtcccccc

SEQ ID NO: 35506 - DNA, 1167 bp, Heterodera glycines
ctgtcgtgaattcggcccaatcttttcgagggccctcttcaatgagacggacgataacgtgagacaccacagatatttgacctgtgcgcctcttaaagagtcgaaatgagcaatttggaaaattggttaagtttagataaaaacacgaggattttaaaatggcattgaaaacccatttcattagtatcaaaacagaatgcacccttttctatattttattgagaaatgtttaattcgggtaccaaccaattcgtcaacctccgggtagtttttgccataaattctcccagcaatttggccaaaatttggcgttgggtatcgcacctcaatgtccgaaatgtacatttggtagcactcctcaaaatacctcgatttttgagtcggaaaagtcgtcacgtattattcctgctatttgtaacttcaaaagccatttaagcattgaaaaaccatagctctgcaaaattaaaaaaatgatttttgaaaaacagcatgaaagaacctgaaccaatagtttggagtaagagtgcagaacaaccggtttcaaaccctttgcgtacattgactgaatagcgatcatacggagaattgacactttgtcccttctctcaatgatagcattttcaatgaagggaatcactttgtcgggctgggcattctttaaaatgtctataaaattgtttttttattgattttactggtcagggatttagaaattataattaaaatggaacaattagggggtaagcaatcggctattcccaaaataattaagaaagaatgacaaaataaattcctggtatcataccctgttcgcaccgaagaatgccagtaaaaaatttgtcaatcagccgtcgttgaagcagaccgaccaaacgtgtgaaatttcccactgatttacgcttttcgccaatgctcggcaattttgagacaaattttttatattccgccatcgacgccagtttatcactgttgataagagacaatattcaattgcactccataatctctttttggcacggttatcgtgtcacctgttcctcttccttcggatcattgacatcgactcgtattttgttggcaactaaaaaatcattcgcttcattttgctataaaaatacacaaatgaaaggtgaactggtcagcgtgtaaatcctgctagctgttcat

SEQ ID NO: 35507 - DNA, 1659 bp, Heterodera glycines
tatacaaacctaaaggaaattccggaagtggcatcggcagatgatttgagcggcatttgactcagctaaacgatggcccgactcaccaaaacacaaagaaattggtggcggatgaacggactgacggacggacacaacgtcttcccgtggaagaagaactcaacataacaaaactcattatcagttttcttaaaggatttttctttattttatttttccccaatttgtttatttaccatttaattactctatcccatttattattgttaaccaatttgacttctgttaagtcgcaattcactggttttctttgttatcattcatacatattaacctaaacacttatttaatcactgtagcaattaaaaattttttgtttggagaacaaattttcctttccagcaatttggattactaaacaccacactgagtatagtctgtttttcccaagataattcgtttgttggttttttccctcatttcttggtgcaaagtttcgttgttttgatgacgctttctgcccttgctttttttatgttttagctgctgcgcagcttaagtagtgattatatttatttatttgttctattttgagtttcttctatgcttttgcatgaccataactcaacaaaagggaaaaatggcggaggttcaaatccgcctcacgccaacatttttggatcaaaaaatttaaaaaatgacgcttattgaactttttgctagtagatgacatgaatttcggttttaataaaaaaaaataatacgccaaaatgagaggtgtatttttctctgcactctcttctttacgacatgcatttattaatcatgataaaatgttattacccataattctttaatcaatttaaatggttgagtcattattaggcatttgattaatttttctatcttttgcaaatctacattttttctaacttgttaaatcattttaaaaagaaaaacccgacagaaatgttgccccacggctgtttcccattccgtgcctgtctcgactgtatccaagggccaagtctgacggccacacaaagttatgctcagctgagagaagaaatgcgcactgtgcgacttgatcgcaaccacatgggtgtgttgtgcaagggaccgggaattttaggcaaaatcggtaccagaaaagccgggatcggtgcatgaattttcaatcgggaatttttccgtaaaaaggggtgggtaccatattaaaagtattaacattttttcaagtttaaaaaattaaaaatgaccatttttattgttttcacttctttaaagctaaagcgaacaattaaatcataaatagacaatttaataaaaaaaaataataataataattaaaaaatttctattcattaaaaaattttgcttgtaaattagctaaaaagtaaaaattaattcttggtatcatattcgatcgcccagtgttctccattagtctgatacatcacagtttggaaaggctgtcggttcaaatcccaccccgggggccagttgtctttttacacaaagatcagcagaaaaatttctgaatttaaatgggaataaaattcctcgatttttttactaattggtccttctctttttcagggtgatgatgttgggttgttgaaggaaggcaacaaaagttgtgggctctggtggaatttt

SEQ ID NO: 35508 - DNA, 1263 bp, Heterodera glycines
  misc_feature (36)..(37): n is a, c, g, or t
  misc_feature (132)..(132): n is a, c, g, or t
  misc_feature (164)..(165): n is a, c, g, or t
atatatttacttaatagttttttgtaaatcaatatnnttcatttaatattttaaatgattaaataattaaattttaaaaattttttttcacagaactcatcgatttatttgttgtaaattttcggatttttntaaagataaaatttatttaacaccaaaatcannaatttattaactattttatttaaaaattttgctcgcgccgatttcgaaatttttttgccgatcaaataaacattttcggattatttcgatttcaatttcatcaacgcatcaccgctcacaaaatttatgcaaattcattaaatatgtgtggatgatcgaaaattttttacacaatctttaaatttatcatcgtaaaaacatggatttgcatattatttaatggataatgaataatgataaatacacatttatttttgcgtataataacaacaccaacaacaaattggcgtcaaagttgaatcaacagcaaggctaaattcatatattaaaaggcaaaattttttggtgtcatttcgcattattttttcaaaatttggaaaaatatatcttattttcggactatataattatttgcaagtttttgggattattcacgctggtcccgccatcaaaattttgattctcaattccgcagcgagatcagaaaatttaaaatttccagtctctaattaataccactaccatgctttttctttttgttattgtcggacaacttctgctggccagtgaaatggttgtgcatggtatgtcattatttaattcaaatttcattacaaaatacaggaggccattacggtggttacagtttcgagcaaccaagcattgagcgtgccgaaactgatcaaattgacagcgacaaagacaccatcagcgacgaagcacttatcaatggctccaccacttccacctttggctcatcatcatcaccggcactcattcgtcgtgttgatcgatcggctgatactgatgactcatcagaacatttgcgatcaggtataaatcagggatgggccaaattgaaaaataaaaagcgaaatgcgaaaagccaaaatgtgcgaaaaggcgaaatgcgaaattttcaaaaattttaccaatagtcaaaatcatagattttgaggttgttatgcaaaaacaacaaaatttctgcattttctggttcaatctttttctcagaccaaaaaaataacaaattctacccattttggattaagtttcaaaaatcaagggtaaatgagtgtccggcggtgccgacaggcg

SEQ ID NO: 35509 - DNA, 916 bp, Heterodera glycines
ccactaagtctctcatcgcattacaccgggcctctatcttccaacgcggacgacgagcggaacatcgatcattgctcttaagcagatcgtgttctcactcgcagaaaaaccgcagcacacgcggctcgatcggatagagaaaacgccggtaaaaattcaatatttcctctatatatatatttaaatttattctaaaacaatataattttcttttttcgggatttttccgaaaaattcttaacataaacgcaataaaaaccaaaaaacactaactcttaaacggcagagctcggtatttaaaaaaaagactatacccgtacccgtatttcccaattggcccgtacctggtatttttaggaacttgttttaaaaagcaaagaaaggtttgaaaaaatcaattaattgcttaggggcatcttaaaatatctaatttacaataataatgtctctttaaattatttgatcatttttcgaaaaattgaaaaaatatcggtcacttgaaataataaattctaaaattttgtacaggaaaatccagggtttttcgtgttttgcctggacctgtacctgtattccaaaaatggcctgtacctgtatttcctgtacaaaaatacaggaaaatacaggtacaggaaaaatacaggttgccaaaaatttgcctgtacctgtacctggatccaggaaaaatacaggcctggacccgggtacaggccgagctctaattaaatgacccaaacaaaatttcagaaaatacacccctaagaataaaaaattttaggtttaaaaatttttcttattcgaaataaatttataaattatttattaatcatttaaataaccaaaattaaattttttgattaagttttacgtattttgctccctaaaccccttaattaaaaaaattaaatgccttttt

SEQ ID NO: 35510 - DNA, 703 bp, Heterodera glycines
cattgactttgcaattggcactttgtcctccaaatttttgccggtgctattcgccgaacaaaaattgacacccgcgcaaaagtccgtcacgcatttgctacccgcgacggcgcccttcggagaaatgtctttgaagccgcggaggcattcgcaacggtacaaatactccttgaaaagggacatgagaatgatgagtgggcatcatctcaatttaattaccaaatcaaagcattgcgcgtgctcagagcattcgttgagtgttgtgttttcgcattcgttgatgccgtacaacggcacacagtcgtggcccgggttggccaccgacatgtcgcggtacccatgcgcacattcgcagcggtacgaattgggccccgtcgcaatgcaaatgcctttggggtggcaatcgttctaaaaagggaaactgttgcaaaaaagagaagacagactcatcctcttaccataaagcacgggccgaacggacttggcattgggttgatgaaaaggccactttggcccacttggaagttgttacggtcgatgatccaccgtaccaaagtgttgtacgccgtctccgccgttggggcttggccaacgcggaaagacattgtggcattgtacagaacgccttaatttaaatttgaaaaactcgtaatgactaaagtgtttaattgggctacccgacttttggggattgcaaacttgg

SEQ ID NO: 35511 - DNA, 1129 bp, Heterodera glycines
  misc_feature (1060)..(1060): n is a, c, g, or t
taattcactaattacccccccccccccttatgacgacccttcctgttcgcgtgttgtccatcaaacgggccgagtacagtccgctcaatgcccacttggactctcaacgcatcggcagcttcgaaatgctcgccgttgtcgctgtaagtttcggagccaccgttacggtaaggaaacgatattaatgtattttaagaattttttttttttgaaaggtgacttcaatcattataacaatttgtctacagcgaagtcgaattcgaaaattaatggccgagaaaaatggaaaaatgacaatttacggagaataaaagagcaaagatgcgatttaattcataatatttgcatagataaaaattaaaccaaaaattaatccattttaattactcaaaatttttgtttactcccgaccgaaattcgattcccgacgaaggcgttcattacccagcatctcggggagggggggggggatcctttaaaatggtatattttgtccgttcaaaaggggcgaagcaaattcgaattacatttttaaatgaattcaaatctgcacacagtgccaaataatattaattgttttttaatttgaattcaatttttcattcattcgctttccttcccttttcctccgccaacagcggcaactgtcaccgccacttttgttctcaatgctaaaaaggacaatgacaaagatgagtgagtgaatgtgaacagtggtcacacatttggcgcctccgtccacttttcccctttttcttttcccttttctctctctctctccgtcacattccttctccattgattggtcaattggcgcagtgcaaaatgaaaatggaaaagttgtcgtgtcgatcaaaattagaatcatctgttgctgctgctgatggaaagaagggttttatgtatgatgagaatccctcccccctcgtccgatcgatggagggggggggggggggggggggaaaggatggaaatgaaccgaacgaaatgcgaacgaatgaatgagtggtaacggacggacggatggacgaccaaaatgaccaatgaacgtcccattttnccagttcatttgcatttcgctactctttatggaccagcctttcttcgcaattccctccttttctttcct

SEQ ID NO: 35512 - DNA, 798 bp, Heterodera glycines
gcataaaacagcaacaaaaaacaacaatttacgtttccattgaataaattaataaaaaggcatttgaaaatatctcaaattatggcatttatttctccgcaataattttggtgtgcacttcttgcactaacaatatgctccatttgttgttgttttttaaatttcaaatccgggccacaaaaccgaaaagtaccaaaaaatattcatttctatcgtccgtacaacttataaaacggtcaaaaagcttgtttttttgagaatttttaaacctttttctaccgaaaaacacattttttgaaaatttttaaaataattcagtgagaaacgaaccgccaacgaaattgcgtccattgcgttgccgtcaaattggaggacgacaacgtcgacgtacaagcaccacagctgggtgggtgccagcatcagcttggccatgtcgggcattgctgacggggcggtgttggcgaacgcacccgcaagcgacttggcccattcctcagcctggccagagaaaaaatgcaattcaaattaaaatttaaaaatggcaaaaagtgttaaaatttggaaatgcgcatttaagaattgtttttgatcaaaattttcgcttttcctcattggtaccctctccaaggcctccttcacccaaatgtcccgaaaaatatgctattttttaaaaaaatctacaaaattatcattttagtgcaaattgtggccaaaattctaaaaaaaaaattcccccgacgacacttgttggcaccgacggggccctctcattccctggaaaacgtcgcaacaaaatgg

SEQ ID NO: 35513 - DNA, 998 bp, Heterodera glycines
  misc_feature (931)..(931): n is a, c, g, or t
cgttgatatatatcaaaattaagaaatgtgcccgtaatctccttcaatgttttgttattttttgttggaaatacattgataaatatgttgtaatattaaattgaacatttttccaaaaaaaaggattagaattcatgtgggcaacagcttgccagactaaaccgaccccgaccgcaatttttggcaacttttaagatcttaataagaaaatggaatcaagacggatcccgaaaaagaccagcgggaccccgtcaggtctctaatagcgataaatgaattgggcagatatccaactagcgaaattgagataaatatgatttttactatggtttccatcacttatcgggaccatgccatttttatgggagaagcattacggagaagtacctattacttaaatgcattagatttaagctaaattgcgaaaattgctaatgtaatagttttattaatattcttgagaaaatttcattaatgaataccaaggatgttgcaaagagaaaaataaaagcgaaaaaagcgaaaccaaaataaaaagcgaaaaggcgaaagcgaaatgcccaaaaaagcgaaaaggcgaaattttttccaaaaattagatgaattataagactcaaaaaattcaccttttaatgcttaactgttctgctgactgttcttttgtttttcataaattctttatgcaattcctctggtgattgtgagacaaatgtgagggtcggggtttttaaatatttttcttatgccatatagtcaaaaagctttctatgtagcattttcttaaaaatatttattaatttcacaataaagtgcgcatccgcatgtttagccgtgcccaacaaatgcttcatccgatccgccaaatttcccgattttgacgaaatcatgtaaaaattgaaaaaaagaaaaatttgttttggaattttgctanaacatagaaattttaaatgagactagttgacaaaacaagagatcggaattttaacatacgcgggcat

SEQ ID NO: 35514 - DNA, 916 bp, Heterodera glycines
tctatgatgggagaacaagcactatacatgcgcgacctttccggcggcgttatacaattgcatgtgtacgctcctaaactggatgatgaatccataacttgattataacatggatccattgctgaggggtgttaatgtatctgcaacatcaggagggacggacgtgcccgagggtatatataccaatgaaattttccattctcttcaaaacaaacgagttgctgaaatccaaattgaaattcagaacgcatttggacgatacgtaaagtttaactggggtacttgcatcatcacgctacatttcaggcgtaaacttttttgatcaacaccgaaaaaaatgacgcacataccttttaatcccgactctgtagattgggcgccttttttggcactacagcaagaggggaagggcgaaatgcaatattttgttggcacccgctatcaacgaggtgccggtcttctgaagaatgtggcccgtttcctgatgccggttgcgtcaaatttgctaaagacggtgtcacgtgaaggacttacggccggcaatcgagtgcttgaagacatttcccagggcaaagcgctccgagagtcaattcaggcacatgcaaaacatggtatggagaacttggctgaaaaactgagacagtgtggaaagggtgccgccaagacaacaacaacactgacaaaaaacaaatcaagcgttaataataagaagaagaaatacccaagttcagtgatgacaaagggaaagagacatgtaattgaccaacttacatttgcaccttgagttgctctgacgaccaaaaaaaaaaatgtataaaagggataccaaaaggcgtgtgacgtgcatacacaggaaaattaaaaacagttttgtttcttaacaaaaaaaatgagtgtaattaaaaaaatagacaaa

SEQ ID NO: 35515 - DNA, 1075 bp, Heterodera glycines
aataatataaaaatattcttataaatttttaagtatgaaaaattcacaagtaattaaatttttcttcaataaaaccaaaaatttgccttgccccctttttgagctttttgggttaaatttttaaattttgttctgcttttggccgacggtgcgggagcatgacaaaatatcggcggccgaaacgtcgctggaggattttttggagcttaacttgaaatatttagagaataataagcacatagaattagtgaacaataccaagaatgcttaatttgttaacaatgaacaaagttatggtcccaaaatggtccggccacctttcggtcggtgacgttttggagtgcaccccgccggtggtacccgtaggtgccgctagtggaaaattggaaattttgacttttgtcgattttttgctctaattttttgaaattttcttttattccaatggggattaagataaggttgaacaaagactggaagcatagcaactaggaaatttcacatcatttatttttcaacatacacttccatcttataatgcctatctttttcccggttcgtcctaaaatttgaaaaattctcaatttcaaaaaagttgtttaggaaaaaaattcaaaagtttttttagtgctataacatttatttttaaataaatattttaaaatttactaggctaatatagaaaccatactttgtcagggtttacgaatgaccccaaggatgtttaatttggtgaccactatgaaattataccgacatttttgctacccactgtgccgtaatttttgtcacggaccagcagcataaaaaagattcgatttcggattttttgaagaaatacggaaaacatctgcgaaaatttggttccagcggtgctgatatgtataaattttgacaaaatttcttaattttttaaaattttctcgcagcctctcatttcgagaaatttcggaaataactgtttttttatgaaaaatatttataaaaaatcaatctactgcacttcatgacgttacattttcatgacatacgccaacaaattcactgctggaaaatactacttcacattacttcc

SEQ ID NO: 35516 - DNA, 877 bp, Heterodera glycines
  misc_feature (756)..(756): n is a, c, g, or t
ttcaatttcaccggtttcctttcgtctcagcttcatcccgtagttcttacaccctgcgctgatgaactccaaaatgtcatggtccggcttttcgtctgtcagctcaccgaggtgtccctttcctgtagggagtgggtcattgtcctcaggatgcacgtagatgatgctgtcctaaaataaaaattcataaaatttaaatattttttaaattgtcaaattaccgtatcaaaatatagaacttcgcatttaggtgtatccgcaactttctttaaaattccatagagatgtagtcgtgctgcagatgttgtaaaaagtgaaatgacgacattggagtatggattttcctcgacaaattcctccttctctttgtagctgatcaaatacgtttcattttcttcatccatttcctcgacgcccgaaacttcgatttttttgttgtcattcaattgtagtagtttgtcacagtcatctgttatcagcgccttcgaaagtagattcctcatggagaagcggccccaaagtgagttgaggcaaagtttggcaatgtaccgcttccccggctcagctttcatcttttgcttgtcgagttttattccaaatagttgtcggcattcctcgatatattcgtctttttccccttcgctgccgcaccacgacgggaagccagtggcatggatcttcaaagccatcatttcgctcacgtacgacttgaagatgttgtcgctccattggtcgtattgtaggacataaaaaagntttctgacggtatagccggctttcaacgctgcattaagttccaaagtgggtgcaggtggaaacgaaggcacggtcattaagggttgaagtgtgggcagctgtagtcatcgtctttgtggcc

SEQ ID NO: 35517 - DNA, 1386 bp, Heterodera glycines
ctgggcttggcgaagaatgtgaaaaaatgtctgaatcacttctacttggcaatgttctgttgacattttgaaaaaaagttcttaattcgctctttgcctgcgactcagtcatgttttcttcgatttcggccaaaaattcgtctccaattccgtcctaaaacaatgtattttttgtgataattcactaacacaattgctttaacctgaaggttttgtaaattttcagcttcaaaagttagccaaagtttgtactggctatgtttttctaggtcgggtcgaaaaaagagagcttaaaccttgggtccagcatagtggaaaggactagctatttatttccatcccatccaactctttatgtttccatttgcatcaattttttcatccatccgtttttgaaggccttccataattgcttgctttttaaatttgtgactgaattattaacaaaaacatactgatttcttaaataccgtatttgctctaattaaggccccggggggattatttttcaacctcctcagaaagggggacataattggagacagggcctttaatggagacggggggattatttttcgacagatttttaatgactagggccgcgacttttagtaatgaaaaatctcggaataggtaggtaggttaataaaatactgaaaaaatagtgacattacgccaaaattttaattattttggcgaggagccttaaagtctgatttttgtggcctcaaaatcgaaaattcaatgctgacatgcttttttgagctcctttatcaaaataaaagcaaaaaagtttttcactaaaatcacggctctattactgattcattttagcaatggaatctttttgctgtgtttgtaaagcaatttatggaggaagccacagctgttctgtctgtaaattgccgtgtcacacattctgtggcgattctggtggagttgagaatgaaggcttcggcggaatggtcttatgccacaactgcgtaaacgaaggaaatgcaccgatagcagaaggctcagaaaatgatgactacgaaccgcaaaacgaagagaatgaaggcacgcaggcaaaagacaagaagcggcacaggaataacgatgcgacgaaaaaactggatgcagtcgagtgggcgcaaaagaactccatacattcagcagcaagaaagttcaaagtggacaggaaacagatcaagaactggatggcacatgaaaacaaactgagaaatcaaatgtacgtgacattttaatattttttgtgaccaaaaattttagcatgacaccgaatggggggaagcgcatgagacttggtggagccggtcgcccagttcaacgcccggacatccacatttcaatggccgaatggatcactggaaaaacgaaaaaata

SEQ ID NO: 35518 - DNA, 727 bp, Heterodera glycines
acagaaaactgtgattattattatcacttatcatccactcccccgagattgggagacatatcaacgcaaaacattaattaactattgataatttattgattggtaaatgattttcgagcgtttcttaatgaatttgaacctgcggttttttcaaaacacaaaaaaattttgatgtaatttcgctcattaattattatattttttttcgacagtgcagaaaatgaaacatttaacgacctcggcggaatggaaaagtgacaacgaaaaaatggacaaaaaagagaagacggagggcaaagcgacaaagaaaggacggctgcagaagaggcggacgacaccttatgacatttgggaggacgaaggtgcaaaaaaagggtggaatttggggattggcattattgacacttggacatttaacccaacgttaaagcatcctgataaatttagttcgttcgtttaggcgaacaaatcactgccaccactaaatgcaaacgcgtgaaatacgtgccgaatttgctcccggctgtggtgccacctcccgagggaatgtcttacaatccgccgattgacagttatttggtgaggaaataactgaataaatgtttaaattaataattatagagaatggccgtgataattgcgaacgaagaaaggcaaattgaaaagaaacggcggcggacagagcgaaggattggcattggcactgacgaagtggcgactttgccgg

SEQ ID NO: 35519 - DNA, 938 bp, Heterodera glycines
tttcgcttatcggcgccggccggcgccaacagcagagccttatttatcttttgcgatgtgattaattaattggttaggcaatcaaaaaggcgcgacagggaaatgaatggggtaaaaaaatggatgaattaatggatgtgtgtacaaggaaggctttgatcattttttaaacaaaaatgaacagcgaatcataaataaatagaaagtaactgctgatcagaggtgattctttgaatattgttgaataaaatgaatggaaacaaaaattggttagaccattttaaattttgattaaaaagccaaatgatttggatgaacgggagaaaaaaaaatttatcaggactcgatgattaatcaattttaaataggattaattaatgaatgagtgagtgcttggaattagagaaactgagttcggtcatttcatcaatcattgtgactaaaacaaggaatgaatacctaaatgacagaagagaaacatattgaaaaatgagtgttgacagatatttttgtcactgataagaacaccttttatgattcataggtgcgcattttgatcaatctttttccttttttttttaccaatttgtgtcgaaatggacacaaatattttgcagatgcagaaaatgaatgacaaacaacacataaataacacatgcacacacttgttgaaaaaacagcagtgattttcaagtgcatttttactaacgcgaagaaaaaaggaggagagagagagagaggaaaggaagggtaacgcattttcaagaaaaattcgactgttgaaaaaacggggaatgatcgaatgggtatatcataaatttaaatgccgttaattgttttttttttcaaaaaatgacccacccgatcgttggtggaaatgtgtgagacgttgatgccctgaatttggcgctcgttgcccggcgattggaacagccaaa

SEQ ID NO: 35520 - DNA, 925 bp, Heterodera glycines
  misc_feature (854)..(854): n is a, c, g, or t
  misc_feature (871)..(871): n is a, c, g, or t
  misc_feature (878)..(878): n is a, c, g, or t
catttattcaaaatagatcaaaaattaggtacccgtataagataaataaatcatcaaaaattttgagagtaaaattttgattagttattttttaaaattgattttgaattttgatgaaaagggcccaaaattggggaaaaaatttgcagctttattttttcgaaaaccataaaataaaaatatttaagaaataagaattcttggcaactcagttaaaaagagaaatttaaaaaaagccgaggaaaaaattccaaatttataaaatttttaaacatgaaaaataagttggccttggtcaaaattatctgggtcacgattagttcatgacaaggtccattcttgtttcggactttaatattaacaattaaaaaataaaattatgcaaaatatttttaatagaaattattaatttttcttttatttatgtaattttttattaataaaaaaatggtgattttttgcagaattcttcgctggtgcaattctaaaacgaaaggacgacaaattgaacaaaagatggtaatatcaaatccattcatttttcttcattcttttcactcttggctcattcattaattttaatttatagcttttactctttgaaattcaaatttcaatttgaaataaaattacatataagcgaatgacttgagtaatttattcattaacagagagaaacagactaactaactcctgactaataaagcaccatcagaggattttttaaaaatattttggtaacaaaaatgcgcacttccacttatttagaggatgatgacaaactattttttttgaacagtgatttaatctttaaagctaaaatggttgaaaagtgaaatttggccataaattanatttttaaaattttaangcaatanattcgatggaaaaaagcgttgattcgcttttgggccaacaaattact

SEQ ID NO: 35521 - DNA, 719 bp, Heterodera glycines
cgcttcgcgcccgttttttaattttgttgaggacattgggccgcttcgcggcctcaggacgggcgcttcgcgcccagcttttaattttgttgagaacaatcggccgcttcgcgcccatttttagaagaggtacaacagtgattggatgagtgattaaagaagtaaaacatgaaaaataaataattaattttaaattataaaatttatttaccaaaaagtaattaaatttaaatttaaaaaataataaaataataaatatttaaagcaggcctcaggacgggcgcttcgcgcggcctcaaagggcgctccgatgatagaagaggtacaacagtgattaaaagaggtacaacagtgattagaagaggtacaacggtgattagaagaggtacaactgtgattagaagaggtacaacaggaaatagaagaggtacaacagtgatcagaagaggtccgtttttcaaattttgttgggcttgggcgggcgcttcgcgaccgttttttaaatttgtttgggccagacgggcgcttcgcgcccgtttttcaaatttaattggggccagacgggcgcttcacgcccgttttttaaatttagttggggccagacgggcgcttcacgcccgtttttcaaatttagttggggccagacgggcgcttcgcgcccgtttgatcgttttttaaatttgtttgggccagaacgggcgcttcgcgcccgtttttta

SEQ ID NO: 35522 - DNA, 958 bp, Heterodera glycines
  misc_feature (181)..(181): n is a, c, g, or t
ttgacaaaactttttttttttttttttaaaaaattttaactaaaaataaaactggaaagtgggaaaaaaattaagttaatttaaaaataaaaatccagtccaaggattttattcccaagaaaaattttttacttgtttccccttccacgctttagttaaccgagagcttaattttttccgngcatgtcaaaccaattaaattaacaaacaaaaactaaaatagtttatcttttctcaaaaattgtccgtaatttgctgttattaaaactatgggtccaaaattaaaaatgagcaactacatactatatttatctatggaaactaaacttctttaaaaaatgggttctttcgatgttgattgcaaaaagttgatcgattactcttgaagggcgatgttcaacttggtaaaaatcacaaataaaactacttagtcactcaatttttaaaaaattattttttttttgtttttttttgacagttcaacccagaaatagtggtccgcaaaagtcggtccgcaaatgtcggtccgcaaaagtcggtccgcaaaagtcggtccgcaaatgtcggtccgcaaatgtcggtccgcaaatgtcggtccgcaaaagtcggtccgcaaatgtcggtccgcaaaagtcggtccgcaaatgtcggtccgcaaatgtcggtccgcaaaagtcggtccgcaaatgtcggtccgcaaaagtcggtccgcaaatgtcggtccgcaaaagtcggtccgcaaatgttggtccgcaaatgtcgcactacgattttatgggattttattcaggggttgcgccgtaaggggggcggctgtataaaaggtgggacggggaagggtcgttggtgaagaggaaaagagggaaatgcctgaaaatcttgactttttctctacaaatttcataaaattttaaagtttttatcggcggcctctgccggcaccgccgtccctcccgcc

SEQ ID NO: 35523 - DNA, 1297 bp, Heterodera glycines
  misc_feature (192)..(192): n is a, c, g, or t
  misc_feature (225)..(226): n is a, c, g, or t
  misc_feature (240)..(240): n is a, c, g, or t
  misc_feature (1181)..(1181): n is a, c, g, or t
acatcaattgcaacgatgatctttgcaagtcacttaaatacgccatttttacgttattcacattttatgcgctgaatcatttcgccgattgactaacgcatcgacggaaaaaaagcctcgggggggaaaggccacaaatagcaaaaaaggcattcatcagcagacgaaacaaatgaaaaacaatccgaaganaagagaaatggcaatcaaacaaaaaaaatagannaatattatttcatntaataaataggattggacaaaatgaaatgaaagtggcctatagaatgtgtgactgttctcggtttgcttttaaagtgccattcttctgtgatcgtcgcttttcctcctcctcctcttcttcttcgttgcttgtccctctcatgagtgaaacctttcggacaatcccatcgcttgtccctccggcgtttcgagcgcattctccaacaatctgcccttcgaaaatgagaactgtttgtacatggtcctgaaaggggattaaattttagtgttttgttcggtacagtaagcccgtgcctttgttggccatgccatttcctacggtaacttgtcattttcactcactcatccgcaatgtccaagccaccggcaccctttgtctgcacataattggcaaatgagctgctgaagaaccaccgtatgtcaaagcgcacgtcaggcggaggagtggcgaattcactgacagaagtcaaattaacggagaaaagtggaaattggggcaccaaaactggccccaggggtaccacaaaaaggcagcaaaattggaattgcataattctgtcacaattaagtggcgaatcggcttcatagggaatccgcccaaaaaacattcaccggcacttactacatataccacatggaaagcaccaacgcgccgtacagcttcagccggagctttgcatatgcgactcgctccttgtggagcatcgatttgtcccaaaatgcgtttgtccgtttatagaaatatttgagcacttgacgaggagcggagaaacgcatttcaaccaagaaatgagacaaattggcaattaaaatgaattagcaaataaaaagtgcgacggaacggaggaaaagcattattaaaaagcaaaatcaaaaacatatttttgaaaatggatgtgatctgatcaataatgaattgtaaacaatgggaaaagtgtgcncaaatgatcggactttttccccctctaatcacatggcattctccgccgacgagtgcctgtccaaatgcgcgaccaatttcggcggcgtcggcgccttcccttccggcgagtccaat

SEQ ID NO: 35524 - DNA, 1282 bp, Heterodera glycines
  misc_feature (28)..(28): n is a, c, g, or t
gtcgtttgtgttgaacggtgttgtaagncgggcagctacataacggccttaaattgcttgttttttagtgaaatatttaaagagtatatgcgataattaattaataccccaagtgccgataaacaccgataccaaacagaaggcgatgagtgcaatcacgagaagggcaatgacaaatagcatggctaaaaaacaaaaaaaatgagttcgaataatattaggaattattaatgattaaagtgagctccgataaaaaaagcgccatgtaaagaattcccccccccccccttccgcattatctcatcttcgatcttgcccggaacataaaaaacattttttcacctttggactttaaaacaatattaaatgtttacaaaaaaatatgatcggatttctcatcttttaagtgtgaaaaatcttgaaaaatttaaaatggaagcaaatttatggagaaatttcacagcatttcatacattttgcagcacaatttctgactgaccgaacgtgtgccaagcgaatggtagaaaaggaccaaagtaacggaggaagctgacaaacggcggaagaaagtgttggatttgcctcggttttccaaatctatgcaaaaaaggagtggaaatgtgacaaaatagaaaggggcgacccaattattcacccaatcgaccactttttgcgattccgtgctgttcggctgaatgtccgtcgacgcatttgtcacatgaacggcctattcccgtaaaagatgtacatgtgaatttgtttgtcatttttgaagcccatttggcctagtgttaatgagctgttgagaacgattgcaaggtcacagacgagcgaaagttaaccaattaaaagttgagttgagaaaaacgtggtaagaacgatgcaaagggagccctaagaagcaaaaaattacattgaaactgatgaatgagctgggtaaagggaataactcacaccgaataaatggttatatcttatggagatacgcacctgaaaactctgtcttccgataaaatttggttgtataaaatcggatggccattttggtaaggaaaaaggtgcaaaatgacgtggaacgagtgcactttgtacatccgtttgcattgtccgcgataataatggcaatttacagcaacaaatttgacctaaacaacttaattttgggttttcggtattaatttggcgaaattttttcttaaaattagtgctgtttctctgttccttttctgcacaattacgacttgattgtcttacggtagagtcaattaattcttgcacaatt

SEQ ID NO: 35525 - DNA, 1056 bp, Heterodera glycines
tcttctctgtgtttgcttttttgtgccatcatttctgctattttgttctcaatctccgccattgttctgttttttgtttcgggcagtgcgccgtacaaataaattccaatcgctgccaatggcggcacaaaaaacagtgcgtaagccttcggagcaatggatttaattaattacttttttattttcaaataaataaattcaatgcttaccggcccatcgccgattttgttacgcactgggagataagcagacaaaacaattgaccgactgaaaagtaaatccattaataatttgagactttgaatttttttttaaatttatttatgggcgggatggctctcacgttggtttttcaataagttttggtgagagccaaaatttcgtggtgtgccgaagtgacaaaaatattatgttcgtaataattaaattaattattattttaattttatttgctaaataataaatcatacttagcttaaacttagtcaaattaattaagcttgtattaaaaggtagctctacatatcatctactattgtatattattaattgacaaaagttgtaaccaaaaacttccgaaaatttagactgaaaaattatgaccctaactttttttaaaactgaattaaattttttgaaatttatctgaataatagaaaaatctttgggctatcttttcatatcaagtgcggtgtgaattaaatgatgtttgaacagttcagaaacaaccaattttaattttctttatataatgagatagcccaaagatttctctgtttttcggtttaatttcaaaaaattttattcagtttcaaaaagttagggtcaaaattgttgagtctaaatttttcgagcttttttagttacaactgtaaatttttgctaaatttttaaaaattataatattgtagaggatacttgaagttgtttctcaatacaaaatttcattaatttgactaagtttaagctaagttatgttttattatttatcaaataaaaataaaataataattaaatttaattattatgaacataatacttttgtcacttcgccca

SEQ ID NO: 35526 - DNA, 989 bp, Heterodera glycines
  misc_feature (808)..(809): n is a, c, g, or t
  misc_feature (815)..(815): n is a, c, g, or t
  misc_feature (828)..(828): n is a, c, g, or t
  misc_feature (839)..(839): n is a, c, g, or t
  misc_feature (844)..(846): n is a, c, g, or t
  misc_feature (851)..(851): n is a, c, g, or t
  misc_feature (853)..(855): n is a, c, g, or t
  misc_feature (857)..(857): n is a, c, g, or t
  misc_feature (859)..(859): n is a, c, g, or t
  misc_feature (872)..(874): n is a, c, g, or t
  misc_feature (877)..(878): n is a, c, g, or t
  misc_feature (882)..(883): n is a, c, g, or t
  misc_feature (887)..(893): n is a, c, g, or t
  misc_feature (895)..(896): n is a, c, g, or t
  misc_feature (898)..(899): n is a, c, g, or t
  misc_feature (902)..(902): n is a, c, g, or t
  misc_feature (905)..(905): n is a, c, g, or t
  misc_feature (942)..(942): n is a, c, g, or t
cagtccccccgaaccgatgcgcccagatttatggggagactgaatccttcgggaatagtttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgacggtacaggactaacttaacctgaaaaaatgacaattgtaattggttttaaatttttttagaaattctgagtttttaactgtttatttattttttgaaaaattaattcataaatattttttcagaaagtgctctgaaacgcaccaaattttatgtactagttaaataaggctctctgatgcttttactatcaaaaagggagatgaataaaatttttaattgctttttaaacatgtcaaaaagtttaggcttaaattaaaaaaattttcttcggctctagctctttcaataagcaataaaatcgtaccaaattttataggcatactccccggtacaggactaacttaacctgaaaaaatgacaattgtaattggttttaaatttttttagaaattctgagtttttcactgtttattattttttgcaaaattaattcataaatattttttcagaaagtgctcttaaacgcatcaaattttatttacaagataaataaggctctctgatgcttttactatcaaaaaaggagatgaataaaatttttaatttgcttttttaaacatgccaaaaagattagggttaaattaaaaaaattttcttcnnttctanctctttcaataancaataaaatcntaccnnnttttntnnncntnctcccccctcccnnnctnncttnncctnnnnnnntnncnnttntcntttttaagaaattttcttacaaattctcactttttanctgtctcagtaagtttgcaaaattaattcataaatattttcagaaag

SEQ ID NO: 35527 - DNA, 1000 bp, Heterodera glycines
ttaacaattcttccaatgtttcttcaatttttgtttcattattttttgtatcaaatttttccttttcaccaaatatttgtcgcaaaaattcgtttcggtcttcgattagtaaaaggtccaaaatgttttctcggctattatttttattttctcgcaaatctgtaaatttacaatgataagcccaaacggacgcgaattttgcagaagatttcttcaaaaaaattaaattttaaaataaagaaaataaattcaattcattcaaataaattgacaaaaaatataaaatatttgtacaaaattttgaaaaattaattaacttaaaaaatgttagttattgagaatattcaattaacgagaaacacctacaaccttaaatgaaatattaaaaatttatcccattattacataaattcatttattcaaacgtgcattatctgagattctaaataggtaaggtaaatttatggaggggtggggtgctttttcttttatccaattttaataaaagaattttaaatttatgaaaacgattagcaaggatttgctccttctattaatagttgactaaaaccttgcatcaatttgccaattatctcatccaattccgtgtcatttccctgttgttttatgcttttcatcgcttcaaaatgcattttctgtatcgtttcgtttggtttcgctattttttcgcccccttcgcttttccattgttttcccccattttctgtgccaattttgaccattttttgccaattttttgaaaatgcttccgcatttaaatttttccctttctttattccctcacacaattcaatcaaacctgaaaaatattttcagtgatccaaaaaaaggtaaatacaaagtaagaattgacataaaagcataacattccccaatcagatcgcatttataatttttgctttttttctaagtaaattcaattttttagtaaagaataaataggagccctcgaattatcgaaattctgatgactctagag

SEQ ID NO: 35528 - DNA, 354 bp, Heterodera glycines
ccaaatcattttatctcaatttgttttatttatgtggaagaacagtgcaaagtcagtcaattgacacatatataacacgtaaaccaaaaatgtcctttcctagataaaataatttttgagattatcctaacaatttattccgtctaaataacatatacacttccgaaaataagacattcccatcgttttgtccaatcagcgaagacagcggcgaatgtatgcaccgaacagaacggtggtcaccccagcaaaagtccaaaagtagcgggtgccgagtttcgggtcatttataaggtatttgctgtaccagatgggcttgtcctcctccttacgtttacgaatgacgtgcctaaa

SEQ ID NO: 35529 - DNA, 848 bp, Heterodera glycines
gacattttggtcgatgaaactgaaaatgatgggaagtgttgtctaaatttttcataatcgaaattactagatgctgatccgtttgaatccgatgattttctttggcaattgaatttgcggaattgacaatgattcacaattagaattgacaatttccattcccttggtgccattttcttcgattttgtatcgaattcgaataaatgccaatgccctttttcgcgtcttgaaatgttcgtccacgtaatagtcaaatcggtggctgatcatcgcaattccaaggccaagttgtgaaggtggcagcaaatcgaacactccgagccaacaatcggcagaaatgaaactgaaaaaaaggaaaacaaaatttaaaattgaaattgaaatttaaaaatggcattttaattttaatttacattgctttttccattttttcctcggcttcttttcggcggtctgacattttgttgttggcaaattattaagacagttttcggcacttaaatgggctttattttcttcaaaattcatataaaaatgaataggtattttcataaaatatcataaaagaattatagtctcattgctatttttcactgtcatttttcgatttaagttttcatttggaaactaaatgttatgcccgaaggaatttaaatttaaaagaattaaaatgaataaagtgaggtcatttaagcgatgcgtcatcatcatcagcagaaacggcgacatttgcggacgaattttttgaatctttttttttaacacacaatgtcttaagcatgtcggaccgcaaatgtagcgacacgagtgagaaagaaataaaaaagtcagacacgaatttttggtac

SEQ ID NO: 35530 - DNA, 842 bp, Heterodera glycines
tttttcaagaaaatttcgttccaacacattatactcaggctaaggaagaagaagaaaaaattttttttctccgttaatttttaaagcttttttgttggttttttgatataaaaaaaataaatagaaaaatgacatttttaggaaaattaagatgtttcataagaattccggtagtgatcgaaactttggtgtctcggttttaattatgaccgaattgcggtttcggattaagagttttttgggtcatagtccagattccggattttttcgttccggaggtttttgggttctattagtccggatatatggggtcatagtccagattatggacattttcacaaagaccgggttacggagagtttttcccacctccggagtcgggccccttctagtcggaatcaagaaatttatgaaaattttgcatatctatgaaaatcgtttatgttcgatttccctctaacatggatttttgtgaacctgcgtttccctttgtttattcaacaaaatttagtacaaagccatgatacataggcccaggccgataggcgccgccgggaaaaattttggaaatttgagtgctatttgttacgaaaattgcctataatatttttaaatgttcgtttggggggggagacttagaaaaaattttccattatttgctttttacataaaacaaatgtttctagaaattttttatttttaaaaaattctaattcctaaaaatctaaagttctttttctatattatctttgaaaaattcaactttttctaattttttacattttttctattttattaccgaaaccaaattgaccatactcaacctttactaacttaaaaaa

SEQ ID NO: 35531 - DNA, 1306 bp, Heterodera glycines
  misc_feature (1139)..(1139): n is a, c, g, or t
atctatgtattaacatgagtgctgctgttcctggtccctctcacttgttcagtcccctcgcattacgtcgtccaccagtccggcacaaaaccgtgccattgttcggctgctcatcggacacagctcccggccattgtctgtgcctaacgaacatggccatacacaccaatggacggtgaatttaaagaacccaaaaatgaattaaatgcttattttttggtcctaaaattgacttttgaccaaccattgcctgttttctaaactgaattcattttttatgtatgtgaaatgaattgcaagaatttcggtgttttttttttctctaatattttttcaaaaatttgacaattttccctataatttagcctcttgtctctgattgttttagatttgaatcaaatcttttagcacaaaaaaaacaagacaattttaaaggtttttgtgcgcgccactggtcccgatcagttcaccgatcgtaactttgtgcgaaaagtcgtctttcatcttcacgaaagttttcagaaccatatgcgagaaattaaaaaggttttttcaattcacaagcataagattcatatggaattcttaaaaattccattttcaagtgataaattgcgattatttcattgcgttttttcccaaatttcagccgcctttcgaagtgtccgagacagggtacggctcctttctgatgcacattttcatccattttgcgggccaatcgaaaagtttcaagattaattacgacctgacactgccccaatacgagccctttgaaaaatgtattgagcacaaaattgagctggccaatccgagcaccgaactgaaggctttgatcagcaggtggtgggcaattggacaattaatggacgagggggggaacaatttgttgggcaaattaaacacttagtattcttagaaatccctaaaaataagggtactcgattatctgatacattcaaaaacaagttacattcaaatctgatttctctaactttttgctttttccaatttatcaaatgctttttggctctactgctctttagacgcctattcgatggccatcttcaatttcttaggccactgctcttttcttaattgtttcttgcctatgtttttggtatcaaaagaacgcttanaatctcagaaatttttaaatataagaatagcaaataatggcattaagaaaattaacacaatgagaaaatatcaaaattcagcttttagaatatattcatgagattgaatttttgtctatttcatactttaagcttccgtttgatccacctcatggggaaaggatgat

SEQ ID NO: 35532 - DNA, 689 bp, Heterodera glycines
ttgtatccacatttttggtcaacattttttcaattctttttttggtttaaaaagttcagaaaacaagtatccgccgggggtttccgaggtcgctgatcaatgatcacgaatatggaatcaaattgattttctacttctttcccttggttcaatcactctgcagaaattcaaatattttgattttctttttgttcatgggttcctacatatcgacaagctatgcttcctcatacttttttttaattgcgcatattttataatttttttaaagaaaatccatacaaattgagcccagtagtccaaaaaaccagcctttttgttgaaattcgtaaacaaatctcactcaaattttcaaaatttttccccggcggcgcctaacggcaccgccggacccctttcttcccaaaaagttttttggaaaaacgtgccgaaaaattatgtgaaaagcaattctggatttctaagattattcgagcatttagtccaaaatgattaattgtttgaaataactgaagtaaattcgtttaaaaatttcattaatttaatttagctttaacttttagattttataaaataaatagcaaaataaaaattaattttgtgttattttcacctgaaataaattaaaatttgaattttttttgaatttaaaaattcccgcaagatcaaggtcccgtcccggtttctca

SEQ ID NO: 35533 - DNA, 1034 bp, Heterodera glycines
  misc_feature (1030)..(1030): n is a, c, g, or t
aattttggctcccggacatttcgacaatgaccgtttcgccaatgaccgtttcgacaataaaattaaatatatttttttaaataaaattcaaatttctgcaaaattatatggacggtgcggatttgggatcaatataaaaaagtttttttttcgtttttttcaaaatagcattatgagaatggctttagtttgtcaattttcggcgcaaattgcttatttttttttaattaaaaattgaaacattgttttacacctaaatagttgataatgaattagaagcttttaccctgaaaaaactattcttgattaaaaaaacaattttttttttgttcgaattcgggtctggagttcggaattgggcaaacccgagttaagatccgttatcagcaccctcaaaaacgcctaaaaactggttttgagcacaaaattaaaaaaaatgaaaattagggacaaccattcttcaggattgccgcctgggtaaaaagaggacactacattaagttaaataaatggtttcattttgaatttatattataggtccgtctcattttgtcttctttcttcactattaatagggctcagatttttaggtgctaaaaatccctaaataggtactaaaataggtgctaaaaaagtgcaaaataggtgctaaaataggtgttaaaaattgaaaaaatctagaaatagtccgactcctataatgcattcattaaatttaaaaaatataactacctaattaaatttttctctttaaatttcatcaatatttttttaaattaatttattattttttatattcattttattatatttaatttgatattttaaattttggcgatatgatatagtcgtaaatggtcattgtcgaaacggcattgtcgaaaaggtattgtcgaaacggtcattgtcgaaatgtccagccaccttaattttaaatgtatccttttaaaatattttttgtttttgctgatcattttcctcatttcgctgcatgtgacttttttttgctgtgcgcttttttcaaaaaaancttt

SEQ ID NO: 35534 - DNA, 720 bp, Heterodera glycines
tccttacggagttggccaattgccttcattacaattttcctttggtatggcatccgaatttctttgtcctttgaccattttctcgccaaaaatcaaaataaaattcgtcacaataaaattaaggtaatgagttggtcctctgcattaaataattggaaatgagaacaaggaaagcccattacagagctaattagacattgggtactattttttaacttaagcattttctcttgggtcctttttcaaatccgtttgttttttccaatgcctttattaattaattacaattatactcccaattaattgctcttgcagaaagctgatgaagaaattcgagttcttgaaaaatttattgccgatgcgcaaaaagctattgccgatgcgcaaaaagctatcgccgattggcaaaaagctattgccgatgcgattgctcgtatcgaatattggaaggagcaccgttctaccatggtctcctttttttacatttttcatttctatccaagtgactaatttattccaaacacagcatacgatgactatgccggtcttgccgcagcaaagcgaaagtacgagtcaacagcccgtcagttcggtactgtaacttcaaaaattgtaaaatttaatgttttttttttgaaaaattttcaaagttgcaaaaaaattttttttttgcttggcggggaaaccatgcggggaactgagcccggggggggggggaat

SEQ ID NO: 35535 - DNA, 1151 bp, Heterodera glycines
  misc_feature (1138)..(1139): n is a, c, g, or t
cccccccccccccccccccccccccttcagacccgacaaatttttcaacaaaaattttgaaaaattgactagagcaatcgacccctaacggacgacctatggaaaaaaatccccgaaggagagaatttaataaatccattcctcgggggaccgtgccgggtgccgcggggtaagcagtgctggttcgtttcatcacggcaccgaaccttttggctagtcagcaatcgttgcttaactgtccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgacgcgaaaacaaaaataaatcgattttttcaagtgtccgnnttgactctagag

SEQ ID NO: 35536 - DNA, 988 bp, Heterodera glycines
  misc_feature (925)..(925): n is a, c, g, or t
gttattttttaaaaagagtcctttaaaatcttccttggcttggtaaaaattccattaaatgggaattgccacatactcagtacaacttacaagaggaatttctctaggccttttgctatgttcttgctttttcctgttattttttaaaaagagtcctttaaaatatcattggcttggtaaaaattccattaaatgggaattgccacaaactcagtacaacttacaagtggaatttctctaggccttttgctattttcttgctttttcctgttattttttaaaaagagtcctttaaaatatcattggcttggtaaaaattccattaaatgggaattgccacaaactcagtacaacttacaagaggaatttctctaggccttttgctattttcttgctttttcctgttattttttaaaaagagtcctttaaaatatcattggcttggtaaaaattccattaaatgggaattgccacaaactcagtacaacttacaagaggaatttctctaggccttttgctatgttcttgctttttcctgttattttttaaaaagagtcctttaaaatatcattggcttggtaaaaattccgttaaatgggaattgccacaaactcagtacaacttacaagtggaatttctttagtccttttgctattttcttgctttttcctgttattttttaaaaagagtcctttaaaatatcattggcttggtaaaaattccataaaatgggaattgccacaaactcagtacaacttacaagaggaatttctctaggcctttggctattttctcgctttttcctgttattttttaaaaagagtcctttaaaatatcattggcttggtaaaaattccataaaatgagaattgccacaaactcagtacaacttacaagaggaatttctctaggcctttggctattntctcgctttttcctgttattttttaaaaagagtcctttaaatatcattggcttggtaaaattc

SEQ ID NO: 35537 - DNA, 1421 bp, Heterodera glycines
  misc_feature (163)..(163): n is a, c, g, or t
  misc_feature (178)..(180): n is a, c, g, or t
tttgaaaaaccatacaatttctaactgctatgctttcatataaccattagggttccgattatttttggcttagacgtatttccgattttcggaaacttttttgactatttttcattgaaccgtgttatcaacccttttctgatcaaatgatcaatcttactanattattcctcccccnnnccactcactttcatcaattcaagcatttcttcaaaaatttgttttctgcccaatttggtagcaagtgtaagcggcgtttggccagcaaagttctcgagactgtgtgccggtttgtgccaatgcttggccgaatagctgtacaatgacttaaacaacctttttttagcaaaaattgtgcaattaaatattttttatttttttgtaatttttaatttacatacaacaatttcgaacatacaacttaaattacaaaaggcttacatttctgttgtgaatcacgcactatgtggagctgaaaagttacgatttcattgaaatatattgtagcgctcactattgtattgccgaaagtgtcctgtttgtccgggtccgcaccatactgtatcagcaggtcataaatgtctttgttttcgaaacaagctgcaaacgccaacggatattctccataataggcatagcctaagtaaaaaaaagtaatttataaatggctattaattaatttaaaaatttttattaccttcataatccatgtttcgattgctgtgaccgggctcatagccatccggcataaagaaatcgccgttggcacgcgcatttacagaagcaccgtattccagcagaattttggcctgtgaaggatgaaaaaaaattatcatttcaaattgttattaccgtgtcataatcatcgttgacaattgccaaatgaagacaaccttggccttaatttttaggttcgacaaaaatgacatttgaaatgacaataaatcggattttaaatttgaaaaaatgaaatcctcaagaaaatttccgtaattatgccaaaatatcaattttgcagattttcccataaaattttatgataattcttggccaggaccaggcggcaattaaattgagagtttataacgcaatttgggaattcttgatttgaacgttacaaaaatcacatttgggcatttctagaaccaaataaacagattgaaattcttaaattgactttaactggttcaaaatttcaccaaacagctcttcgcccaaatagatgtccctggccatgcccgggtaacggttgatcaaaatacgtgccacttcatggcacaccaactccttcctgttcaacaacaggtggatgagcgtttcgccgtccatgccacgcttgttcatccgccattgggcctcgtgctcggagaagcgcgagtcggccggttcagttcgcatctcatccgtgataccaagcgcaa

SEQ ID NO: 35538 - DNA, 1531 bp, Heterodera glycines
  misc_feature (50)..(51): n is a, c, g, or t
  misc_feature (78)..(78): n is a, c, g, or t
  misc_feature (135)..(135): n is a, c, g, or t
  misc_feature (1475)..(1475): n is a, c, g, or t
aaaattttgaaaattttcgaaattttaaattttgaaaaatcgagctcatnnaactctacaataagttcgctggcaccncctcgctcagaccaaaccctgacgtggtattcacctggtactgaagtggaaaaaaanaattaactgagtctccgtgtctgtacaggtccgggatttggtcaaatcaaaaaataaaaaataccagcatatagaggacacttctgcggagtgccctcacagcgggaattttttgatccgagtttcagaaaaaaagttatgggccgtcaaacgcaagaaaaaatgagaaatccgtccctgggactcagtcgtccgcgctgaatttttctctatagttttcccggatgctcctcaaaaagttgtaagacccttccaccactttcagggcgctcccggccttcggccgggagaaaatggttttagcaacgaaactccttgtcaatataacgtatatattaactagcgggtgcgtgaaccgtcgaatctggacctgggaaaaagcgcttcgcgctttgggagcttcgctacctagattagctatgggttgtggagtaattgttggtccagaagagagttacaacaaatgttagaagaagtacaaaattggtagaagaggtacactgggatttttaggctgctttgtggagaatagaagaggtacaacagcgattagaagaggtacaactgtgatcagaagaggtacaaaattgttagaagaggtacaaaagtgattagaagaggtacaactgtgattgaagaggtacaactgtgatcagaagaggtacaaaattgttagaagaggtacaaaagtgattagaagaggtacaactgtgatcagaagaggtacaaaattgttagaagaggtacaacagcgattagaagaggtacaactgtgatcagaagaggtacaaaattgttagaagaggtacaaaagtgattagaagaggtacaactgtgattgaagaggtacaactgtgatcagaagaggtacaaaattgttagaagaggtacaaaagtgattagaagaggtacaactgtgattgattagaagaggtacaaaaattgaatgcaatttattataaattttaaaaaataaattaattattccttttattaattaaaaagaaaattttgaaatgtacaataattgaatatttaaattaatatgaaattaatttttataaattcaattaaaaaaaatatgaaattctttattaaaagataattattattttttacataaattcttttattattaatttacaacaaatctttaaatataaattgatacaacagtgattagtaaattcattaaataaaaatgaaaaattttttaacaaatttaattaaaaaaataatgaaattctatcaattaaaaaaataattaatttaaacttataaaatttattcatcaaaaaaaaattaatttaaatataattttttatttattaactcaacanaaatattttaaataaaggaaaatcattgaaaataacgtaaaaatgcacagaaaaat

SEQ ID NO: 35539 - DNA, 742 bp, Heterodera glycines
cccggttttgcccagttttgaccgggaccgggaaattcccggtttttcaaccaaaaaagtcccgatcccggttttgcccaaaatttccggtcccgaccaaccctacttagaatcacatttttgtatatttaaatataaacaatttttaggggtacatattcaaaaaattttatttttttcacaagaaatttttataaattttcaaaatttctcaaaaaaatttagaaaaaaatgctaaaaagtccaaaatatgtaaaaagcccgaaatatgtaaatagaaatatgtaaaaatatgtaattaaaagtcccaactaaaaaaccaaaaaataaaaaagtaacttttgttcgcaaacacaaaaaagaaagtgtttttcctactatttagagcatggagaatccaggaaatatgtatttacataaaattagcagccctaataatgaggacttgaacctggtacaactgtataaaatggctttccgtttcttggggcgcaatacttttgaccttgactattatatgtattaaaaatgatttttttagaatttagcctaataaaaaaccggtcgctttatttatgcctagtcataatctgaactcacgcgagggacagagcgcagcttttgtggggaaatcgaccacagccgaagaacgcgaaacccttcgcaaatcgctggaggaaagcattcgcaaattggtgcgatctccgagcgaaaaggcagcgaagagaatattgtctttgag

SEQ ID NO: 35540 - DNA, 1078 bp, Heterodera glycines
tttgtccaccaataaatttgtaaaaatgcgaagactgacgcgcgcaacctgtgcaatcttttgctcattattttgtttttccacctcccactccaaaagaaattttttgattgtctgaaaacaaagactttcactacttttttaagggtttagatttattgttaatattgttgtaaatattccctttttgggaattaataaaaataaataaataattcaaaatgtccgctagcaacagtcgaaaagcattcgtgcccttttcaaatgcactccgacgacgaaagctgctctttggctttggggttggcactgtcatcggcgccggcttttactacatggacaaaaacaacgaaaggcgcttcaaacgggacaaagtcagtccatttgaagattttatgtcgagtgtgaagtccatcaaaatcgagacggaagtttgcaattcatttcaatttgaggacgtttatttcgtgtccaatgcgcatgcggccaccgttgacaccaaagcggcgctgaacaaacgcccgtccggctcacttccgacccgcgcggagctgttgaaaggaatgcgtgacgaggaattcgacatccttgtgattggtggcggagcgacgggcgcgggggtggcattggacgcgcaaacgcgaggtcatccattttttgtccacttgtgccgtggcactttcagtgcacttggcaatttaaggtctgaaaaccgcgctggtcgagttggacgacttctcttcgggcacaagtgtaatttgtcttccccgtcttgtctttccctccgttttgatgccttttcccgcttcagtcgcgctccaccaaactcatccacggcggagtgcgctatttacaggcggccattatgaagtttgaccgtgagcagtacaaaatggtcaaagaggcgctgttcgaaagggccaatttggtgggcaaaaaaattcgatttggttgaaaattgacaatttttacatttaaaaatgtttcagttggaaattgcgccccatctgagctatccgctgccgattatgctccctatttacaagtgacacacacgtttttgttttatttatttttt

SEQ ID NO: 35541 - DNA, 224 bp, Heterodera glycines
atgtgttaaaaatataatttaaactgcaaaagtaccaaatttacaaatgaatttcattttcagaaaatttccacgccaacgattttatttattttttcgaccgaaagtaaattgctaaaaaataaaaataaaatgtgtgaattaataatactttaattctttagagtgtatcgtccaaagcctatatcaattaattacaattatactccctattaattgatctt

SEQ ID NO: 35542 - DNA, 1432 bp, Heterodera glycines
  misc_feature (39)..(39): n is a, c, g, or t
ttttgccattttccccattatttgtttgttttccacttnttcctttgcaattccaattcctttaatatatttaattaattattaataatttgtttacgaacgcaatccttaacagaattcgccatttaatattaattaattttcgttcctttcattcctgaggaaatgcacttttccttttcaaacaattttccgttattcaaaaggtttttccatttttatgtaattatattttgatagttttttataatattatttttccaaaataaatgtaaaaatattttttattatttatgttttatttttcccattttattttctattgttttttatttttccccttttttattttgggttttatcttaggatttcgcgttgtcgcgacactgacagaagcaacagcacgctgacggtaaaaccatatgtttagcacagagtaatcagcagtgtttgtagaaaacaaaatagtcattagaagagccgaaagtgtttattattaaattaagcccatcattaaatggtcaaaaggcccattcaaataaaataaatcaaattctcaacaagtaaacaatgacaaataaaaaatccatgttaaatttgaattaacaagcctagaatgaaaaatgctttaagtaaatatataaaacaaagccccgtcccttttatggacagaaaatgtcctcggggcattacgcagtgattaataaaataatgcgcaatttttgtcgcttttccctcggggcataacgccgtcggcaaacggagcaaagagagcacaacaaattggattaatccaatgctttcattggctttcgatgtgtgcggattgagcaaaaatgacgacggatggtcaaagagagagagagcccaaaaaaacattcatcattttccttataaaattgaaatttatgacggatttaaagaatatttttcaaaattttaaattgcattttacttttaaatgtttattttaaattattttaaaataaaaatgatgcagaaagaatgaaaatattaatcaaatcgctcagagccaaaatattaaaaaatttcaatctgattagagatatttgagattaaagtgtctgtgtctgatttgttttcggtccgcctaaaacagtcatttattgttgttattgttggccccttagaaaagcaattaagtgcttaattagtcaatttccctaattgcctttttaaattttccttcttctgtcctccaacggatgcttttgtctgtcccccccaaattcgtagccaaatgttttgtgcttcaaaaatggggctcaaatgaccaaagggagcagcgactgactctcaacatttgtgagaagaattcaaaagaattgggcaattagcattttggaaggaatttatacgatcaaatgtgggtcggaaaggccaaacaaacgaaaaaatattcaaaaaatga

SEQ ID NO: 35543 - DNA, 438 bp, Heterodera glycines
atccgcaaatctgttttgggcgggatctacctggtaatcattgcattttttgaatctctgaaacacatatggagcgatggaaatcttgtatttctttttctttcattttggcatactattttcatgtctttaacacacgaaaaataacaaattcgcaaattttaatattttggttgtaagggaacaaaatcactttggacatttagaatcaatagaaaaataattagtctagcattttggctgagatcagctgcttagaacttgagttacaacgtaatgaaaatttgaaacactcacaaaaatcatgaaattcgcaaattctattaatttttgttgatacggtacaaaatctgttggacatttagaatcaatagaaaaatgattactttccgcattttggttgaaatcagcagtttaagacttgagttacaacgtaat

SEQ ID NO: 35544 - DNA, 923 bp, Heterodera glycines
aaagtgggaagagaaagtggaagaggaacagaaagtggaccatgagaagaaagcggaagagaaagtggaagagaaacagaaactggaagagaaagtggaagagaaagtggaagagaagaagaggaacagaaagtggaagagaaagtggaagaggaacagaaagtggaagagaaagtggaagagaaagtggaagaggaacagaaagtggaagaggaacagaaagcgaaagagaaagtggaagagaagaagaggaacagaaagtggaagaggaacagaaagtggaagagaagaagaggaacagaaagtggaagagaaagtggaagaggaacagaaagcggaagaaaaagtggaagaggaacagaaagtggaagagaaagtggaagaggaacagaaagcggaagagaaagtggaagaggaacagaaagcggaagagaaagtgtaagaagaacagaaagcggaagagaaagtggaagaggaacagaaaatggaagagaaagtggaataggaacagaaagtggaagaggaacagaaagcggaagagaaagtggaagaggaagagaaagtggaagagaaagtggaagaggaacagaaagtggaagagaaagtggaagaggaacagaaagtggaagaggaacagaaagcggaagagaaagtggaagagaagaagaggaacagaaagcggaagagaaagtggaagaagaacagaaagcggaagagaagaagaggaacagaaagtggaagagaaagtggaagaggaacagaaagcggaagagaaagtggaagaggaacagaaagcggaagagaaagtgtaagaagaacagaaagcggaagagaaagtggaagagtaacagaaagtggaaagagaagtggaagaggaacagaaagtggaagagaaagtggaagaggaacagaaagtggaagag

SEQ ID NO: 35545 - DNA, 616 bp, Heterodera glycines
cccatgccccagttaccttgaggtacaattgcactttttaaaaaggcaggggtccgggacccctgcccccgtggcctaaaaaaactcttttttttacattaaccaagcaaaaaccaaagacccttgccccggtgaattatagttcgtcaaaattgattctccgccgcgatgattgatccaaggattcccctcttccccgggcgagttgttatttgaagtgaggctaattacagttgaaaaagagagatggatgagtaataaggaattataaaaagaaaatattttaacattaaaacaaaatttcatcaaaactaatttaatgtttatagtaaaaaagaattaaaaaacagttattatattaaaatcagacgggggaaaatgagtgtcgggatgaagggaataaatgttacacccagagggtgaatgggaaagaatggaaaacaaaagaaaacggaaaacgtaaaatgtcaaatacaataataatttaaagaaaaaacttattaaatacgtttttttttgttttagagggtttaacgcgacccttttttaaaaaggagtttgtttgaagtgatggagaagtggtaattactctcttttattgacggccgggaaggga

SEQ ID NO: 35546 - DNA, 883 bp, Heterodera glycines
atggggcaaaaaggcactcaagatattttttacaattttaaattctcagttttatttgggcactaccgtcgctgcctcaatgtacatcatcggtgctgtggaaatatttctcatctacattatgccacaggcgaaattgttcgaggacatggtgagcaaatcaaaaatgtgcaaaaaattaaataaaaattcgagactctctcgagagcaaatgtaatctgatcaatttgatcagagtgatttccgatcagcaaaagggggtggcactcttttggcattttccccacttgtccaactttcccatctcatctgatcaattgatcagaataagagttatttccgatcagcaaataggggtgggactcttttggcttttcccccttttttgcccaacttccccccccccccacttcccatttcagtaccacaattttcgtctgttcggctcacttttgctcattttggtcggtcttattgtgctggcgggcgtcaaaattgtgaacaaatttgcgctcccggccgtgctgattgtgatcgcgtgcattgtgttcacttttgtcggcattttcctcaaatttgacgggtccgactcgctacagtaagtgcggcccctgtcccgccataaaagcacaaaacatttctcattactagagaccggacaactgaggcacgatgagggaccccgagtcggggtcccaactttaatcccgcgatcccgagaaaatcccgcaggatcccgaacttaatcccgcggaatttgaacggggccattgaataaacattatttaaccagtaaagtgtcatatgattggtccccaataatccttggcaatgtgttcaatggcacaaaatttaaaaatgccgattacccaatggtattttt

SEQ ID NO: 35547 - DNA, 944 bp, Heterodera glycines
ggtgtacggacatttggcctactcgacatctcgcctactgacatttcgcctactaacccaaaaacattcattttgcctactaattagtaggcgaaatgaatgtttttggcttggtaggcgaaatgaaaagtaggcgaaatgtcatgtagcctattgtgacatttaattaacgtattataaacttgttttttcgaataaattatgcacttagaataattgtgattttgttatgagagcgattgactaatccgcgttttcaaattgaagttgctaaattaatgtcgcaattttttgattttcattataggatggtttcaaactttgagttatgttaattcttctaaattgggttccaccgtaaatatatttaatgaatctgttaaaattgttaaccaaactctcaaattgttgttctgtcgaacacgttttgatttgctcttttaatgttgccaccttattccgtcagctgctgtgctgcgcgaaaaagcagctactcgtcttttctactaaaaaaaggcacaagtagcctccatacttgatcggctgacgccaaacgattgggaaccgcccacttcggcgccggccttttcggcgccgttgctaacaacttttttcctgatcaaccaaattaaaaatttttgttatcattcgatagctcttcagattctctattagcctgtaaaatttcaaaaaatttcgtcagtttacaaaaaagttatggccaaaaaacctcaaaaattaactttttcttggctttttcggcgccgcgtagcataacttttttatttttgaatcattcatttctatttttacatgtaaatatagagcacacatagagctttcaaattatgccagattggctaaagctaactgacaaataaaaaagttatagcatttcaaaatttgcggcgccgaaatggtccgcgccgaagtgaccccgaccc

SEQ ID NO: 35548 - DNA, 553 bp, Heterodera glycines
acggatcaaaaagaaagttttttcaagagcgtaatttattttcaaaatctcagtgtccattgtgttcatcggtgctcgagaattgtccaattcgtcaaaaattctgtgtaattaataattatttattttttaatttttaaaataaataaaacttatttttgctataaaaaaatttttaaggaaatttaattcgtcgctgcattaatattgttgttagtcacgcagagtgcgcgagataagttaatacaagttgaacacaaattttcggcattggagaacatcgaactgaaatggtaaacattcttgtttggacccttttgctgctgccgccgatcgtcttttctgtggtcgatttgcgctgaatattgcacgacgaggcgatctgatataattatcagtgttaatgcaagagtcaaaggcatacaacgtatctacagatgcaatacatttgaatcccttaccaaagcatcgtttgtctttcactgccacagatccggcaatgttttcgtccccgtgcaaaccgaattgactatgcggaattggacagaggacc

SEQ ID NO: 35549 - DNA, 978 bp, Heterodera glycines
aattagtgcattatttaatggcaaaactcgccaacaacttctattcaaatttttttaatttttaaaattattttctaatcattaatatttaattcctaattatgttttatcaaacggtgtgccttcttttgctgttgagcgcatcgaatgatgttgcggtttttggacaggaagaaacaaccacaacatcgactagtagtacaagtacgagcacaactagttcaaccagtacatcgaccacaccaactacaacatcttcaaccagtacatcaactacaccgagcacaacaacttcttcaaccagcacatctacatcaactacgccaactacaacttcgtcgactagtacatcaactaccccgacaacaacttcttcaaccagtacatcgacgactcccactacaacatcttcaaccagtacatcaactacaccgagcacaacaacttcttcaaccagcacatctacatcaactacgccaactacaacttcgtcgactagtacatcaactaccccgacaacaacttcttcaaccagtacatcgaccactcccactacaacttcttcaaccagtacttcaaccacacccactacaacttcttcaactagtacatcgaccacgcccactactacttcttcaaccagtacatcgaccactcccactactacttcatcaaccagtacatcgaccactcccactactacttcttcaaccagtacatcaaccacacccactacaacttcgtcgactagtacttcaactacatcgagtacgacttcgtcaaccagtacatcgtctacatccagtacaacttcatctaccagtacatcaactactccgagtacaacttcttcagcaagtacatcaaccagcagttcatcatcaaccacgaccaaaacatcgtctggcgatagtggttctggagcggtcaccagctgtaccaacgcggctggggacagagcttgcaatgcttacaaaa

SEQ ID NO: 35550 - DNA, 858 bp, Heterodera glycines
ctcgccagcgtggacgggggcgggggtttgatttttaatagatccaaaaaatctcacaaaaaaattaatttttatgaatgatgtttttggctccacatttcttgagtcgatgtatcgcctcgattcaattccttttggcctaaattggccaccgggcgaattttgaaatttaatctctcttttctaacagatattcatcaaaaaatctaagattattcacaaaaaaactctgtttggcaatcggtattttgaaaaaactcagtgctgaggcgatccacaaaaaaactcagtgtgggcgatccacaaaaaaactcagtgtgggcgttccacaaaaaactcagtgtgggcgatccacaaaaaagctcagtgattgattggtcattttccggaagcctatcgcaccactttcgggcaccaaaagtgcctgatccggaacccggaccggcccggttaagaacaattttttgttcagttttttaagggctatctcccaggccgggtccggttcttaatccattcacttggagcccgtcatgggtcgggcacatctgccggaggaccctcagcctcgcccccgaccctgtcgatggccaacccaagctaagcttgccggtaccagcggcttttttgtacatctcgatgagctctacaaaatggtatcaatggcgtcaggctatgtctactacaaatggagaaaattggcgagaagtgatgtcaaaaattgaaaaattttaaaaatttgaaaatgacttgcgtcccgccgtacattagtattaaccggacggccaccgtgttttgtgaattgaataattaaattatttatttaattttatcgatcactgaggtttttgttggacg

SEQ ID NO: 35551 - DNA, 1021 bp, Heterodera glycines
ttttggcctgagcgggacatttgagtcccgggccccataactcgtcaggggtcggttttagacaaaaaatgccctagagcaaaattgtagagttttttaagctctatcgaatggtgtgccatatggccggaaattttcaaaaattttcgagctaggccccctagaaattttcgaaaattttttttgggttgaaaatgggggtcaaaaatatttttctggggtattttgatgtgctgagcacgaatatgatatttgtttttcgtttcataatttttagaattttttaaaaattcgaaatttttttcaatttttttgaccctcgggattttggggtaaattttgaaaattcataactcaatggaggaccggtcaatttaagtgaattaaagctttaaaaatagagaaaaatcaggagaattttatgggatttatttatgttttctaacatcaatatgaaaaaagttattccagaaattctggaaattttagatttttcagaaaaaaattcagaactcccttctgaaaagtcattctgtaaaagtaaaatactacaaaaatccgcaatttttttctctataatataaattttattttacatttttatctcttttttgcgaattgttataaaaataaaagtgatttttggtttcgggaccataggggggtgaccaggatttttgggtggaaaaattttttcaccgaaaatattccaaaaacatgtctttaggggtattttatgacgctgatcacgaatacgtgatcagattttacttttgacatcgttcagacctcagaatccctgtgtgattggggattctgaggcatcattttgaggggggggaagttcgaatccgggcggtgtacattatttttgctatgcatttttggttatttttaatgtttttaattcatttaaaagagtgtttgtttttttacttaagtttttaatttaaattaaattattttttgtgaaaaatttaaaggaattaattatttgtttgattaaagaatttcatatagg

SEQ ID NO: 35552 - DNA, 933 bp, Heterodera glycines
tctgtttcttcaaaatttaagaaatttgtgcaaaccctttaattttttttaaatctttttttttttgctcgaatttactattcttcaacattttgtatgccgatttccttttttttacagatacaaatggctgaaggacaatgcgacgttgccgttggaggtgtacgcgtcgcgcattctgaccaatccggacaacggttcgctgacatttgtccactttgaggacattgacgagggcgactaccaatgcttggcattcaacggaaatggcacggcatattcggagaaaatgcgcctgcaacaagcatgtgagttgtgggggactggtgaaatttcgccgccgaattttttttcaaataagaaattttcaattaaaaaaaatctagaaaaattttattgtaagagttgcctgtgtacgacgagttgccattaacccaaaaaaggcactgaaaaattttcaaattttttttcttggaattttcttataaaaaaaaattctaacaataaactatgaccaaaaaactaattcccgaacatacttatcgaaattttttggaattttataggctaatagagaacacatagagctattggatttataatacacagattggtttaatttggacaattatgaaagaagttatactcaaaaaccgggctatcgatttttttttttgaattttctcataaaaaatttttgtattttttttttcgaaaaatgtctaagcttgaaaagttaaaaaaaatttcggcgaaaacgagctgctccgccatttggaggtctctgtagttgttactgttttttcattgcaaactttcatcattttcaagggatccgcgccttcccggtgggcaaagggcctgaaattgttaccataccaatgggtcgaccgtacacgccgcgactgtgtgccgccccgagtcgagcccatc

SEQ ID NO: 35553 - DNA, 1012 bp, Heterodera glycines
tttttaaaatagaaaagaaaaactacctaaaaatgaaaggaataaatgaatcactaatgagtaatgccccggttaagttcatataacgccgaattgcatcaaacttttattcccccttttgtacttacgtatgtacatatttggtcaattttccaccattaacaattggcacaaatttgccccaatttataaaaacatttccgcgtgccatttgatgaggtaatcagtgacaactacggacggctgagactgcggcacgacaaatggccgtcagtcggcaaatgcgacacaagcgcaaaaatgacggcgaaacagtggtgacgggggaagccaataaaaattaatcagttttaattattatttaaaaaattgtttaaaaagccgagaaaaatgtatttgatcaagaaaacgatgtgccagttggatgcgtaattagggaaaactaaattggccacttttactaactttcgtcatgtaaaacaatttaatcatggtacggcctattgacttttataaaaaacaataagcgagttttagggtcgtgtaatttgtttctaaagtggttttttaatttctaaataagaaaagtttaaaatagttaaaaaaactataaatttattaaatatattacaatccaccaaaagttaccattttccaactgagaatgggatcaattcattcactcgctttagctttccattctcgtccaggaatcgttctcgacaaaattgctgtcgggttctcgaatacctgaattgattataaagaatcatttttaattatttggcacttttttatccatttgaaccgcagaaatttattggcacaccatcgtccccgccttgagcaggtgcccgtcaatggtcacaagccggcgcattactgttccaatttaaaaacatttactcaaatgcgtaattatgtcaaacaaagacgtccgtggtttgccgattacgtattacatcaaatcatccaatgttttatacacattacttacacaaatcactgcgtt

SEQ ID NO: 35554 - DNA, 711 bp, Heterodera glycines
ttaacaaaaatgcaataaaacgaaaagtgtacccctaggaatcgactcaaaaaatttcagaaaaatataccccactaagaaatgaaaaattttctaaaaaatcatctccaaaatttatttatttattttcttgaaaagaatttttaattgctttttgaataaaatttacgattttacaccccctaaatttgaaactgtttggcacctattttcccatcatttttagcacctaaaaatgggagccctagtactgatttccgccttctcttcgggaaccgtttgtacttgaaaagaagatcagatcctctaaaaacagatttccttgggcgaaggatcttggcttatgaacgacttgagcttgctgatacccgtgttgatgtaatacggatcgtcttctttcttgtagcgccacattctgaatttttgtccaaggttaaggtgttcggcccactgacagaagtgcagtttggccttgattttgttgtccatgttgtacagtaccttttgaggatatggtgattagagatcggtattttggaaaaacctggacctggatttagtggacaaaaatccaggaaaatccaggtccatgaaaaatccaggctcctcgagacttggatccaggcctggacctggattttttaaaatttgttttaaaatcaatgtttgaaaaaatcaatcaattgcttaggaacgtctaaaaatatctaa

SEQ ID NO: 35555 - DNA, 1235 bp, Heterodera glycines
  misc_feature (53)..(53): n is a, c, g, or t
  misc_feature (62)..(62): n is a, c, g, or t
  misc_feature (69)..(69): n is a, c, g, or t
  misc_feature (93)..(93): n is a, c, g, or t
  misc_feature (110)..(110): n is a, c, g, or t
  misc_feature (117)..(117): n is a, c, g, or t
  misc_feature (119)..(119): n is a, c, g, or t
  misc_feature (121)..(125): n is a, c, g, or t
  misc_feature (136)..(136): n is a, c, g, or t
  misc_feature (138)..(138): n is a, c, g, or t
  misc_feature (149)..(149): n is a, c, g, or t
  misc_feature (160)..(161): n is a, c, g, or t
  misc_feature (163)..(163): n is a, c, g, or t
  misc_feature (184)..(184): n is a, c, g, or t
  misc_feature (195)..(195): n is a, c, g, or t
  misc_feature (197)..(197): n is a, c, g, or t
  misc_feature (215)..(215): n is a, c, g, or t
ctacgatgacttttataatgcctaactttgcctatttcctttaagggttgtgnctaatgtgnctatttnaagattttcgacttaatatttaanaaaaatggaataaaaangaaaaananannnnntaagaaatgananaaaaaattttnagaaaatatannantaagaattgaagatttttttngaaaattgatnanaaagttaatatttttttntttataaaaataataaattaaaaaaaacttcttatttgttgcttttgaataaaatttgaccatttacacactaaaattgaaatttttggcacttttttcacatttctagcaaacctattttggggattttttagaacctaaaaatataagccctaataataacagatattttgtcaagtctcgtcatttaattttctttagcgttttaatttattcttaagcattccttcaggttaattaaggcgctgccgagtaaattttaaattaatattaatttcaaaatggaaaaagtcagctaaaattaaccaaaaaaagcaaacaagataagctaagaagattttcttttcttcaggtccaccatgcaaggaaaaatattccgaactgtctccgcttaatcattttgaaacctgtttttattgtgtatagatggtcgatctattattgtacagttttaatgcatattttgtaaaatttgcaaaatttaaaaatggcaatttgcgtggggcctaattgaaattaagctcacctaataacgcgccaaatcgccttgcagaatggctccatgaatgtatttttcttctctaaataaaaaagcattgaagattctgtataaaaataaaaagatgaaaatttttttttcaggatgaaacagaatgccaaaataatcagaaatgaaaatatacataaacctaaagaaaaactgaaaaatccgttaaaattatacagcaaattatgatttctacaaacgatgacactgattcaagttggatagccattgacaacggtatgtacctgagtattttccttctgaaattgttttctctgcaccttcacattggccttgcgttctataagccttacaaaatttttgccaatctttgcttgtaactaaaatttaaaattgaaaagaacaaaaaaaattgaatgttaaaaatatatttaaaaagtaaaaaaatcgagttgggtaatatttttgaggggggtttaatatccatttctagatcttcaattttttacagt

SEQ ID NO: 35556 - DNA, 1200 bp, Heterodera glycines
attcagtcccaaaaagtgccaccatttccactgcaccagcgcaggggttcatcaaaaaatgaatattgcttattttttcccttaattacaaatttctccgcacagttccgccgccgcttccacctcatcgctcatcactcttatgacaaccaatttgtcatcattacctttgccattgccattatcccccgaggtgtcgtttgtggtgcgcagcagcagcagcggcacaatcagtgggcacaacggcaaaacaaacgatggcacggcaaaagcagaacaaaagcagaagcatcagatggaaggtagaagcagaaacacaacaagagaagaagggcgaaaatcaacagaaaaggcaatggaaaaaacggagaaagggaaaacgaagacgacgaccaaattgataataacaattagtgcaaatgacaacggcactttggaaaatggggacaaaggaaatggcacattgataaacggtgctaaagacaacggcactttgataaatggtgccagcaacgcaactttggaaaatgggaccaaaggcaatgacacttctggaaattgtgccaatggcaacgacactttgataaactgtgccagcaacgcaactttggaaaatgggaccaaaggcaatggcacttctggaaattgtgccaaaggcaacggcactttgataaacggtgccaaaggcaacggcactttgataaacggtgctaaagacaacggcattttgataaacgatgccagcaacgcaactttggaaaatgggaccaaacgcaatggcagttctgtaaattgtgtcaatggcaacggcacttttgggaattgtgccaatctcagcgctaacacggaaagaggaatttgtgcgggcagttatattttggcgaatactactaaggagaatgatattttgaggaatggtaccaaggacaaggacaatggcacttatacggacaatgcaatttttatgaatggaaccattgccaacggcactttggaaaattattctgccaaaggcaatgacacccttataaatggaggcacaacaacaacagttttacccagcaaaataatgggaaaaagtgccgtttcgactccgacaaatggcacaacaaaaacaacaccaaatgaagcaattagcaaaggcaacaacagcaggtactaaagaagagacaaccaactcaatttcaaatttgtcgcaat

SEQ ID NO: 35557 - DNA, 879 bp, Heterodera glycines
tttgtacagactttgctttgctgctttctgtcaattgcttcctttgatcccgtttgtactggccttgcttcgcttctttcaatcaatctcgcatttggtcccacttgaacggactttattttatttttttctatcaattggtgatttgtctccatttgtacagactttgctttgcctctatttgacatttcggtatttagttccacctgtagcggctttgcttcatttctttctgacaattcgggatgtatatcagttagggcaacttgtttacttgaattggcgcttgaattagtgaccttaaaatatgtgaattaatgtcgcaccacataaagtccattttttaaatcgtttcttccaccattttataggttcatttataaaagggtttctcaccgattctttctccaattgcgtcctttttggattaactggcaattgcttttctcggcttatcaacggctcgccaattattgacaacttgtttaattcttgtgttattggtacatctttatttgacatatttttttcttgatcagcttttgttagcgatgcttttttgtccgaaatttccttatccttaggctctaaggcttctttcacattttcatattcttcatttatttccggtaagggaatgttcaaatcgaactgtaaagggtttttctcctttatattatctggtcgaacattggtgttttccatattttctttagtactaaaaataagtattgaaatttatttaaggaaaagaaaaatgggaaaccataaaatgaaaatataaatagatccaaagttaaaatgatatttaaaggttaaaattggtgttagtcggaaccgggaattttggaaaaacgaggtctaaccggagctaaattt

SEQ ID NO: 35558 - DNA, 1056 bp, Heterodera glycines
  misc_feature (110)..(110): n is a, c, g, or t
tcgcatgtgtctaagcctagaaaaatgtctaagtaaaatcgtattacgctaaaaagcttctcaaacaattttagcgttccaattccttctacaatcgcctttatacatcncattatgagcgctaaaattatcagagtgccgaaaatcgcatgtgatctaagcctagaaaaaaatgtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtcaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtctaagtaaaaatcgtaattacgctcaaaaagcttctcaacaatttttagcgcttccaatttccttcctacaatccgcctttattacatccccattatgaagcgctaaaaattatca

SEQ ID NO: 35559 - DNA, 1665 bp, Heterodera glycines
atttgttccaaagccaaaggccaacggcggtcaaatcaagaccttgaatgttcaaatgtaacgtcattcaggaatcaagggaatttttggcgatcctgttttcattcaactcaaccattcacaatggaaagtgggagttagagcttgccagcggtgctgatgttacagtgatggacgagatcgactggaaaaacattggaaaccaaaaattggaaccatcccgaggattggttgcctatggcggaaaatccatttgtggcattttgggaaaggcaaaggtgaaagtgacgcacgaaggcagaacaattgagtccaatattcatgtcataagtggtaagcacaaaaatttgtgcggtcgcgatttgatcatgggactgaaaattgatttgaaccgagctttcggaatttcgacaattcgtgccgtggagatcaaacaggaattggacgcatgtttgggtcaatatccggaagtgttccaggacggtgtcggacgatgcaaaaagatggcgtcactgaagtttaaagagggatgccaaccgaagcgatgcaagccgagacctgtgccattttcacttcgcaatgaagttgaaaaggttttggaccaatggcagtcggagaaaatcatcgagccagtggcaaccagtgaatgggccactccgctggtcattgtgccaaaggcaaatggcaagcttcgactgtgctttgactacaaagtcactgtaaatccatgcttggatgtgcatcaataccctcttccacgccccgaggagctgtttagcatcttgaatggaggcgaaaaattcacgaaaatcgatttgaaggacgcatatttacaacttttgcttgacgaaaaggccaaaagttgtctcacaatttgcacgcacaaaggacttttccacttcgctcgattgccattcggagttgcttcggcacccgcaatttttcagcaagtaatggaagaagttctgcagggcattgatggcgtggcggtttatctggatgatattctgatcacagcagccactgatcagcaacacatcaaaagaatcgatcaggttcttaaacggttgtctgagaatggtcttcaagtaaagcatgaaaaatgtgagttcctcaaaccggaaatcgaatatttgggacacattgtggacaaaaaaggtttacatgcgtcacctggcaaaattgaggcaattttgaaaatgccggagccgaaaaatctgaaagaattgcagtcatttctgggaatggtgaactactatggaaaatttgtggcatccctggcaacgctttcagaaccgctcaatgaattgaggcgaaatgatgccaaatggacatggacaaagagccaacaaaaggcattcgatgtgatcaaaaaggttttgacatcaaccaaagttttggtccattatgacccgaaaaaaccactttttctggccgcggacgcatccgactatggagttggggcggtcatttttcataaagatgaaaaaggaagagttggtgtgattgcgtatgccttccgaacgctaaattcttcggagcgcaattactcgcagattgaaaaagaagcgagggcaatcattttcggagtcgacaaattcaagcagtacttgtacggtcgaaagttcgtacttcaaaccgaccacgagccactaaaaaagattt

SEQ ID NO: 35560 - DNA, 925 bp, Heterodera glycines
ttttcattttaattttttataaaatttttcttggaacttttgtgctaattacattattttatttatttgcccttgcaaaaatccctaagaaaatatatatttttaaattttttacaaaaattaagatttaaaattttcagggtaattttaatttatttttttcggaagaaataatctaaaaatctttacgatggcttttcaattcgattttttttaattaagatttaactgcgttttttattttatggaaacaattattttttatttgtctaaagatagaatttcaaatacctattttttgtgcaaatatttacaaatgttttaaccccccccccctatttgtactcccctcaaaaactcatagaattcctgtaatagcgttggttggatttccctttttcccattgattgaaattttgaattgattaaaattaaatgagtcattcatcccgtcgttcaccgccccttccccccaatttctaaaacccacaaatgcaattccttgaagtaaatgttagattacttggaattttttgggctaattaaataaatttatttatttgccctcacaaaaacccttaagaaaaataattattttttaaattttgtgttcttggaattattccaaaattaagattttagagtttcagggcaaatttttaatttatttttgaattaaaaaaattttaaaagggctttacattttatttttttttaattttaatttttttttaaatttattttatggaaacaaatatttaaattaaggagagaatttcaaaattgattttttgtattttttggaattattccaaaaattaagattttaaagggctaatttttctttatttttgaattaaaaaaattataaaagggctttacattttttttaattttaattttttttcttttatttattttatgg

SEQ ID NO: 35561 - DNA, 825 bp, Heterodera glycines
  misc_feature (814)..(814): n is a, c, g, or t
ctcgttgtgaaagtgtaccctaaacaatggaggagaccaattcaaattcttgaaaatcaacgaatgattcattaattaaacgaagtattattacaaaaaaaagttggattcgctggttgaattcaaagagcttttgcctacttaatttatttactattttttaattttggatttgtaaaaaagtcatttaaatttggcgaaacgtattttattgataaatttgaacggaaatcaaacacccgcagcgttttaagagatttttagacaaaagtcagatcaggtttgaaaccgaaactttataaatattaaaaataaagaaatcaatgatatatttccatttaagcggatggtaacagttaattggccaataccaaagcagagatcacaattccagaactaaaagatatgatcactcagtcaaagctcatccaattgtttcgtccaatccaacttttgcccctccgcacggcgtcacttgtgccaacgaatttcaagggtcataatttcactagagcccggaattttataaaatacaagagaaaaagctgggtcaatgatagtgcggggatggggggaaacaagcgaaaaatctccgttttcggggataactgttccaatcggtgccgatacgccttgcctccctggtgcgttgtcggcaacataagttttaccaattgccgtgcttctttgcgtccgcttctgttccaacttcgcacggcaagtgaaacgtggcccagaaaatgcaaaagcatcgattgatggacgaggagcacaaagaatggaccagcgaagaatgtgtgcccggcgggggggngggggggggga

SEQ ID NO: 35562 - DNA, 972 bp, Heterodera glycines
ttttgggcaatttaatttaaaaaagctaagaaaatccgggaaccaattttataacgtggggacttaaaagcattgctaagcaaaatttaaatcgagaataattttcgtgtatattttcatttcaatttcaaaaacaaacaattgatacaattttggtaagaaatagtgcataaagaagggggggggggggtagacgaaaagagaaattttataaaataacgcaccccatctgatattcccctttttctgttccacaactcgccaaacgcgactgttctcgttgacaagaatttgtccaattaaggtacttggactttccacagaaatgtggtaaaaaattttggaactgtccggcctcacggttggacttaaaagaatcgtgaagcgaaattaaaaatcttcagagaagatttctttgttttgaatttttggcaatttaatttaaaaaagctaagaaaatccggaaccaattttataacggtgggacttaaaagcattgttaagcaaaatttaaatcgagaataattttcgtgtaattttcatttcaatttcaaaaacaaacaattgatacaattttggtaagaaatagtgcataaagaagggggggggggtagacgaaaagagaaattttataaaataacgcaccccatctgatattcccctttttctgttccacaactcgccaaacgcgactgttctcgttgacaagaatttgtccaattaaggtacttggactttccacagaaatgtggtacaaaattttggaactgtccgacctcacggttggacttaaaagaatcgtgaagcgaaattaaaaatcttcagagaagatttctttgttttgaatttttggcaatttaatttaaaaaagctaagaaaatccggaaccaattttataacggtgggacttaaaagcattgttaagcaaaatataaatcgagaataattttcgtgtatattttcatttcaatt

SEQ ID NO: 35563 - DNA, 1176 bp, Heterodera glycines
  misc_feature (1126)..(1126): n is a, c, g, or t
aaattgcatttaattatttcatttacaatttgccgtttctgtttcattggattcaattaatgggttcttttcttcaaaatttaacggtgtttgatttggttgctcatcagcagatggagaaccctaaaattgtcttcaaatgttttacaattttgtgcaatacctcattaaaattgtcatttggcactgattgtgcataaaacaaaatgaaacaataagaaaaaataaataatttgaatttcattcttaaacaaaaatttaattttttgttgcagaatttctttaataaaaaaaataaatatattttttaataaaataaaatttaatttaataaaatttttttagtttttcctgaattcattgcaaaaaataaaatatatataataaaaatgtacaattagataatatatttattcgaaaaaataacaaaaaaatatattaaagctaatccaattttgtccaataaatcgacaacgtcaatattttgtttgtatagggagtccaatttttccatttttcattagcgattcgatttttatttaaaaaaatctgcaatagaagtgacaaatgtatgtaaattaactttaaaaatatttttaaaaaggccaaatttcgtcggcaaatttttacattttccatttttcacaacaaggtaaaaattattccaattttttctcaaaatatttcattttgcataattaatttaaatataaatattttttaaacaatttctaattaataatttattaattttggttttatttaatttttattttcacataaaagtttaatttaaatttttaatttgcctataaatttttatgagacttcatttcttttattagtcgaatttcttctttatgattatggattatgaattttttctttaaaaattatattactaaatcctttattttatttgtttaatttttcacaaaaaaaaaatttcgtgaccaattaaatatgaatttcaaaaaacgtaaatatgtttaaatattttgcaataacaatcaaattgtttatttccacaagcgaacacataacacaaatgtgaaaaaagcgggcggaaagcgagggcgacaacgacgacgacatcaaaaaattggggaaaaattttaataaattnttgaaatttttttttcatttttttggcggcatcaaattcatcatggtcag

SEQ ID NO: 35564 - DNA, 731 bp, Heterodera glycines
atttttaaaggaaacaaataaatcttatttctatcttcttattatttatttagcacttaaaaagtctgtaattaaactaataggttatttttaatatgaaataatatcaaatattttattttttgtattattgtgttaatactatttgttagatagagaatagaattttattttcaaaatattaattattgaaatttaaattaatttaaaattgaattttttgaatatcttaaaaattgtataatctaactgttttgataaatcatacattaaaattctaaataaattattaaatttactttcaatactcaaaattcatttagataatcatcttgttagtttttaatttgttcaatttgcctgttttttgtgacacttgtaaacatatggctaaattacttttttgtgatataattattttattatttaaagtttttgaagaataaattacaatcttgcgatcatcagagttttcgaatcgatgtgaaatttcttgaagtaataattaaaaaaaaattagcttgcttttgaacaagtgtttctttgaaattgatattaaataaataaatttatcataaattaaaagataattcaataactttttacttgaatttaaggtgtcaatagcagttcgtacaaaggcagttcgaacaaaggcgtttcgtacaatggcagttcgtacaatttgcagttcgtacaataggcagttcgtacaatggagtttcgtacaa

SEQ ID NO: 35565 - DNA, 866 bp, Heterodera glycines
gggaaaattatattttactttatccacctacccgagtattggttgttctggcggttaaagcgaccgcgccagttcctgttattgcgcgcccgtctgccacgaaaaggctcattccgatacccttggtccgcacggtttccttaaataataattaaataacagaaattcagtccagaataaattgcaatcgttttaaaaaatgttaattaatatttaaatctgcctaatatgtgttataaataggaccaaaatcgtcaagttccgtgtcatgggactcctacataacatttttccggtttattcttgaatattaccatttattaaatatcccacaaaaatgggtaaattatctgtaaaatcatttatttttaatcggtttttaagaatttctgcccacgcgggttcctaagggtctgaattttggttgggatacatctaagactaacaatgttccaatccctgggagattagttccgacaggacccggtcccacccatttaaatttatggtatatcttaacggcataaaaaatttcaaaaaataatacggcaccaatctgaatcggaattggttggtcggggtatggctgaatcggttggttggggtacgtctcagtctcctcgttcgtggtctcaaaccgcacaagatcagatagtggtgtcaagccacctcgaccctcccggttttcgctaagccatgcgctgtaaaacttaatggttaaaataaaaataatagatatttatttaattatataaatatgtcctactcattcttataaatacaaaaataatgatccctctaaaaacctaaactccgccaagcttcgttcgagattggggcagtcaagtcggaatccgggaaatgca

SEQ ID NO: 35566 - DNA, 861 bp, Heterodera glycines
ttttcagttaaagtggtcaaaaaaagatttaaaaatgtttttgtcaacctacccatatacacgttgcatgagacatgtacacattcataagttacatattgtacatgtttttaatgcatgtacaatatgtaacccatgatgtgtacatgtgccatgcaacgtgtacacaaaggaccaagaaaaaaaaaatcattttttgaccacttcaattaaaattatgcaccaaaacatcccaaatgtgaagcggtctcttcactcttcctcatgctgaggctgtggttccaccgacggcaattctccggaccccgcattcgaattcgcaaccgccgaactgtgaccggaccccgcatgagaattgcccgacgccgagctgtgcccagccgatgtggagagagacgacgaaatcggactttggtttggcgtcacaaaaactgaaggcggcgttcctccggtctcgatctaaacattttgagaccaatgcttaatttttgcgtctattcgaataagagaaacataaaagaagatagctagattaattaagcaatttattcgttttggcattaaacaaatatattttttaaattatcgaagaccttttttaaacgatttttaatttatgaaacttaaaaagcaaagtaaaaaatttaggattgaattcacatcctgacttaatgaaatgacaaatgctcaaaataaatttaaattaatgtgaacagatttagagagaaaaccttacctctctgatggcgacccaaatcaccaatatcgcatcatgggacacttgacaaaatttgaaaaagttctcattcgagattttcagacgcagcagatcccactcctttaaataaattttaaattaag

SEQ ID NO: 35567 - DNA, 1211 bp, Heterodera glycines
gcaaatgtcttgacacgattcatattgtgtcagttgtttcaacaataaaaattttatgtccttttgcaaaaaaaaatcgaggacttgaatcatgtgataacgaaattgacttgggaacaagaaacaaaaacgaccgagacacaaaagccaatgttttggcacggcacaaattctcgagcagcatgaaacttgagccaaatcgaatcaaaatcttgtttgaataatttagatttgataaggtacataaaattcagaataataaaatttagctaatatttgaaattttacttttatttttgttcctcaaaggcacttttgcttgcatggccggcaatatggtcgggtcacagacagccgatgcccatttggacgtacaatcggcacaaattgatcagttggacaccacactgaatgaccaaacattgcgcagcattgttgatgaagcatcgcaaaacatagacaggtattaaatcaattttaaaaataattattcactttaagggataaaataattcttaatttaagggattttttagcttagttaaagattattccaacataatccattaagagaatttttttttaaatttgggccaatttcttagagaattgcgtaatttgacttacgcttgctaattgcgtttggtttatttcattattctcatttgtcagggcaatttcgaagacaaatgaagagctgaaaataagcaatccgcaagacttgctgaaacattttaaatttgttggcaaacggccgacgagccaactgagccgagcgcgtgaaatttatgaggagagtttgcgcttgattgagaagcatgtcgaactcggtgagtcaccgcctccctttaaatgctttaccaaaatatttttgaaaaaggatattttatattcttaaatgcttgttaacggttcaattaatctatccaattcacattgaattgcatgtaataataacacacagtagcatatttttaaataatacggtatcagatgctttctgttttttcgaatcacttacagtagtacatttaaaaaaatacggtaccacttgttgatttttttttcttctcgaagatcggaatatttttaggaccaatccgatgagttcaaaatttatcaatggacccttttgtttttttatctttgcataaatgtttaggtattaacctacgcccattggacatgccaaacgagaacatttcatttga

SEQ ID NO: 35568 - DNA, 913 bp, Heterodera glycines
tatgcaaattgggctacccaattgaggaaatactcgacccttggtctatgagcagccggacactgtgctgacattgcccgtcactggtactgtttgttttttttttttggttttttacgagggtagagacaaacccatcgacagggtggattttccaaaaaatgctcaaataataggatttgtaatgatcaatcagaaatggtttgatttaatgcaactgcccaaaaattagtccaaaaaatggccgggttggaaaatctcggagaattcctcaaaagtttttagcctggttgtttctacccaagctttggcattttcttgcctagacacattttgttatttagaattcaccatggaatatatcaaaaaaagtcgggcttgcttcgcccactttttcagcgtaccgccggaacagttgggaattaggtttcctgttttctatttttttacttttcgcttaaaattttgttatagaatgccggacccggagcaattcggcgttttggatgtgctcggtgtgttctgttatttgcatttcatgcctttaccctctcaaaatgccacagaatggtggcatttggaactgatttggacgaagggacgggtgccattggaattggcggagtgccaaacggaggacgaaaatgggggacgaatgtgctcaaaagagtcatggcgtttatctagtgcatgtctattttcagcaagaaaacaatttgctcttacagtatgctactttctcttccccaactgtctctaccgtaccccctttcagtccgccctctcttcgtttctcacccttcgtcattttcggtgatctctccgttttgcctgaccttctccgtcattctgctggtcggacttcggacctttcattcgttggctgtcagcgacgaattgccatcgatggaat

SEQ ID NO: 35569 - DNA, 507 bp, Heterodera glycines
acgagctggcgccgaaagggggcgccgaaacgcgaccgtcgaaacgcgagcgccgaaacacgagcgccgaaacgcgtgggtcccgtttccatcccaacccaaccacaacgaacacaagagaaaatagaaaaagagacatcaaagtttagaccaaacatttgggatttcgaatcaaatattttttgtcttatttaaaatcaataaaacagaaaataaaacaaattggtcattttatttatgctcgacaattgaaggtatgggctcgcatgcatggaaagtttcggagtgatcgtagcacgtttaaagtcgctgaatttgtccgaacttgagctgagtgcattgaacggaattcagttttggaattacaaactattaagaagtagcctgtcaactattaagaaaataattaaatttttaaagtagcctgtcaactattaagaaaataattaaatttttaaagtagcctgtcaactattaagaaaataattaaatttttaaagtagcctt

SEQ ID NO: 35570 - DNA, 918 bp, Heterodera glycines
  misc_feature (35)..(35): n is a, c, g, or t
aaggaaagagagtcgatttaattatttgtttttcncagcggatactcatgaaaagggccgagtgaaaagtcatttctgatccatccactcacattattgaacaaagcagaaactccgcaaaaaactgccacagcctccgccaactgagcaccacgcgccaatcgtccgccccacaatcgaccaaatccaactgatcaaaagcaaacgaagagcatggatttggaaaagaaaaagcgaaacatttggcaaaatgggcaattgaagcgaaattcggaacaattggcaatttaaggcaaaaacaaaggaaagtcggggaacaattagcaagcacaatgccattgataagtaatgcttgactattcggcaaccaatgccgttcttttttatttcaatgcttttccttccatttgccattttccttctcatatttttcattttccattctgtcccacctgaatttcgttcagatggaaatggacctaaacaaagagaaaagtgaaaattaaaattaaatttaaaataaaatttaactgctcacaatttcgacaagcaaagccaaagtggagaaaaggagaagcgaacggatgagcaaagaaacgaagtgaccctaaggcggggaatgccaaaattggaattccttcgcctttcggcggacggaggaaaaccttgtgaatggaaaggaactgttgggcacacatttccgtgtcaattaccatcagcaaaatgccgaccattgcgaggaaaaggcacctgaaaaggccaaagaaaaggaaagtggggaaaggcacggcacaagcagtggataaaccaatcaatcaatcaataaactaatcaatcaatgaccaatcaatcaataataatcaatcaaaaaacattaaaacacctgtccgcgatacgcacccgatcagccaatcgctg

SEQ ID NO: 35571 - DNA, 1017 bp, Heterodera glycines
  misc_feature (32)..(32): n is a, c, g, or t
caaattttcgcctgtcggcgtttggtccatcncacatttcgttgatgctgaaatgcggtacaatcccatttcgtcaaaagtgactccattcgcttcgtatgcatcaatttcgacggccgattcactgcagcggcgctgtaagcacgttccgcctttccactttactttgcactcgagtgctgaaattcggcgtttttctggccattcttcggtagctaacgaacattttttgaaaaatgtccgtatttgctctcgtccttcatttccatttagttcaggaagtttttccagagtgaggagaaattccaaagaacaaatttgtttttgttctttctcactttcgcatccaccattttgtaatgaaaccaaaaagttgcgattgtctttccaattttcctcggccgaaattttgtgttgacgaagaaattgcatgttgaaatgggattttcgtttcccggttttgaagtcagtttttagacggagttaatttaccgaactgacaaattttcgtgatttgtttcacactttacggcttttccttttcgaagttgcgttttttttatatgcagagggatttagttttctcgttttactgatttcgtggccacaaccaatgaagaaacttcattagggatttgtttcccttttccagagaccaggatttgcttttcctgttacaaattgcagaaggatttacttttccttttaaaatcgttgctcgtccaaatttgtcgtttattgccactgctgagccacctttgtacaggagcgccacgtcgtaggaaaaagaatagtccaatgggaaaggggaattgtatcccaaatccaaaaccaaatcgccgtctcttttcactgctttcttttacttccaattaataaaacaacacacagcaatcaattacaaatttaggaagagcacatatatcacacataccccaaacaaaacaaaataaaataaagggtcacaaaaactaaaacaaaacgccaaataattcaaatcaacaatgatatgacagg

SEQ ID NO: 35572 - DNA, 908 bp, Heterodera glycines
gctttcttttcttatgcttttcccatttgccaggtcattctctccctccccctcgtctccccccgtccttccccaaagttttgttgtcgtatgttttttttgtccacaatttgtttgacctcgtctctccccccccgcccccctacacagataactcattaacggcgcacaaaaagcatcggcacatcatcaaaattgggctgggaattgcttttacacctcaaattggaacaaattcgcagctcctcccccccattttcacaataaatgtaaaaacatttatgggggcaaatcaaagagaaggtcaaaattaatttaattaaattgaaaaggtccaagctgatcaacaacaaaaaatgatgaagaaatgcgaaattcttttcaattttaaacattttggccatattttacaattttcggctgattgatcactgatcgctcccttaagcaaacaattgcactcggttgttctctcgatcggccaccaccaattgatgttgcttctgatgcctcaacagacaaatgccctcgacgcctttgaattggcccgaggcggtgccccaagtgccaaaaacgcggagacaaacgccggagggggagaagaattggacacgattattgccagaatcggcaacgataattcgacccttaggggggggggggaagcgacggacaataagcagacaaaaacaatgccgacaaaagcaaattatcgtgttaattaatggtacatcatccgtttgtattctttttttggctcctttttttaaattttctatttttatttaaaaataccgtaaaaaatgaatgctattggggttatcgatgtttttagtcccaatctaacttaagtccataaaaacatgaaagccataaaaaatacaaaattctcgggttttcgacttttt

SEQ ID NO: 35573 - DNA, 802 bp, Heterodera glycines
caacatttccctcagaatcgaccaaaacaatgccaattctctccactggttctttgagccaccaaatgcttcttcctctttatctaaatattatttttttaatttcatgctgttatgccatacaaaaccgaatccaattgaattatcgagttgttttgttggtgacaaaaagtcggctccgtccgcttccctccaattcggtttgtatgggccgcactgcgagtgggggtcgggttgaacattctgaacatagccaaataagcagtttttaagggttattttaacagtgaaatattacaacaacaaaaaaaagattaccctccaaaaattcggttggcatttcgcttttagccaatttcgatgcatttccaacgattcttcggtggacaacgattcctcttcaaagcccattgccagtgcaaattctgttgctgtttgttttgtgctttttcctcctcaatttgcccaagggaaacctttctctccggcaagcaaagaatgttcagtgtaattcatcacagcccacgcgaccttggcggcgctttttattcgactaaattaattaatactaattaataatgcgtaaacagacacggggtacttttcggttttgtatacacacctcaaaattttcaaaaatatgccaacaaaagatgcactgagttttttggtggcacaaaaggaataatttgtcccaagaaaatctgaggctttttgccattttaagggtaaaatattattacctttatgcgatctatttcacttgaacatatcttaataattttgatgtatgaatacaaaa

SEQ ID NO: 35574 - DNA, 100 bp, Heterodera glycines
cccttcccccggactgatcactcccttcccccggactgatcagtcccttcccccggactgatcactcccttcccccggactgatcagtcccttcccccgg

SEQ ID NO: 35575 - DNA, 683 bp, Heterodera glycines
aatgtgtgaattttcacttcaacaattagaggacttcactatttaattagtgaatgaaaattgtgactcattagttgaaaagtattttattgaacaaaaaagaattgaaataaaaagaaattcgaaaaaattatttgctgatcattcgaatgatatgaacaagtatgtaatctcgcaaattctcacaataaggcgtcttttggaggacctgctattcggcgagagacattcgatagcatagccgcggcgcaattattattttatgcgattggccaatatttatcctatattttactccttctcgaccatccccgcccgcgtattcgatctagtgcgacgacctcaaggcgatcaccactcttggggaggacatttatccagggaccggattgtggcttactccggtttccccccaaatccaatcctcgttctcactcgttcccttcctcatattctgctctggacatcatcaccttcactagatttatacattcatcgatcattttatagacaattttcctctttgtaatatagaccaaatgaccaacgaaaaagactctatttggctatattttgacaaaattcacaattcttcttatgccaaatggaacattgagcttaataatcgcaaaaaccaaccttttttttgttgaaaatctgttaacaaattgcacccaaatttt

SEQ ID NO: 35576 - DNA, 1070 bp, Heterodera glycines
atgtgcatgtgtgtaatcacatgtttaaatgaaataaaatataattttttctcaaaaatttctccttcttcatcaatttcttactctagtctcgaccagtcatccattcttaccagtgcaaatttttagcggcggtaccggtactagacaaaccggtaccggtaatttcatttttgaaaaaaccggtaccggtaccggtaccggtaaaaaccggtaattttagaacataaaaatttttggacaaaattttccaaatacaaaatttttattcagttttcgcgcgagtgcctgttttttagcattagaattgttcagaagtatatgtatattgagggtgaccaagttttttttcaaattcaggataaagaacactaaaattcagatgtagacctcaaaattcagattattgcaaaacaaggggtcagcagccaattttccaattttgcgaaggggtctccggccatgtaaattaatgtaaatcaatgacctttttttgctttcaacaccgctttttacgcggcacgttttttccaagacttttgggggacaaggagggccggcggtgccgataggcgccgccgggaaaaattttgtaatttttaatgcgatttgttaacagaatttgtaaaaaaatgaccaattgattaagttttgggtttttaggatgcttaacatgaaagaaaaaagttagaatattttttaaaattaaaattttaattaaaataatggtaaagaaaatgtaaggaatattctatccaagtggggaattgaactcaggcgaaaaattatgaaaggtagaaagtttaaccactacaccacatgtgcaagtgtgtaatcccatgactaaatggaataaaatttaattttttctcaaaaatttcttcttcttcaccaatttcctactcttttctcgaccagacccccattcttaccagtgcaaatttttaccgacggtaccggtactagacaaaccggtaacggtaatttcatttttgaaaaaaccggtaccggtacgggtagcggtgccaaagaaaacaggtaattaccgaccagtaccgaaaccggtaccg

SEQ ID NO: 35577 - DNA, 1045 bp, Heterodera glycines
gtcccagtgattggaatgcaagagaattgagtcccagtgattgaaatgctggagggttgagtcccagtgatggaaatgcaagagaattgagtcccagtgattgaaatcctggagggttgagtcccagtgattgaaatgcaggagaatgagtcccggtgattggaatgcataaaaactgagtcctggtgattgaaacgcaggagaatagagtcccagtgattgaagtcttggagaattgagtcccggtgattgaaatgctggtgtgttgagtcccagtgattgaaatgcaagagaattgagtcccagtgattgaaatgctggagggttgagtcccagtgattgaaatgcaggagaattgagtcccagtgattgaaatgctggagggttgagtcccagtgattgaaatgcaggagaattgagtccctgtgattgaaatgcataaaaactgagtcccagtgattgaagtcctggagaattgagtcccggtgattgaaatgctggtgtgttgagtcccagtgattgaaatgcaggagaattgagtcccagtgattggaatgccgaaggaccaggtgaggttaggtcccagtgattggaatgcaagagaattgagtcccagtgattgaaatgctggagggttgagtcccagtgattgaaatgcaagagaattgagtcccagtgattgaaatgctggagggttgagtcccagtgattgaaatgcaggagaatgagtcccggtgattggaatgcataaaaactgagtccgggtgattgaaacgcaggagaatagagtcccagtgattgaagtcttggagaattgagtcccggtgattgaaatgctggtgtgttgagtcccagtgattgaaatgctggagggttgagtcccagtgattgaaatgcaggagaattgagtcccagtgattgaaatgctggagggttgagtcccagtgattgaaatgcaggagaattgagtccctgtgattgaaatgcataagaactgagtcccagtgattgaaatcctgaagaattgagtcccggtgattgaaat

SEQ ID NO: 35578 - DNA, 1357 bp, Heterodera glycines
ttttgttttcttcataattcatttccttcgaatagcaactggtgacttgaccaaatacttggactgccttatcatttctcactttcatctcggtaagtgcattttttcaaaaggaaataggtaataccaaaatgttgctgaggatgcatattagaattagaagtagagtttggggtaatagtgtcgggtcccttttttgaaaaaatttcgtgtttttcgagagtcattttgggagttttaagggtcggaaaatccgaatcagacttccattgcaaagttttttgtttcctatagggtgggaattgatgggggaggggggtatggcgttacgtacgtatacctttcctggatttgtccctccccttcgttgatttgtttggttggccgatggtatggtacttattgtcagacgatcctcccttcacacataaagaaataagcagtcacattaatctgtctcattctttccatatcactgtggtgctcttccctacatgacggaaatgatcggctatcagggcccgatttacatgacctatccgaccaaggccattgtgcccgttttgctagtatgtttattatagcattttgcaatgattttggatttgcattcgtattttaggaagattttcgaaaggtggtcactgagcatcgcggagagacgaattttttcacttcggcgcacgtaaaagcatgcatgaaaaaggtgaattttacgttcagtttttgattcccaaattctttgtctttttcaggtcattgctgtgaatttgcacgaaatcattcaggtggacgaacaactgaccatccaggccttttacgccggacatgtgctgggggcagcgatgttcatggtcaaagtgggcgaggaatcggtagaatgaataaaaccatttgcaataaacgatgaaatgtttttcggtattttacaccggcgacttcaacatgacgccagacagacatctcggcgccgccaaagtgccccccggcctttgtcccaatgtgctaatcactgaaaccacttatgcaacgacaattcgagactcaaaacgggccagggaaagggactttctgaacaaagtgcacgaaacgatccaagggggaggaaaggtgaatgccaattttacgtgttgagacaaaaacgagtggtgcacaatatataacatacaattaattgtcttccacttattttcttcccgtttcaggttctaatccccgtctttgcgcttggtcgtgcccaggaattgtgcattttgctcgagtcgtactgggaacgtttggacctgaaagtgcccatttacttttcccatgggctcgcctctcgggcaactgaggttgttttctatttaagcattta

SEQ ID NO: 35579 - DNA, 780 bp, Heterodera glycines
cgaaaaagcgtatgactaatcaccccccccccccctccgaatttcttcgattccccccccccccccggcgatggcttctctcccccccccccggccattctctgccgtcccaccctttcatcgcatgactcactggacaaacactgctccgtcaacagagcacgcagcacaagcacaggtcgaattcctccgcagcattttgctggtgattgtcaaaaaaccctttacaaattccttggcttacataaaaatttccttacgcaatttgtattttcgacattttgaaaaataattaattcatttaatattaattctgaatacatatttcaattcatccatcccctttccgatcatctgtttcgttttgtgtcttttctccggaagggttctcttttcacaacaatttttcaagaacgctaactgtccaaaagctttgatcaaaatgtttccgatttcccgacaatttaaaattgggccaaatcccaccgattcccaacaaatcaatcgctttctttccgccagtcgtccgccccgccccgtctctctctccttttatgagcgatttgcttttgtcgcaagtgtggacattttcccccacttttccctcccctccgtctgtcccttttccattttccccccagggggtgtccccgcattgcccctcaaaatccaattggaaatacgttgaagaaattgtacaaatcgggcggggggggggggcgacggggagagtgggggtcatggagtgagtggcaaaaaggtggagatctgactaccaag

SEQ ID NO: 35580 - DNA, 1111 bp, Heterodera glycines
ctcggcttaagaagaatccgatccgctcggcttcatcgactatcgcgcatttggcgtctgcggaatgggcgaaggcgctttggaatggcatttgggggagagatttttggcggcgatggacgacattcaaaacaacaacggcaaatgtgatgccaaacatgaacagccacgtgcttgccaattccggtaaacaaacaaaaatttggtgccgtaaaaatgggtttcattcttctcagatatttcgacggcatttctggcactgtccgggcacacagtccgccactgcttgtgtaccgtaacgcacatttggccattacaggtgatgactggacacaatttgactaattaggctctttcatcagaaaatttcttgaggagattcggatgaatttcgagactctcggacggggcatttgtgggatcatttaattaggctatgccatttgaacccctcacatatttctccggaattttagccctttcgtgccaccctcagctccattcgtctcagttttacgtcaaattgaccacttcgtccaattgctgccattatcggaccagcagttcaccaattgccgattggccatcacttgtcagttgatcagttagcaataagtgatcactgcggtgatcagagtacttttgacccaattagaatttcctcctccccgtcgaccggtcgagcgaaattcgcattcgcgtcaaagagcgacgatggaacggtgccaaattggtgggcgaagcaaatgtgccaatggtagtttctaaaaattatgaaaagcacattgtaaatgccgaaaattcgcagatggatttgctggacggtgccgacaaagggtcagtggagcggcattttaaacaaaattgtcagtctaattacctatgaatttgtgcctcccctctctctttcccctgctgctccctcagtgtcggcacttctcctccctcacactctctctacggtgtcctctcaaaggaccggaggcccgcggtgccgataggcgccgccggggaaattttttgcaaattttactccgatttcttagcaaactttgcccaaaaaatgaccaagttgctctataaaacgatatgaaattctgaaattttcagt

SEQ ID NO: 35581 - DNA, 765 bp, Heterodera glycines
caacttggcctcgaaattgcactggtcatccgccgctttgactgcatcgtcgacgaacatttcaaaacacgcaaatggagattggagacgcaattgctaattcaatgggaaattgaagaaaatggcaccaagcaaatgaaaattgtcaattccgctgggaaagtaatgccaattccgcaaaaagcgttgctgaacaaagtcatcggattcggtgacattcagatcatataaacacttgatcagattggattgattttcaaccacattttctgcttttcacagtttgtgcaacaaatttggacatcactacggacaacttgcgcattttggaatttgtttcgctcaacatttggccaatgctccgcgactccgttcgtgtgatgcttttgaacaccatcgtttttcgccgtttacgtcaattggtcccgtcactgctcaatgattgtccatcacttcgcgggtgtcttgtttgatgatgatattctcctcgcttttccgcccaatgaaagtgccaatgcgtcggatggacaagcggtggccaaattccgattgactccgttgtgccatttgagctgatcaaccaaatgacttgagaaaaatttacgatgtttgcctcacccgttgtccaattgcatgggattaggctttacgggccaggtcgttttcgtacgatcgttttcgtacgggggtcgttttcgtacgaccgttttcgtacgggggtcgttttcgtacgaccgttttcgtacggaggtcgttttcgtacga

SEQ ID NO: 35582 - DNA, 849 bp, Heterodera glycines
ctaaaataccccttaggacatgtttttgaaagatttttggtgaaaaaatttttccactcaaaaaccatgtactcccccctttggtcgcaaattgcgaaatcacttttaattttataacttttttcgaaaaagtgataaaaatatgatatgaaatttataaaatagagaaaaaaatcgcggattttttcattattttaatttgtgaaaatacgttttcagaaccgagttctgaatttttttctgcaaattcgaaaatttccagaatttctggaataacttttttaattttacagatagaaattccaattaaagtccataaaatcgtccttatttttctcaatttttcttgctttattctatgaaaattggacaagcctaagtttagttatgatttttcaaaaattacctcaaattctcgaggcccaaacaatgaataattttcaaaattttttaaaaaattccaaaaattccgaaacaaaaaacaaaggtcatattcgtgctcagcacctcaaaataccccagaaaaaaatttttcacccccattttggcccaccaaaaaaaatttgaaaatttctagggggcctagctcgaaaatttttgaaaatttcccttcatatagtataccattcgatagcatttaaaatgctctacaaaaaagatctaagacaatttttggctaaaaccaacccctgacgagttatgggcccgggactcaaatgtcccgcttaggccaaaaaaattttctatttccgggaaaaaatcgaaaattttctaaaaacatcaccaatcgatagagctcgaaaaacgatgttttggaagtggtctccgttttccccggaaaaatcgtta

SEQ ID NO: 35583 - DNA, 714 bp, Heterodera glycines
aaaaaattttgtttttatgttttaaagcctcaatattttatttttaacttctaagaattaatttcactggtcaaaatgagatgttggtctcttaagtgattaaaatgtggtccagacaatgcgtcagtagttgattcttaatatttcaacttacttcatacttctattaattgatcatctcgagaaattatcatatttcataatttttataaaataacccaaattacttaaattaatttttacatcattttaaataaatctgggtgttttaaaaaataaatttgcttatagattagttactgacggattgtccacaacttttctttcccaaagagtttgggaataatcttatataaatcttgttctaatgttcagttgggataggattattagggcccaaagcaattccaaggcctaaaaatgccggggatctgatgcctaaagcggaaattcgtgcagctcgtgttcagcatttatataatcttttaattttgaaattgtaaaataaatttggttaacgactaagcatatctcaaaaaatttaaattgtttcttttaatttggaaaataaaaaaaacatactcgggagtagttatgagtacattttttgccctaaaattgccccaaccccgtacaccccaccatgcacccgcgaatcatcgagagaaactccccacagggctggtgaaaaaagttgaaaaaagtggtgaaaaa

SEQ ID NO: 35584 - DNA, 999 bp, Heterodera glycines
ttagtgaaaattcgatcactcatattctttttgctaattgagcagaagcgtaacaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctataccctgtactttaattctgcgttggatttttgctccccataattgtttgagtaccccaacggacacttgaaaaatcgatttttttgtttcggggcagtccccccaaccgatgcgccagatttatgg

SEQ ID NO: 35585 - DNA, 1071 bp, Heterodera glycines
  misc_feature (967)..(968): n is a, c, g, or t
  misc_feature (1019)..(1020): n is a, c, g, or t
  misc_feature (1023)..(1023): n is a, c, g, or t
aagaaagtggcggagtgtgccgcagcataaaaaacgccggcggcgtcgtcgccgtctccggcggcgcatttattaattgatcaactaattagtcgtctgctcctccccctccctcgctgctaccgtcgtgctcattaaagttctcctcattcttctcgtgctgatcacacccatttcacatgaatgctattgatgatatgatgatgtctaattggtcgcacaaaaataattctttgtgcggtccaaaaattggccaatttggggtgcttttcacgtgaaataattccaaccccccctaattttgaaggagcaaaaagcgggaggatgaggaggaggagatgattcttacacaaaattttacccatcacactaattcattcattcattcattcattcattggttgtcgtcgttgtgatgtgatgatgacagaaaatttgtgtgtatgtgattaggggagagtttttggagctgattattgtggccgcgattggtttattcacattcatcgtttttgctactcttttgtgctgaactcgcaaatttcgggggtatggccataaatgtacacaaacaaataattaattaattgcaaataaatacacaaatgaacggggaagggaaagtgttgtgttaatggggtgcttttactgttgttgttttcgttgacgatcaccagagagagagagcatcgcgggttcgttcatccgttgcgaaaacatctcgatcactttaaattcaattaatctgactttacgccaacccatcacatggtgactttttaggtcacaaaattactaaaaaataattattttaaataggagttttgcgtattaattaatgggttattaattgatcttttcatgagtcaattactaattactttaagtataacaacgcgctttggaatgcttaagtaaaacgatttcttctccggcgccttttttgtctccccctcccgctttgttnnttttccttcccccttcttttgttaaggaccagcaggaggaagggagaaagnntcnttccttttaaggaactaacttattcgaaatttggcccaaaatcctcaa

SEQ ID NO: 35586 - DNA, 763 bp, Heterodera glycines
gaagggagtcaaacaccctattagttcttttctgtgccgagaaccggcaggcaatggatgactttcaatctgcaagaaattaaattggcaataagtggttgtaaaaaacttgtgtaaggaattattttttgaagtgaatcaaacaccctattagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttgctgtgccgagaaccggcaggcaatggatagctttaaatctgcaagaaattagattggcaataagtggttgtaaaaaacttttgggtaatgaattattttttgaagtgagtcaaacaccctattagtgcttttctgtgccgagaaccggcaggcaatggatggctttcaatctgcaagaaattagattggaaatatgtggttgtaaaaaacttttgggtaatgaattattttttgaagtgagtcaaacacactattagtgctttgctgtgccgagaccggcaggcaatggatggctttcaatctgcaagaaattatattggcaataagtggttgtaaaaaacttttgggtaaggaattattttttgaagtgagtcaaacaccctattagtgctttgctgtgccgagaccggcaggcaatggatggctttcaatctgcaagaaattagattggcaatatgtggttgtaaaaa

SEQ ID NO: 35587 - DNA, 1428 bp, Heterodera glycines
  misc_feature (1319)..(1319): n is a, c, g, or t
  misc_feature (1344)..(1344): n is a, c, g, or t
aaaaacaacttgttaattaacccataagtgaagtttctcaaagttcgtacaataggcagatggttcaaaaaaattttttttttatatttcaatgaaacccagattttttctccaaaaaaattaaaatgaattttcaaagccagaaaaccctaaaaaaattcagaaaattttttaagatttttagattttttcgattttgaaatacgttctgattttttggagaacaattttaggtttctttgaaaattaaaaaaaaaactgtacgaagtgccattgtatgaacttccattgacccccccccccccccgcttcctaggtcataacttttttgaaacataaattcacaaaaatttttgaatttttacgctaataaaaaaatatatatatttagctatccaatgatagaaagaatgaaaaactaaatttttaagcgtagcaaaatatgaaaatttatactaaaaatttcatttttataattttattagacagctccgtttgagcttaccccgacttggtccattttatgaatttgggttaattcaaacatgaatttcgttataaactggccgataaattgtatcaattcgacagtttcctaaaaaaaatttatttttaaatatttaaaatatttttatataaatatatttaatacctcatgaaattcaaaaaatattttttctttatttggcatatccaaaaaaatgttcatccgtcgaagaaggcacacataaaaaaacagcaactcttttttgcccacagtttgctctagtccagttggtttctcagttattctataaaaatttttgtaattttattaattgcattttaaataataatcgcacacatatcctttttagggagacaaattctaaaaattttataaatgttatacctaaaatatgaataaaaatgcgttaagtgtcaaaaaacacgaaatgccataaaaatctaaataggcttagaattaaatgtttttttttgtataaaaaagcaaattatgtgtaccataaaacatgtaaaaaaaattcccgaacccaaaccaaaatatgtaaaaataaaatcaataaattaatgggtctgcatcgtttcggcgccagcctaagtttttggactattttttttgaaattcgacaaccttggtattattcgaaagcttatcatgtttggaagctatttccaaacaattgctttgcgcttaaacaattaacaaaaaagttataactatttaaatcaaatgtagcaagttgcgggtttttcgcggtcttggcactaattttggcatttttaccaaaaaataatatattaggaaaattaattanattaaataaattacacctacattgntattttaaacaaaatctttgtctgtgcagcacttttcttcccattttgagtgttttcgacaaaaatatctgcaaaaaatttttc

SEQ ID NO: 35588 - DNA, 1282 bp, Heterodera glycines
ccaaatcttacaaatttgaaatgtccttatttgtaagatttgtccttatttaagctctttgtccttattttcatcttattttttggattcagtgagaaatttagatttttaatgataattgaaagaaatgttttttgaagcgaattaatatgcaaaatcttgacaagattcagttaaatattcaaatttttctctcggcggtttcttattctcttaaaaaaattagctcaaaatcgtaattttgtcattttttgaacaaaatcgttaagaaatcgcattaaaaattacaaacatttttccgcggcgcctattagagcaggggtgtatctgttcttatttctaagaaatgttctgatttgtggtagtgccttattttcatttaaaagaggaaatttctgaaaaattcggctaattcctaacaaaattcattaaaaattcttaaaattcccccagcggcgcctatcggcaccgccgaactctcttccctcatccatacccaaaaatttttcggaaaaattcgccgaaaaaattgctaaaaatatgttttttttttattctaaatgcactgaaatttaccaattgcttatgtttcgacaaaattgttaaaatattaaaattgattttcggaaatgtataaatttctcatttctaagccgaaattgctcagaaaatagttggcggtgagtaatgcttgattgtgttgaataaaaatgcgattcaaagttttcgaagcgtgttttaaaaaatgtccttatttttgaccctaaaatcttatttttgaccagcgatgctcttatttcgggaaaattttcaagggtaaccctgattaatgacccctagaaaattattaaaatgaaaaatgaagaaattattgaaaaccccactaaaaaaggcaaatgcgcttttgtgtgttgtttgatgcgtgctcaacacacacatgtacttgtaggtgtatgtaataatgtgtggcgttatgttatgcatgtacataataaaaaaaagtgtggcgaatgaatgggcagcggaggggggggggagagaatgtgtgtaatgaatgaatgaatgaaatggtgttgggatggaattgtaatgggaattatgggaaatgtatggaggaggaggagaagaagatggagaagtatatactgccgccctggtgctggccaatgatttgggggggggggaaggagaagcgtggcttatatatgcgcaacaaggtcgagagagcgtatgggatggagagagagagagagagcagagattagaggagaatggagttaaa

SEQ ID NO: 35589 - DNA, 633 bp, Heterodera glycines
attagtgatgtctcgagaccaaaaatttcccgagaccgagactcgaccccgagaccgaaaaccccgagaccgagacccaaaaaacccgagacttttttcaaaaaattttcctatttgcttaaaaatcgtttaaaattttttttgactccttttttaactaatttttggttttatttttattttgattcaatttggtacaatatttatcatttcaaaaacgcacaaaacaaaaaattagttagtttttttcgcggtttttgagtcaatttaaaaaataaagggtattttggagctccggcggtgccgataggcgccgccagggaaaatttttgaaattttcagtgcactttgtgaacaaatttagtccaaaaatgacaatattttatgattttaattgttaaaaattgattaaattcccttgaaaaaggaataattttgaaaaattagaagaaaaaattactcttggaggggtactgatccaacgcaaaaatgaagaacataaccaagagcacaacccactagaccatgcacattactaagggtatgaagcaaaaagttaccaaaagtatatttatttctaactttacaaaagccaatcattatggggggtaaaaaagtctcggtctcgaaagt

SEQ ID NO: 35590 - DNA, 1032 bp, Heterodera glycines
aaaaaatgttttttttttttttttggggggcactcccccccgacccaggttccccccaattttgggggggagccgaaatctttgggggaaaacttcccctaaacccctttcttttttttggggggggttttttcccccccaaaatttttgggaccccccaaagggcccctgaaaaaattttttttttttttttttggggccatcccccccgaccaaatgcccccaattttagggggagccgaatcctttgggaaatacttcccttataccctgtctttaatttgggggtggattttttccccccattattttttgagttccccaaacggccccttgaaaaaattgtttttttttgttttgggggcagtccccccgacccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgtttcataaatatttttttcagaaagggttctgaaacgcaccaaattttatttacatgttagtttaggcactctgatgctttttctatcaaaaagggagatgaagaaatttttaaaaatttttaattcctttttaaacacgccaaaagagtttaggcttaacttttttttcagaaacttatcaga

SEQ ID NO: 35591 - DNA, 852 bp, Heterodera glycines
  misc_feature (832)..(832): n is a, c, g, or t
tacaacatagtaataaatgagaaattcaaataataaattaatgattgcaaatccagctttataaatatctcatgcatcacttaattaatactagtaaattgaatatttggaaaatatgctcaatgaagcagtattaattttgatttttcaaccaattagacatacttttctctaataagcttaaatacgcggcacatttttttctctcaaaaaaataataaatcgaaatggatggatataagagcatattaaatattatttgtcgcttgaattaattatattgtgcaccgaccagataaaagaaaaaacaattgcctcggcatttaaaatatatttatgttctagtttataatactcgaaataagtaaaatgctcggcctcggttaggaatccaacccactcgtacacccgttcgtggtcacttctaccattgagctatcgatccacatccgtccttttttatgatcttattaaccccgctttccacgtttaaccgcttattcaacttatttcttacctaattaatttattattaaaatgtgatgacaattatgtcagatttttttaaagtgtattccacttaaacaagaatgctgttccacagtatagttttcggtacacctttgtcctatgaaatatgatgtttttccaaaatgtgctaaatattaaattttcctcattgaccttcattatatccaaaagttattaaatttaatgatgagatataagtaaactaaaaatagttcttcggttagaaatcttggtcaagcagtaaatacagctaatcaaaaagcttaagcaaaacagtgatttatatgattcgaacccggantttatttggcttttcatttt

SEQ ID NO: 35592 - DNA, 1399 bp, Heterodera glycines
gccaaaacttcgtccatcttccagtttagaccaaatgactacgagcgcatgccgatcactgaggttttgtgagagggagggatggcattttttttataagttgattaaaaaactgcccaacgaacaattcataacaaaacaaacaggaaatctaattgctttttgacactaaatgccgttttttgaaatttgattttataaaattttcatttttttagaaatcaatcgcattccgtcgacggaattcgacgccgcctgccgagcccaacaatggcacactgtgttcactcaatgcgtttgtcatctgtttcagcactgaaaaaggttttcatttcctgtaaaatgttaattaatttccacgaatgcatatatctggcaccgtcggatttttaattttttttcctaaaattcttaatttagtaaatttgttacatggttcgtcctcttgcctttctgaacattttgttaacttttctgaggactaacaaattttttacaaattttacaggcaatagacgaaagcctagggctataaatgataatgattggttattgtcaaaatactcgaaaacccagttgttgttgtttttttttaagttttttggtcataattttttttttttgttatacaacgaaattttttggaaatttttgcattcctaatagagataatttagagttaccaaatgataatagattggttcaattcgcactaatatgaaatgagttatactcaaaaaccaggaaactgttgccaatttgtctctttccatattccacttcccacttatatttattattaatttaaaaataaatattttacccagaactcggcacatttcgcaccaatttggacacattttgtcggcgtcaaccaatcgcagccgccccgggcactggcgacgggaccgatgccggcaaaaagacggactgtgccggtgccagcaacaacaaaaagcgcaaatgtgacggaattaacggcaacaatgccgacgacgacatcggcacaaccgctgcggacaaagcggcaaatgggatgaaaaatgatcgcattggcggtgaacatgagcaaaacacgacgcactcggagtttgactcgagaaccgaacaaggttttcacatttatcgtttaatgacataattttttgttgtttgggtctttcaattctgacccaacgactgtccaaaaatgccatttttggggtaaaaatttattatttttagctttcatgattttttggagttttttctagttgaaaaatgaattgggctaatagacaaaatatcggtgggcgatggtgttaattctgataaattttctacaaaaaatggcataattttctctgttttctccccctttccaatttttgaaacttaattttacgtttttcttcaattt

SEQ ID NO: 35593 - DNA, 878 bp, Heterodera glycines
aaacttttcaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgggaatgttatttttatcgaattctgaaccgttttgagaaaataaaactaaaaaaaattgaaaattttgaaatcatgtttccccctcccttctcccaggggaataattttgaaaagtcttttttccccaaaaaaattttcaaaccccatttttcccaccgggaagggtattttttttgaattttgaaccggtttgaggaaattaaaataaaaaaaattgaaaattttgaaaacatggttccccccccccttcccccggggatttattttggaaaggctttttttccccaaaaaattttccaacccccttttttcgccccgggagggttttttttttgaattttgaacccgtttggagaaaataaacttaaaaaaaatgaaaattttgaaattattgtttcccaccccctttccccgggggaatatttttgaaaagattttttttcccaaaaaattttgctaacccctttttttgcccggaaaggtttttttttgagattttaaaccgtttggagaaataaaaaaaaaaaaa

SEQ ID NO: 35594 - DNA, 824 bp, Heterodera glycines
  misc_feature (58)..(58): n is a, c, g, or t
tgatttctgtaattgaaaatcagttacgcacagccctacccttaccgaaaaaaccagngatctccgatcacatatacaaaatctaaaaaaaatggaaatcaatgaattttcattcagcaacaagtggaagagcaaagtgaaaatagagggcagagcaggtaaaaaatttgaaaaaaattaattaaaattaaaaaagcgaatttagacacaaagcacagggactgaatcgaactgagagaacagagagagagcaagagtaagagagagagtgagagagaatgggaaaacgagagagagagagaggagaatagaaaaaaggatttcaaattgaaatagcctaatccaacactttttttgttaaaatttttcaatgggtcataaaaagagtgatattccgctagatctaagttaattttccagggtgtcatcaaattttttacaatttaaaatgacacaataaatgaaaattttataaaattaaatgaaatgaaaaaaaagaataatcaattaaaaaaataaattaataaaataattaatttaaagcaaatgacgatttggattttttaaaaataaaattaataaggctggatatttatttatgtgtttaaaatcaacgcaaataggtacctaaaaatgctaaaaaatatagaataggtgtttaaatcccgaaaagcccaaaataaagtagattaaataggaaaattttggtaaagtcatcgaaagtttaattaattattcaataaaaatgtgggaaaatgcgaaatagaccagtatttagacgtataaaacacccagtataaaaaattaagcagagcttaaaaaca

SEQ ID NO: 35595 - DNA, 665 bp, Heterodera glycines
aaaaataaaaatagaagactcagaattttgaaaattttttataaaaattgatgacaagctaatgtgataaaacaggttaattcttttcctttcagtatccctgcaaagtttggggcgcttctgataagtttcacaaaaaataataaaaaattaattttgcaaaaatcaataaataatgaaccctcctccttaataattttcctgcgcccatggtactcactcggccgcttcgaggcctcgaggggggccttcggccaccccccccccccccgcccttcaaaattttgaaaaaaaaaataaaataatagaagactcaggattttgaaatttttataacaactgatgacaagctaatgtgataaaacaggttaattcttttcctttcagcatccctgcaaagtttggggcgcttctgataagtttctgaaaaaaaactgaagcccaaactttttgtcactgttcacaaggatataccatatttttaaaatatttattaatctccttatttgataatatcagatgcagattgactgtattcaacttgtaaataaatttaggatcgcgttccgagcaatttctgtcaaaaaatttatgaataaatattgcaaatatcaaaaagaaatgaaacctcctccaataagaattttcctgctcccatggtactc

SEQ ID NO: 35596 - DNA, 962 bp, Heterodera glycines
tttaaaaatggtcagtctataagttacaatacttgtccttaaggggtggctcactttaacctttgaatacgctttaacatcgtcaggcaacagcagcgcaggcggcggcacatgcattaattcaccgatcgaaaatttaatattttttataattgcatttcattaacattaattaatgtaaaacatgccgaatgattgatgccccacatgaacacggagatgagcggctctttggcacggaacaacttccactttggcaccaacacccttttgtgccccgatcgcgacttgggctttttgactttggtcttatcctttcccattttggtgttgaagtttcaaactgttaaaaacaaaagaaaatggaagaaaatggcattggcacaaaagaaaaaggattggcgatgtatggtgtgggtaaattacgataaaattcgatttttcttttttcttttttgtatttctcgccaattaaagtgtaacaacaaaattaaacaatttaaaaattttatttatttctcgattcttggcgatttttgatcgatggcgatctcgttagtgaagaatgcctttccgattcgccttcgtcttctaaaatctgttcacgagccccaaaaagtgcgactttgtcttagggcggataggcgccatcgtaatgtttgtccgtctcctgccccgattttgcccgattcggaagaaaaggaagaggatgccgcacgggcgaccgtcggcggtggtggcgcgagaaattgtggtggctgatgcgaaccggagccgttcgactttatgcgatggtttttcgtattttttccgacgatttctaattatataaaatttaattttgttttaacccgaatttattttgttcgtttaagggcgattttggcacgattcgtctggtcaaacgggatgaattttgcgaatttgcgttgcttcaagaactgattctgctgacaaaacaa

SEQ ID NO: 35597 - DNA, 1392 bp, Heterodera glycines
  misc_feature (33)..(33): n is a, c, g, or t
tttgcagcaacaaaatgaccgcgggaaaatatnagggagaatgaatgaatgagagaatggaatgaggaggggaagaagaaacaaaggcatttttatacgaaaatattagcgtacatttgagtaccggtgagcaaaaatcatataaaaggcagagaaaattgacagttaatttcattaagctttggtggacacgtattttgatggaaaacggaattgacaatttggagaccaatcgaaatttgcagagaaaattggactaaaagcaaaactatctgaatttatcggtagcaaatttgtggaatttcctttgcccgacaatccgctgacaaacaaaatccgctttaagcagggatgcgatctgttctgatttgtcagaaatgttctaattttgggttagcgaccaaaatttgttctgatttcttaaacaaactcataattttaaaattttatggcctaatgtcactattttgcaaaaatatataaaatttatggcaaaatttggtcattttttggacaaaaatctgttaacaaatcgtactaaaatcacaaatttttcccggcggcacctatcggcgccgccgggtcccctgtcctccaaaatttttggaagaagggccccgcaaaaaaagcgtttttaaaagcgaaaaaaagtcctcgcttggcttttaattgcaaaattggcagtttttggtgaaaatctgttaacaaatcagaacgaaattgcaaaaaattttccggaagtaaagatgaaaacagtcagaataaaacaatccaaagggataagaattgtttgaagatcgtgcctcaatgatgatgatatcatttacataattattaatttattctactacaggtttttgcgcaattaagaagtagactaaataattatcttctggaaatataagacactcgattagaacccgtgcacaaaaagcaattaattaacctttagtttactccattttacgtattattgcaattaaattaaccaagggatatctaaagcaatgaaaaaaaacttatcaataaaaaaaattataaaaaatccaggatattgactcggatgctgacagtaggcgctgatttcaagcgatcaatgcaaggacggaagagataagcaagaatttattaccttacatagagttattgctaattaattagaataattttgaggctttataacatattttttatcatttacttaataaaaaaattctttagaagaaattattaaaacaacaaatttgtttataatatctaattcttaattagaagcaggtagatatatttcaaatcaattgtcagacaaaaaatattatgtaaagttatttatttttccattcttttctcggtactttctctttctttaaatttctgataatgataaatgaa

SEQ ID NO: 35598 - DNA, 1168 bp, Heterodera glycines
  misc_feature (36)..(36): n is a, c, g, or t
tcgggaatgcaatgattcatcgatgcttttccactnccctttggcactgaaattggagtaacctaatagaaaatgcacattaacgaatacaacaagttgcataaagtcaacaatatgtcaaaaattgcatttgtaattcaataaaaaatatatatataaagggcgataactttttgatttatcaaaacaaaaaattcaacaataatttgtgattgataacaatgcttccgggaaaacaatgaaaaatactcgggctttctccatcaattcaatcgagtttcttgaatccaatgtcggaggcgtattcgcggaagcagcgacggcaaatgttcagtgaatattttcgaatgagtccatgatgactgaaacatacgcgacacgagcgcgagccaggcccaaatttgcgtggccgggaccaatggatgttttcgtgaaccatttaatttactctcagttgagtaccaattaggaaaaaaattgctgaaaatatcaaaaaacaaaattcgaatttgacttttgttcagggcttcgatcgtaatttcaaaataagaacatcggagtgaaaaaaaattagaatgttttcgaaattgctacaattatttagtgcaatcttttacagattttacttaaaatttccgaattttgtgattttgatcaaattttcaagaaaataaaggattttagggtccggctgttctgataagcgccgcctgcaaaattttttaaaggtttggctactttttcaacagattttttcgtacaaaatgacaaaattgcgtcaaatttgaaaatttcttgagtgacaatttgccataaaagttcaaaatttatgaataattttaagaaccagaacaaaacgagcgcttgggcgccgcttcgcggcgccaaccgctctgttttattctcaaagaatttaaaattttgataaaaatttccatgtctcatttctcttctcctttatttttctcgcctccctccacccctctctctcatttcctttctctgcttttctctctcacttcctttctccctctctcgctccctttctctccctctctcttcatctctcatctcgctctctcactcaatcaatctccccccttttctttcctcaaacacacataatgaaaaaaaattttcttttccttcactatggacgctcacagtt

SEQ ID NO: 35599 - DNA, 1194 bp, Heterodera glycines
  misc_feature (42)..(42): n is a, c, g, or t
  misc_feature (57)..(57): n is a, c, g, or t
tatttcatacaatttgcatataattccgtacaatctgatatntaattaataattatntccattgtaattttttttacgctaccattcattagctcataaatatagaccggatttttatgtttttacatattttttccgcggtttacttatgataagagaagctaaaaaaaagccattttccccaaacaatttcggtttagagagacttataataacataaaaacacatattttggcgttttggcacataaaaaccatatggaacatatctcggagttttggcacatatttttttcacatattttggcatttttgagaaaaatctgtaagaaaaaacaagaaacttgaaaaatatatccccaaaaattgcaatattttcaaattttaaaaaaaatttatttcgaaagacgaaagataccaaatcgaagttttcatcaaatggtcattgtatttcgaaactccatgctgtaacttattcaaatgacaactttcaattttaaaacaattttatcagaaaaaagaatcatttacccccgaacaccccaaaatgtatctgatttcaattttgctggagaaaaagataaagcaaaaattttttatttcacatacattttatttctgtttttatttgttatttgtattttttaatgaatttaaataaacgtattttagttttattccattggactttgtgtatattttgaggagaatttcttcttatttgttcttttttattaatatgaataaacaattatttctattcaaagttaattttatttcaaaattaatatattttttattaattcttttttaaatttgctttattttttggcaatattttttgatgaacctattttttatttattaagagtcaaggccgcattattatcattgtctagtccaagtccctggtgaattttaaaagaattatttttcatataatttttaagtaatgtttgaaatataataatttaatattttatttatttattttaatttagttatatgtaaataaaattattttaagactttacattatgttttaagttctgtcggatttttatcgttggttctatgagaaacctttttgttgcataaattataataatctttctatttctttttatttattttttactccaaaaatttatcttactatgatttaataaatacttttaaataatcttctttgaaa

SEQ ID NO: 35600 - DNA, 412 bp, Heterodera glycines
aaaagtttaggcttaacttttttttcagaaactgcccattaaggcaccaaactttgcagggatactgaaaggaagagacataccctattttaaatattatctagtcagttcatttaaataatttttatccaaaaaatttttttttgggttttcggggcagtccccctgaaccgatgcgtccagatttatggggaggctgaatccttcgggaatagcttccctatagtaggtactgtaattgtccgtggggttttagctccccatgaatgtttgagtgacccaggagtgcgcttgaaaaagtaggtttttttgttttgaggggcagtcccctgggagcagatgcagacggggttatggggagcccgagtccttcgggaatagcttccctatagtcagtacgttcattctgcgt

SEQ ID NO: 35601 - DNA, 878 bp, Heterodera glycines
  misc_feature (24)..(24): n is a, c, g, or t
aaatccgtgaagagatttctgttnggcaagcagtaatttttttaaattaaaaatgttataattttattattaaaattgttttcctatttaattttaattgttttttcggcactccgttggaccgaccaaaaatgcagtgaaaatggcattgtattttcagcagagaatcgccgtcaaatgcttggctcggcattgttcaaaattcgcttcccgctcttatcaaaagaagatttttcgggaaaaattggtaaaaaataatatttcttttagttacaaatctttttctaactattcaccagtcgtttccatatttacagttccatccggcattttaacaacaaacgaagtggtcggcgttgaagaatatcataccattcagaatttgcaatttccgagtcaccagcgaattaaggcatttggaacattattaatggacattgaaaaagtgtccgaatttgcgggagaggaagttgggagcaggcgacacatcgaaaatgtgtacataagtggactttcatggataatattggcacaaattagaatgaaatggagaagcactgacaatgagaaatgtttgggaatttatcttttgtgcaccgagccaaaagaaggtgcaattaactcttaattaatgctaattaacagcaatgattaacatccattaagactcgaattggcgctgccgcgttcattcggccacttttcgcattgtctcgcaaaagaaaggggcacataattccattggaacactttgcgacaatgtgtttaacaatagaaaggactggtcaggtttcccaaatttcatttcttttgcggtgagtttgacatttaatttattgcttaattgttcaaattatgggcaattaaggaattaatgg

SEQ ID NO: 35602 - DNA, 703 bp, Heterodera glycines
gtgtgaattttcctctgcacttgcccccgtttgacccccggcacatttcccgtcccactttctgcttcctctcctggcaatttcaacgcccgaactcctcgggccttgtcgacaccaccgcggcgacctgcaccgcactcaacgtcaagcgcacacggccaactccaagcagctcaacggagctcaactcaatcaatcaatcaatcaacgggtggtgatcggacatctttcaaaattcaaatttcttttttttcagggatctgttagctgtcaaagtcactgttcgcttcaaattgccttcctgcgtcggactcggctcttccggtcagtgccgtttttgcccatccgacaaaattggggtgaaggcactttgaccaaaattcaattcccggcctcgaacttagtcttggtgcctgattttctctctcaatagattcgggcaaatattttagccaaaaatatccgtccaaatttgtgttccacccaaaatgccaatcccttccctcctcaggagcttattgcgtttgcattgcgcccgccctccttcagacggccggcctaatccccccgccttcggtgtccgccgaatcggacgaactcacttgggacgactcagtgctggacatcatccgcaagtggtcttccgcagccgagtcgctgatccacggccgcgcctctggcctggacgcggccatttgcactt

SEQ ID NO: 35603 - DNA, 818 bp, Heterodera glycines
ggcggggagggtattttaacactcccagggtcaattcattttggatttagtacggtaattttttatttataaacttgcaatattaaaaaatttttctttctaaataaggggacaaattgtgcaattgcgtggaatctgggtccaaaatcttgggttccatatggattggataccagaatagaattgaaacgatttcaatatgccgcttttgatgcacatgaattaacaaagctaaatatgattaaaaaatatgtcgggagtaggtagtgatgaagttgaaagagccgaagaggcctggaaattcgtcagaaaagaatatatatgctaccgtaaaggttttaacccaatttacgcaaaccatcaaccaataattgagaaagaaaatacaatagttccaaagaaatacataatacttggaaatcaatggtttcgaagcgaaagttggaatgatgagcgtacgattcgctatcgttgttcaaatgctaattgccgtgtgtctgtttcgctcaatagaataacccacaagtattcagacccaaaccccgatcataatgatgttctacatgcgtttatacctgatcaaacgttattaaatcttccgtattatgttaaactatagcgcattagaacaatccacaaatattcagaccccatccccgatcataatgatgttcacatgttttgcttcggttgagtccagtcccgtccagtcccgtccatttcgtgcagtaggcggggattgacccgccttctcgccgccaatgaaaaaattggtgacattgccgccgcgccccttgacagttgaagctccgaagcgt

SEQ ID NO: 35604 - DNA, 1459 bp, Heterodera glycines
tcccgcacatctctaatttttgcgtgagaaattcatagcatcgttcaaatcagtcgactcaaagacgccgagacctcctctttgttgtaccatccattgatcgatgtcaataccgccggacatagagaaaggaaaatataagacatatatgttcaccaaaaaaccgaaattgcattcgccgtacaataatcacaaataatattggaccattaaatttttgtgacgaatcaggactgtacacatccttattgattgattatgaggtcaaacttggaaatgaattttttccatgtttaatccagcatacattttatctacgcccactccttttttcataataaaattcatgggatcaactatttcttgttggttacgatgtaatcgtgaatacgcctgaaatctattgctgctcattacccagacccgaattgagagtctataagccaatgtttagcaattccaatgaattgcactacgaccgcttcaaatgaactaactattccgtcctctatcgactattatctttcttatttaatatatctctcgtgcctaccatacatattattctgctggactttgtttttttattcttatgctgagactcgccactggtacactgacactgacacatgaatgtactgatatgaatgtactcgcgactaaatgactgtgagaatcattctccgactcctaaaaccaccttaatactacatcgaatgcattttacccattaaagccaataaaagcaactgaaaatgttctctgtttaggatgcgcttccatcgtttgacaagtgtgcaatttgcattgacaagaacagtgggggcgaatttatcgtggccatttcggactgcaaagggaccattcactttttgactgtccctcggtttgatgtcggcattcacgacgaggaacagtttcgccgagcgttttcctcggtccagaagcattcttccgacgtcacacaaactttggggagcggcgcccatttcattgcgaacgttgtgaacgcttttgtctttgtgagttgaaacttttgaccaagaatgtgttataggaccctttttgaaaaatacgtaaacttttaaaaggcactgaaaataagtttatgagggtttcggggtcgttgaaccgcacccttctcctggttggtacagtccctggtcgtttttttgattgctttgtattttttttttgtttaatttcagtttcccaagcggaagggcgcctctgtctatgcctttgctttgcatccgtccgacaatgatttttccaacttttccgctctgtttaccctcaaagaagacgtgcaaatggtgcgctctgtcggctgtttcgtctgtgttttgctcaaaagcaattcgcaattggtcgtctttgaccagaatttggtgcaagtccatgtgatctctctcgtgtcaaaagaggagaactgtgttattttggactttgaatttct

SEQ ID NO: 35605 - DNA, 960 bp, Heterodera glycines
  misc_feature (893)..(893): n is a, c, g, or t
tttaatgctgtttaggctatcagggactgataaacaattttgaacccgatttttgacataggagcaaatgttgggacacataactgactgaccctgcggaatccggagaaggatgacctcaaaatgtgatatgctttttcaacggataataaattgttttgtttttctctcgtttgtattttattttttgcatgaataaatttcttttgtttattttgacaacatgtatcaattaggaatatttgggtgggctgggaccccgacctttaatcctgaattttggcctgggacataagggaaaagtttgttgaaaattgaaaaaattgttgaaaaattaatttttgagttttttttaactgtgttgaggattttcagttttctctgattttggttcgataaaaaatgcatcaaacaaaaaacattttgatcggaaatttattttttcttttccaaaaaacgtaaaaatgaaaaatatttttcaaaaaatcgacttttcactaaaagaaaaattttctgtttttcgaccaaaatttccagaatttttataagttgacataaattgcaacttttgatggaaattattaaaagcttgggcaaattttagaaaattttcaccgaccgtggaatcccgccaccctgtaccgaaaaggctttcgataaaagcgtgccgtaaaaacgattctggaaaaaaaacatcgaatttcatcgctggactccattcacaaatttgaccgctggcccgaccctccatcaacaatgggacgcgaaaaacatgatttgcattttgaccgaataaattgaaaaaaaattaagcaatttggaaatttttatcactttgaactgcaaaattacagtacaagacagatactgtataatttcccttgacaacttanaagaattatttgaaaaggcatatggcggcattcatcactcccatcatccatcgcctcacacacactc

SEQ ID NO: 35606 - DNA, 868 bp, Heterodera glycines
aaaattgggacaattgccaaagatagggaaatgaaaagcaaagagcaaagaaaattacggtgattgaactgacgggcaccgtcgcccattgtgccgaattttgtaagaaaagcgccctcggcatcgaacatttgaatgcgatggttgtctttgtccgccacgtaaatctgaaagacggcaattagcggaaaaaaacaaataatgaaaaggaaaagccaaaagacagaccagcccaaactgttcatccacggcaatgccccaacactgctgaaattgtccgggtcccgtgccatggcagccgaatttccttttgaaagtgccgttaaagtcgaacacttggaccctaaaagaaaacggcacaataagcgcacaagcaaatgaccaaatgaatgaatgacctgtgattgtatcggtccgcaaccagcaattcccccctcacgccattcacgcaaatggcacaacagcctaaaaagggagcaaaaggcatctatctcaaaaggcaaaatgccttttcttttcaccgtcaaattctccgtttccgctgccaaaagtgccaaaagtgcgcaccaaagtgccgtcggtcccgcggaagatttgaatgcggtgatttgagctgtccgccacggcgaaaagcgctgcgtcaccgccgtgcggaagtgcgcaaatgccacggggccaattcattctgtttttgaatgtttgcgcctcagtctgtcgacctccgctcactcactgatcggatgcggtgccgcgtccgcccaacacaatccgcggtcgcggtcggacccgcgagaagtccatcgccggctccgctccttccccgtccgtctcttcgtcttccatttcgtttccatctctgcttgtctgc

SEQ ID NO: 35607 - DNA, 1548 bp, Heterodera glycines
aaaattgcaataaagcgcgttcaatatgaactgacttattttggaggcataaaagcaacattttccgccaaaatttcctcaaattcatcgacgttacgtggcttacagtactcgcgtccgagaaactcgcaaaaatacgaaatgaatacttggccatgattgaacacactttgttactatttttttttattgggtgtgccttcaaaacgggaaagtacgcaaatctattttttacttcactgtcgcttttgtccaaattgccaattttaattgaaatgttgtgccattttcagatgcccttggggttgaggcgatgcaaaatttcattacatttttccgcgtcggagacgaagcgcaacagcgcctcatcgacacactgcacgtcaatttcattgtgtggtttctgcggcaaaacattggcgaaatgtttcgcatggcgaacaaacggttcgaaatgaccaagggcgacacgggcacgttcattgacccggacaattgggcaaaaatgctgaaaaaggtgcaaaaatcgcggagcaaagtgaccatttgtctgatgtatcaattcggggtcagcgtacacaacttcatgcaacttgtccgggctgaacaccgtgggaatgggtcaatatgctgcacagattgaaaatgcatgagctcatcaatgcgcatgtgggcactttggaattttgagtggccgaacttttttttggcatttttggaaatttggggactaataaatttggggaatttgcatttcatttaattaattctattacttacttttcattaatttttaatcactccctccctctgtctctctcctctctctcccatccctcctctctccctctctctcgctctctctctctctctttgccaaataaaatgaacaaatttgcccatccaattagtcaatagaagcgactattaattttcattttatgttatagccggaaattaattgcgatgatgatgatgagattgagaagttttatcaatttttgatcgattcttccctaattgacacaattgtcggcttttgtctcgacgaatttctcaaaatgtccgattcttttcggcactttttctgccatgagaatgatatgcttgtgctgaagatagcaatgagctcaaaattggtatttgcgtccaatttggtgcatttggaggacgaatttccggaagttttgcgcattggtaagcagagaaattgagcaaaaaaaaagggattaaaatattaaattttttattagagcagagcgggaccgggacgaattcccggatctccgaggtaccagtcccggattttgaaaagcccaggtcccggtgcccggtagagtcgagaccaaccgggaaaacaatttcgtttttaaagttatattaaatatattttcatttcttctttttgcatacttatggttaaaaaaatcgactcaaaatccctaagtttggtgaatgtttggattttataaatagaaaagaaaaaaagaagaaaaaaatcttgtaatatttcacttccggtcccgctctactctactttttatttat

SEQ ID NO: 35608 - DNA, 768 bp, Heterodera glycines
aagtgcgttccatgcgaattgtgctggccaatggcactgaggcatcttttggcccggagagtgccgaactgcgtgccgtcgcgtgcggattgggcgcctttggcgtcatcaccgaagtcgagctgaatttggtggccaccttcgacacgatcagctacaatttcgtcaggtatcatacacatatttcaaaagttgctataccgaacctaaaaaagtcgaaaatgggggggggggtaaaaagtttaataataataaatattcatgaaataatatattgtctctgaaatatttaattctttatatattcatagtcgtccaaataattgtctaaatttccttaaatttcaattcaaattaatttttgaattctttgaatatctgtaatttttttttttgaaattaaataccctattaatgaaacatttatttgatagagctatcgaatggcatatcaagaaaatgaatgtctatttggttactttgatcattttattatttattatttttaaaatagtttgtcacaatattaatttaatatttactttcatttctttctttttttttatctttgccccgttgaaacttttttcggtcggttaacatattttgaaaccaaattttcagtgctttttcttcattttttcaattgttcagtttgccaaccgaaagtctttacgcgcattttgacgaaattcagaaaatgggcaataatgttttgcttatgacatcactggcgaacgaaactttgtgggacaaagtgacgtgagt

SEQ ID NO: 35609 - DNA, 897 bp, Heterodera glycines
  misc_feature (15)..(15): n is a, c, g, or t
agcatggaatgactntggaaagaattcgaacccattcctctctcctcgccttcttcttcagccccgtaattgtagttcgggtcataagaaaccatttcgacgcttatcttcacaatgctcggcacaaatggcgacaattcagtcgtacaacgaaacgcgaatatctcaaacgcctaaaaacactctcaatatgtcaattactgatttcaattgcatttacctgtaagcaaatctcgcgcaattcatcgtcctccaccgattcacacttttgtatcaaaattggcacaatctgataatttataataaaaatattaaatagtttattgttgatttaaacctgtggcaaaaatttggcaaagcgagcgcccgaagtgcgacaaattgtaataacagaaatgataaatgtcttcagggaactgagctcagtttcagaatctgcacaagtgccaaggactttctccacgattcggtcgaattgttcgtcaccaacgacatcggcaagatgacctcaagaaaagtggaaaagtaagaaaaactcaaatgaagggagagtggcaaaaagggaaaagtttaaaaaaagtcagaaacgctacaaaggacataccaagggtagaaattgctcttttgcgcatcgtttgcctctctttttcgagttgaacaaaaagaatattttcaatctttaaagaaaggaattgtaattactataccaaaatgcacagattgtgataagaaacagggaataatcaaaatcgaagcgcaagcaccaaaagaaaattcaacggttttataatgttataacaagccattttaaaactcaacaatttcgaaaatttccaaaagcaattatttatttatggcatggtaattaatcgtatttttcaaagagcaaaaaatata

SEQ ID NO: 35610 - DNA, 652 bp, Heterodera glycines
  misc_feature (588)..(588): n is a, c, g, or t
  misc_feature (602)..(602): n is a, c, g, or t
aatcacaatatatattttttgtttcatttttgctaactaaggaaggcccccaggtgtctgtgggatttccgaatgaaacttggtggtcatgtgttcttaagaaaaatgtctaaataagcacgaataccgagttatgacgtgccaaactttttaaatgaataaacaaatcaaactatttccaaatcgagcagtgtccattggtgaagtggtagtgtgctagtctgcattctttaaaccccatgttctgattccctaaattcaattattttaattaatatttatttttgctttttatgccaagacaattatcaaaaaattgttaaaaacttaatttttaatttattttattttatttatttgatacataaaatactcaagaaaaattaaatcaacttttaaacagcattgttttattgcatatttatgttaaatgtaatttttaatgttaaatcaaaaataaaaaatttatttcataaatatttttgagaattgactttgcataaaaagcaaaaattaaaaaaatggatttacacataattttgttgataaatggtaaaataattttcattttctacgtaatttcattanattgtagccaattnaccggttttggcccatttgcttgtttattaataaatctatgaagaaattt

SEQ ID NO: 35611 - DNA, 957 bp, Heterodera glycines
atgctctacacgataaaagtgatttaaagcgatctgactctcaccggacagttcggaatgttcccttgtcagcacgtcattctatacccataaacattctcaattaacctgcaaaattcaaaattcattaataatatgtttgtttgttattgatcagtaaggttggggaaaacaattttaaattattttttggcccaacttttttttttgaaatttaatgaatttctaataaaataaaaaacgatttgactagagagtgatgcgcaacataatcattttcccgtgccacagacattgctccttgcgcgacgattaccgcggtgacactgatctccgagtacaactcgcccacggccaaaccatctacgggatcgattatctgagcttgttttggtgtgtatgtgttttccaagtggttttgttttttacttggctatttgtccttgattccaaggacggtttccttgaaaatcggcctttaattggcaggaaaactcgccgaacaaatttgctctctcccctccatttttgagttaaaaaaataaataaattcccaaacaaatgggaaaatatgttttacagcggaatccttgcatccatttcttcgaattccgaacccgagttcgatcgctgttcccgctgaaaaaagcgctatgattttttcgaatcttatattaaaaaaatttcgaggcggataaagtgcaccctcatattatctaccgccaatggagccccgaaatttgcggggctcccggtaaattggacattattggatataaaataaattaaaaataaataaacaaaaattttggttttgctaaaagattgtattttagtctgcacatccctgtgtttttataagcgtaataaaatggcaataaataaggtttttattattgtaacattaggagaaggaagccaccataacattcataaagaaagaaacaaagttttatt

SEQ ID NO: 35612 - DNA, 679 bp, Heterodera glycines
gataaaattaaaattttttattaattttcacgcgttaaagaaatttgtaaattttttaaatttaatgtgcagaagaacaaaaaacagttaaaaagcaaattattttatcatttaaatagatagctctgaaatttaaaattttaactatcaaaagatttttcggtgaaggagctcagcagtgccgacaaccaaatttgcctaaaaatttccgaattttaaaaatgccgggcacgtaatttttgttccttttttaatttttcatgtcatttgtgggattttctggaaatttcttaataaaatagaaaacaagaaagaaatagcatgactaagaattgaccaaaaattttcaaaaaatattcttcataagaatcgattttttttaaataaacctttaaatattttcaaagtgccacccacataacattttttaattttttttttctgaatcttaaaaattttttcgagcttttttaagaaaatataggaacagttttgttaaaagtttgcagggaattttaatggatattttctgatacaattgtttttttttctttacaaagtgccgggtcgttactcaaaaaccatcaaaatgcgcgtctcaaaacaactagggttcggaccccgcccccgtcacccccgcccctgccgggggcgggacaggttttttggcctcaccccc

SEQ ID NO: 35613 - DNA, 1013 bp, Heterodera glycines
  misc_feature (874)..(874): n is a, c, g, or t
  misc_feature (931)..(931): n is a, c, g, or t
  misc_feature (941)..(941): n is a, c, g, or t
ttaattcgtttttcctttttgttgaaaggaatgaatttaatgatgatttcagaaaattaatagggtttatttctaaaaattcacacttaaacagttttgaatcgcttaaatataataatataaacgcagtttctcattataggtttttaattcatcatcaaaatataccgcccgaatttctagagagaagcttcagagttttccaaaaaatatgctggtacccaaccacaggcactaaaagaatctttttacaacggcatttcatttttcccacgaataattggcaataagaaagaatttccaatgttttttggcacacctgggcaaataataaatatgcaaaggttttataattttcttattaaaatacttaattatataatggaatttgtttaattcgtttttcctttttgttgaaaggaatgaatttaatgatgatttcagaaaattaatagggtttatttctaaaaattcacacttaaacagttttgaatcgcttaaatataataatataaacgcagtttctcattataggtttttaattcatcatcaaaatataccgcccgaatttctagagagaagcttcagagttttccaaaaaatatgctggtacccaaccacaggcactaaaagaatctttttacaacggcatttcatttttcccaagaataattggcaataagaaagaatttccaatgttttttggcacaccttggcaaataataaatatgcaaaggttttataattttcttattaaaataattaattatataatggaatttgtttaattcgttttcctttttgttgaaaggaatgaatttaatgatgatttcagaaaattaataagggtttatttctaaaaattcacacttanacagttttgaatcgcttaatataatatataaacgcagtttctcattataggtctttnattcatcatncaaatataccgcccgaatttctagagagaagcttcagagttttcaaaaatatgctggtacccaccacaggca

SEQ ID NO: 35614 - DNA, 956 bp, Heterodera glycines
tgaaattaaatggcgattgcgcaccgcacttcctatccttctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaattaaatggcgattgcgcaccgtacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagagcttttgtaacgtataaaatttctcaaaataagagatagtcatttttcttggatataagataaatttaaaaattctctgtgaaattaatggcgattgcgcaccgcacttcctatcatgctcgagagcatttgtaacgtataaaatttctcaaa

SEQ ID NO: 35615 - DNA, 863 bp, Heterodera glycines
tgaccaaaactgacttggtgatcaccttgcatgagattcgttttatgacattcaattagattctgaaatttttagttgttttttttgttgaaaattagaattttttttattatttaccacaattgtgttgaaatctggcgcgtccaagttcagttttttcatgcgtactaatgtgacgagttgacggtgggcgatgagcagtccaaatgcaattatctatcgaaaaattaaaaaaaaaaatttccggtaaatttttttttgtagaattacatttggacataattcattgataactgtgcccattgtttgtacaagaaagtctctgtccgcctgatggagtggcaaaattcgaaagcccaaaaaaacaacaattatttttgtttttttaataaatcagttaaaaaaattgtttgttttttttaccataaagcaccaccggatcttcgttgaatcccttggcacacgcatcaattcgcttatcaataccatcttaaaataataaaaagataaaagtgtaatttgttgcaataattcctaaaatagggttgcaaaccgtctccaaaattttttttggcgattttcgaaatttgtctccgacctcgacccccgatatttcccaaccccgacgttgaagttgcaaccctagtccaaaagcgtaacaaaccaaaaagtgttctaatatcaaagttatatccacgctttgcataatatccctttagcatttggcgagaaaacatcgaaattatctgaaattaaaaaatcttcaaaattcgtccctaaaatattttcctcaataaaaattcatccaaaaattgtcaaattttatttcaaccaacttgattataaatggtatccaattgaac

SEQ ID NO: 35616 - DNA, 1022 bp, Heterodera glycines
tggtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccgataaatgtttgagtaccccgaacggacacttgaaaaaatcgatttttttgtttcgataaatatttttttcggaaagtgctctaaagcgcaccaaattttatttacaacttaattttagcactctgatgctttagtatcaaagaaggagagatggagaaaaaaatttttaaaaaatttttctattatattttggttatatcgtttt

SEQ ID NO: 35617 - DNA, 1145 bp, Heterodera glycines
gggtattatattgtaaaaagtctttttttccacaatatacttctcataccccatttttcgcaccgtgaatgttatttttattgaattctgaaccggtctgagtagattagagtacaaaaaattgaaaatttcgaaatcatgtttcccactcccttctctcaggggtattattttgtaaaaagtctttttttccccaataatcttttcatccctcatttttcgcaccgtgaatgttatttttattgaattctgacccggtttgagtagattagagtacaaaaaattgataatttcgaaatcatgtttcccactcccttctcccaggggtattattttgtaaagtctttttttccccaataaacttttcataccccatttttcgcaccgtgaatgttatttttattgaattctgaaccggtttgagtagattagagtacaaaaaattgaaaatttcgaaatcatgtttcccactcccttctcccaggggtattattttgtaaagtctttttccccccaataaacttttcataccccatttttcgcaccgtgaatgttatttttattgactccggaaaaattttgtaatttttaatgtgatttgttaacagaatttgcccacaaaaatggccaattttgcaattttatgcaaaaattttaagaaaattaaggatttttagggtccggcggcgccgccgggggaaaaattgagaattttgaccatatttttagcagattttcattaaaaaattctttattttgtggttttttggaaaatttaacaaaaaaccacaaaaagcctcaaaatttctgaaaaacccacaaaaagcctcaaagcctcattttgaaaatttagcctcattggcctatcaaaaaaccacaaaatgaggctaaagcctcagatctgcgaaccctgatatttagtgctttttttaacttaacgtattatctctaattatccccccccccggtggattattgttcaacctcctcagaaagggggggggattcttagatcctctcaaatttttccggcgcatggacggtaaaaaagaaaaaaagcggcaataaatatttttatggataattattggcgttctgttgaatttactttttatctttatttctctcaatagggtgtactatct

SEQ ID NO: 35618 - DNA, 569 bp, Heterodera glycines
caagcaatcaaagtcggcttcagttcgacgcaatcgccagtggttcccctcttaatcttcacggcacggtcgtgcaaagtgctgggcgatgagtaaccgactcggcaccctttggacaggcaaacgatttcggcacacacttcaagaatatgtgccaacggcaaatagccgataattgtgtcgctggtactgaattgtctgcagtctggactaattgtttcctgcttattcacctgactgaaatgacagcgctctgtcccgatgccgccgtgatgatgttgcggtgcgacaagagcactcctttcggctttccggtgctgccactcgtgtacatgatcatagccaagtcgtccggttccacatttcgctcgagttttgctgtaattaaaaagttaaagctgttcagtggattgtcagtgcagaaaaagagaaaacaaagagaaatttggtccttcgctatgactgagatttttttttttggcttatcaaaagcacttatttgctttttattaaggaaatgggcctcattcagagtttatccttttcgaccccatcttttccaagagttt

SEQ ID NO: 35619 - DNA, 611 bp, Heterodera glycines
taatatgaaaaagaatattgtcaaacaaaataacaacatttcgtcccccctggagcaacccctgtctggaaatgccttcctgatcatttttgtagagttcgaacaatgttcgacttttcgaccttttgttcgaactcgttattttcagcaatcctgagctgtcaatcaatttacaagtctttaaactcttttctgaggtcttacaagtgctctgtgagcgaaaataacaaatgaaatttgttcgaactccaaaaagtgggtctaaacgtcgttttggagcaaaaataacaacatttcgacccccctggagcaacccctgtctggaaatgtcttcctgatcatttttgtagagttcgaacaatgttcgacttttcgaccttttgttcaaactcgttattttcagcaatctagagctgtcaatcaatttacaagtctttaaactcttttctgaggtcttacaagtgctctgtgagcgaaaataacaaatgaaatttgttcgaactccaaaaagtgggtctaaacgtcgttttggagcaaaaataacaacatttcgaccccccttggagaaaccccctatctggaaatgtctgctatcgatgctcaagtcggca

SEQ ID NO: 35620 - DNA, 1414 bp, Heterodera glycines
  misc_feature (1382)..(1382): n is a, c, g, or t
ttttgcctggccgcaccaatttattgaacctttataatatttattaataaatatataaaacaattatttattagcatgcaaaataaggccagactaaagaagaactgagttgacctgctgagaaggtcttcgaaaagccgagaagacatttgattagccatcacagagccaaaaactaaacagaacgggtaaacgaagccaaagagaacatttgcaaatgaaaaaggcatccgacattttcatggtacggtattggaaacagaatcacggctggacatcatcagttaacctgttacggtaaccataacctttaactggggaacccggtttttaaactccgtattcaaccctaaaaatggcgtttcttttcgaaatttcacataagagtcgtttcaattcaaatttcaatttggtgctcaattaggcacttaaaatgtattttaatttgtccaaatcttaagcgtcggattatccccaattgtcgttttacctttcatagttaaagttacaaaactaaacactatctacatacatattaagaaattattcaaatacaatatgtattcattaccaaataatgtggtgaaaataaaatatggatggataagcattgctaagcgaatgaatggacggacgaccgggggggggggggggacttttcggcaattgacaagtggcggtggtgggaatggaaggaatgggtcggcaaattagttttgccaacgaaaaacgaagaaagaaataagaaaaaaaagagtgggtttgctattcaaaatggaatttatacgttagaaaaagcataaattaatctgcgaattgttttcggatgattggtcaatggtctttttcctccgctgacaaacagcagtaacatttatttgcttttgcgctaaaaaccagcgcacattcgactacagcgtccgtaggtgtgccgagactccggaagaagtccgcgcgtgatccgcaggtggttgagggcccccgcattcaaccgcctgtgacgctcgtcagactgctttctccgctcagatggcatcagtccgaattcaacccctattttaagacaatcatcaatagctttctaatgataccaaattattagcttctcaagacgaattgattggtacgtgattagcagcaggctgggaaggattacagggatattttaatcccgacatcgggatcccgatcccgaccgcaaaaaaaagagccgggatcaggatcccgggaaaatctcaacgggatcccggtccgtccgggctctaaaaaatagccaccgttctacagggcgattgaatcggaagcaaaacgctaaaaaaacatcaagcaaaattggataggaaacgatgttacatagtatttaaaaagtgaaaatgcacganagaagaataaaatgtctcgcctttgctttgac

SEQ ID NO: 35621 - DNA, 622 bp, Heterodera glycines
cagaaaatttcgaactataaaaaagatagaaataaaaaacttttaaaattctgccttttttgcggttttcaactgataacttttttgagaattgattaatcactgagaaatagcttataaatatcttctaaacatctagggctttcgaatgataccatgattgtgaagtttggccaacaaagaaaaaagttatagctttttgaacattgctgagacggagttggccagacggagttgacccctaccgataaaattcaaaaaatcgctgaaaattttttcaaaaatttcatttattttttcttgaaattggttaacacttcctttacctccaactccgtttgatccatgcgccaattccgccgtttgatcgctttggcataacaaatgcataaatatgatggataacaatgtgaatttggcgaattcgaataaaagcatttctattgcttatataggaggttctaagtacacttttaaaatttttaccaagactcaaaaaaggtcaatacttttttgaaaatttgcaaatttctgatactcaaacttacattaagatagaaaaattcggcaatttgtacccctcccctaccccccccccctgtgtttaaagtagggttgagcg

SEQ ID NO: 35622 - DNA, 1034 bp, Heterodera glycines
ataaaatttatgacaattagccggattacaacacaagcaataaaaaaatgtgaaaataatatcatgtgcaaaataatttatcgttaataaattatattattgtaataataatttttcgatgaagttaatatctttataaacaacactaatgcatgaaagagtaattaataattatatttttaattaaaagcaatgaaaattaaagctgattaaatgtttaaatcaatttaatattttaaaaataaatttgaaatataaaacaatataattaatttacaaattttcacattatctcagacatagcgataaaattatgaagcgacaactgtcagacgtgcatggcatggcatacatgggcgcctgtcctcgcactacgacacgagcgttttggtaaaatcaaaaacaacaaattaaaaaaatattgctataaaatatttaatatttgacgaacgaggtaataaaagaaaatatattttttaacatattagaagattataccatcatagccatgatatgtaataatttgagctaatttgtgagactaattgaagaataaatgactgatttagtttaaaaatatttaataacaaataagaaattaaaaaaaataaatagcaagctaaaaactgcgaaatgtgataaaattcaagaagcataaaaaagggcgcatacaacaactactcgacattagaaatataaattcgcgtaaatattttaaatattattagtataaaacgatattttaatacctaccagtgacgaaacaacatgataatatcgagggaccttatcaaattaataaataaaaataaatgtcaaaataatatattgtataaattaaagtaaaatttaaaaagatttcattaaaaaaatatatttttaaaataaaaaatttaataataaaactactcaaaaatggaaaaaatttcgattgaatcaaagtaaaatttttcatgttattaaaattaataattgcaaaaaaacggcaatttcagatggtataatatggcaaatcaattaaaatgagatttaat

SEQ ID NO: 35623 - DNA, 875 bp, Heterodera glycines
ataaataaattcaatttaaggtcaacatttatcgactgctctcaaagggtctgtggaagaagagatcgttgaaagggccaaacagaaattagtgctcgaccatttggtcatccaaagaatggacacaacggggaaaacagtgctctccaaaaatgccatcaatcatatcccattcgacaaaaccgagctgactgctattctgaaatttggtgctgcagaacttttccgggaggagggtgaagaatcgcaggatcttgagcttgacattgatgaaatattgaacagagcagagacgagagaatgcgagaacatggagtgagttaaattgtggtgtacacagcacaggcaatctaaagcattaaaacaaatgtaaacacaaattaagatcagcgaatgatttgctcaactcattcaaatatgccaattttaccattgacgaggagaaggatttggcagaaatttcgcagttggacgactcaggcatgggcgagaatagtccaaaattgaccgacaattcgcttgacaacagcgtgaaaagggacttggagaagcaatgggatgaaataatccctcggcaagaaattgagcgattgaaagaaatagaacagagcaaatcgggcgaaggcgacattttgttgccgaggaacagaccgagtgtttcaaatgtgaattacggagggttcactgatgaatcatcggacgatttggacagtgaggggagacggaaaaggaagaagaaaaacagcgcaaagaaagggaggtcattgaaaaaggcacgagtggacggggaaatggacaactcggaggaacgcaaaatgaaaagggaaggaaaggaacggaagccgagaaagcggaaagaaaagagcggcgaggag

SEQ ID NO: 35624 - DNA, 1458 bp, Heterodera glycines
  misc_feature (1414)..(1414): n is a, c, g, or t
ttttcttggtccatcaccgtttctttactcttttccttcttagtttttggtagttgcagtttacatgccatatttcctatacatttatgccaataagtgggctgaaattagatactggtagtttaaggggttcactgatcatgaataacgaatcccgggcccgtttcgaacaaaaaaagtcaaggattcaaacaaaaatattttaaacgcacccaaaaaacttaaggcaaacggaggttttctatcaagttgtggaagacattcaccgattgtttcaattgtctaccaattgctgctttaatcgacgagaaaatcttctgttgtcatggaggattgtctcccgatttacaaaatatggaacaaatccgcagaattatgcgaccgacggacgtcccggacaccggtaccacgcctaacacaagatagttgtttttagtgtgttgttcaggacttttgtgtgatcttctctggtctgacccggacaaagatgtgcagggatggggcgaaaatgaccgtggcgtttcattcacttttggcccggacgtggtagcaaagttcttgaaccgacacgacttggacttgatctgccgtgcacatcaggtcactcaattttatacacaaactcgcaggggcgtatctagaaacatttttcggggggggcccgacctgaagaccttttttttgggtaacaactgcactttttcactaaaaagacccaattttggccattttaaggcaaaaaacttgtaaaatagtggaaaatggaggtccggcggtgccgataggcgccgccgggaaaaatttttggaaatttgagtgttatttgttaccaaaattgcctattaaattttttaattttcgtttgggggggggaattcgaaaaaattttccatttttagttttaatagacatttaaaaatttaaaattattttttccttattcataataaatgtatacagaaaatgatttgccacctcaattcaaaaaacgaattccttatttacttacagtctaattttattgtaactaactaataacgaactcatttaccatggctttgattgtttttttatttttctattttttatatagtccagcaaactaagtttatgtaattgtcgtataaaaataataaacatggaatacatgaaatgtaaaaaattaaggtggtggaagacggctacgaattcttcgcaaaaagacaattggtcactctgttttctgcgccaaattactgcggcgaatttgacaacgcgggtggaatgatgtcggtggatgagactttgatgtgctccttccaggtgcatttgtgtgggatgagaacaatcgcatgtgataaacaccttttgcagattctcaaaccatctgagaaaaaggcaaagtatcaatacgcgggcctcaacagcggaaggnccctgccatcgccagtccaacgaaacaaccaacagcagcagggg

SEQ ID NO: 35625 - DNA, 1450 bp, Heterodera glycines
ttattttttgtaatttattattataataaaacaaccggttcagtgtcactggctcggcaacaaggcaaattttgtccaacaaattcatttcatctaatgcctttgcaatcaaaccaattcggtccgccggaagtgaagatgagtcttaattagatctaagacatattggaaaaagccttgaattgtgttgtatgttggacctggacttgactttctagattgaccaagagctactgcccaaaatctcagttccaggaaaaagttcttggacaaaagcccaggaaatccttggtcacggaaaaatccagtttggttcaatcttatttctcatgtctggatgcgttaatctttttttcaattgactcaattccgcaaatttccgacaaaatttcttatataaatttatttcacaaattagtggtaagaaaagatctattccattcggctcatatttcttaataaacgttgtttcttgttccatggtcccctttgtttctcttaaataagtacaaccgcgatccttgcagtatcccattggggcaacttggatagtgggggggcacaacgcaaggcaatggacgaacgaatgacacacaacacacacacacccacacagctgagagtgattatccatcccccggggggaaagacgacggatatttacaatcagacgaattggcgtttgataggccaacaaaaaacaattctcgggaatgaattcgagaaaatttgccgggaaagacaattcattttcactggcaacggagagtaattaaagaaaaattggaaaaagaaaaacaaaattatgaaagcgatgaaaaaagaagagacacataaagccccacacaatcaatttgagggaattaatgaaaaaaaaaattgggaagaaaagcgccgctccccgggggcttatgactgatgagcgatcatcgatcatatttttacccggggcgatgtttgttgtctttgtgtgcccgctcatttagcagcatcgaatgcactcaatcggcacaaaacaaatgtgcttttattaagaagcatttttattaggcaatttgatagccttaattagttttataacagttaaaatataaaaagccgttacaaattgtttaattttgaaaaagatattccagatttcgctttcgaaagttttaagaaatgccaaaagcagttttacgaaggggggggggagagcaaagagtccggcacaaaagaggcgtggccatcccccggcggggaaaaggcgaactttgacaacgaatggaagagaaatgaatttgcacgagcggagggagggacgacaaccaacgacataatggatggatgaataatgtgtgcaattcgtcgtcggatgtgatgagaggggaagggggggggggggagggagaaatgaatggaattacgggtggttaatcgcatccttttataccccccggagggggggggg

SEQ ID NO: 35626 - DNA, 1613 bp, Heterodera glycines
aaaaagcgcgcccgaaaaaagtgctttaaaaattgacaaaaaaggtcgttgcattgcttggcctattcccaagctaaaatataaattataaaattttttcgaatttttaataaaaatttcaaaaatttgaaaaaatcccagtcccggcgggatcccggccaaaaactgttaccgataccgggaatcccgtttaaaacgggagtccaggtcccgggtcccgtcccggttcattttccaagtcccggtcccggcaatttcaaaattccggtctctactttaaatcatttattattttctcttgacaaaaatttatgttttttatttattaatttaattatttaattaataggtttatttattttattataaatgaattatttattaactcttgtctgtgtccagaactttttggattttcggcggaagtcatttaaaattaataatttagaaaattttgatttgtgaaaaaatttaaatggatctcatattgataaacaaacaaaaaaagatattttactaaaagtttcaattattaattgttggtataataaagtgaacttattttcttttattttaaatgtttgttcttaatacaaacgaattttcaaaatcgaatgtttattttgtttagttgtattcttgtaatagaatgcaaataataattactatatttaaatattcgaataattagtaaattttttatttgtttaagtaaatacagaaataaaataaataatcaaaatattatttattgcttttaatctaacgataattaacaatcatttgctaaaaataaataaattatttgtttcattgttattcattttatttgaatagatattttgtattttattgataaatatttgttttccaactaaataattgctttattctttaattattcatttcacataacttgtccgcttccttataattatgatccatatctgctcggaatttatgatttgtttatgtatatttgttggtaatataacatgaagatacatttttgtcttaaattttgacaaatatttttgtttatattttttatcaatttatttttaattcacattgaaagaatttaaaaagttattatcgctcgaacttattatgtgttttatacaaaaaataatattattatattatttattatattagttttgtttggttgcatttaatattttatttaatttacatttcttcaatttctaaattgaatttattttgtaaatgattgaattaagtgaaacaatttaaaaaataattgaaaattttttttctggaatttcgtacataaaaattaattctattttcatgtccatataaaatagacaaactcagattcatcactgaactgaaatgtgaagaaagaataatacaaaatggtttaaggtctatcatatggacaattgggacatttattaaaagtccaaaaatgaaaaattgttttttgatttttcatcattaagtttgtattaataaaaattttaaattattaatatgttaaaattaattaaatgatgcttaaatacagattacttcaaaaatgtgactctctcgttattaattatcattgatttattatatcttcgtggcttaaaccttggcgaaag

SEQ ID NO: 35627 - DNA, 1221 bp, Heterodera glycines
tcagcaagcgtacttgcaaatgtgccgccaaatcgggcttctagaaaccggagagcacttctggattcctccgcagttcctcgttaagagcaaggaagagctgatagattatgtctatcctaacttccaacaactccttggcaatgacaaggagctgctcaatcgtttgattctcgctccgcacattgacacgtgtgatgaagtcaacgagatcatgatggcgaatgtgccaggtcaagtgcgggaatacttgtccacggataagccccttgacgaccggccactggacatcgatgagattgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaaacctgcattcgctatgaccattcaaaaaggtcagggccaaacaatccgcactgtcggcattgatctggaaagggaagtattttcccacggtcaattgtatacggccttctctcgggcaacggacggaaacaatgtccgtgttcatgctcccaaccgggaaattgatgcccaaggccgagccaaagtgctgaatattgtagctactaatatgctcaagttacaataattggcttagtccagagcagttgggcacatggtttttggagagatgccaatcccattcccatctgcactatgttgggtgcgaaaatggtgagaagcttggatccgggacatggaccggtcagccctctttagggcctacaggtgaattgccatttagcgctcaacccaataacgtgccaacgcctggactaagggagggaggagggatgacgtgcaacgttagggcacttccggtttccattgcattatgcgatgtgtcaactccaattattggaggaaaccaagtgcatgtcggctgacgcaaagaccctaacagactaaaacgcgcctaggtagcgaagctcaagaagcgcgcagcgctttccccagcgccaccctcgcatgcacacacccgctagt

SEQ ID NO: 35628 - DNA, 1222 bp, Heterodera glycines
cagaatttgccaacgaattttgtcgcattgtgcgttctttttgaattgagtaaattgggattttaggcgttaaattaaataggaccttagattcgagaatttttcaaaattttgacgaataaatcccaaattctgccggcgatttaaatgccaccatttttagcgttacattgacatcggtgggagtgaaattgtgcctctctcgggcgtgctcagaatgcatcgggaacacagccgaattgtgccgctttgcatgcagctgaccctggagagtataaagccaccgaacagagccagcgaatggctgcccaaagagtgcacttttttccgcagtttaatccgaacggacagagcgatgagctgtcgaattcgacattcgaaccaaaggtgggcctgccctttgaaaagggacggatgtccactgaatcctttctttggtagcgccaattatcagccgagcagttacaattcgtcgccgcaaagatggtcaggagtgtttggcgtcacttctttgctcaatgggaactttcgagtggaagaacaaatggtcgggggagttgagaacggagaagggaatcgcgaagtgatggccgcgtgggccaacctcgagaatgggttccactgatgcgagagagagagagatttctttctttgtctatgtttccgaatgaatggctcaattttcttttgcctttactcagtgttcgcaagcttttctaacatgacaatccaagctaattcaggtttttaaaataatctcttgcactttgctccttagctgagaattttccatttcgaatatttacgaacactgctttgttttatttgtgctgttctcttctcattttttctcctgttttttcctttgtaagacgattaccaattttttttattcagtaataacattttacaatttctctatttattgtatttattttttacaaataatcagtttttacttttttttttttttgtagtttttacatagttaagcgtaatatattaccgttaatccatgtttagagttcattatctgtcccatcatcttcgaattgccggttttgtttctctgtccttccctcgcctctttctctgtccattgcctttgtcccgttgtccccattggctgcttaacattgccaataacatttggtcgatgccgtcaacgagaagtgacgatgaattccgtgggagtgccataatgggcattggtgccacctcc

SEQ ID NO: 35629 - DNA, 960 bp, Heterodera glycines
ctaaagtgcaatagagccagggggtaaatccgtctgttgccagttgtttcgtatctgtgcaaaatttcaaaaaatttcgataccgggccatgaggctaacgcgcgggattcccattttttcattaatttttttttatttactttttcatcaatcattcgctgtgcaacatcggtcgccttttggcgtgccgtttgctcaacaaatgggtccacttgcattgttcggggcaaatcttctggacagttcgatggcacaaccattggttcaagaccctttagaaagagatttaaattttatttggcattattttaaatttaaaaattttttattccttgttaaaggctcacgaggttgtcaacaaaactattgttgcaggttaaaaagcccaacctcatttccttacaatatttttctcccaaaaaatagttttaaatacccgaaatatgtaataattcggtttgtttgagttttaatgtgcccggactgaattgggcaattcattttttcgagagttagcgtggaagcgtgtaagtcagtcccaaacttgattcatcgttttctccctaaattctaagccaaacacatttgagaatttttccaaaaaattatggaaaaattagtgatgaaaattagagtcaaaggaaaaaaaaattaatatattctttaaaagtaacactgctaaagtgtgcaagtggcttaatggctagtctccttgactttcccttcttcttccacctggttcaatccctctacagaaattaaaatattttgaattttctttttttgtatactcgtgggtttcctatcgacaaaatatgattcttaattttttaaattgtattttatcattttttaaagaaaatccatacaaattgagcctagtaatctcataaaccagcctttttttgttgaaatttgttaacaaatcacactcaaattttcaaaattttccccggcgg

SEQ ID NO: 35630 - DNA, 1767 bp, Heterodera glycines
aattagtggagtattagtagattgggttttaacaaaaccgaattgattttcggatattaatttattcaaagaaggaaattataaatgtttttgcatttattttttcataactttacatagacagcaagtaagagaaaggggtctgtaattatgtggatcatttcggtcacctttcttaaaaagaggtataacaatagattttttgcaaatttcaggaatcttgcctgtgtacctgtatattatgaaaagttcggaaattacaggagacagagtaaggtgtctactacgtaagattctataggtattctcatcaggggatgtggattgttgattcggtgaatgatgtacgatcatagatagttcatcatcagggcatcagccacgacacatacggctggcaataagcacagaagaaaagcgaccgaccgacgcccgacggcagcggctggtaagaatttgtcctcgtcttcgtccgctccgtcgccgccgccgctccgttcccgaccgaacgaaacgaacggacggacggacgaaggaatatttatgtaattgacgagcggcgttccaattccatcagaaaaaaagaattctttccctccgtcgttcgttctcctctttttacacacacacaacaaacacacaaaatatccctccgttcatcgacaaaaaatctccacaaaaaaaagaaaaaagaatcggaaatgcactaaatttttggctaaaaattttgggaccgaaaatggggagggaaaagcttcaaatttcatcaattttatttaaaaagccctttccctttagaatttcccgtgttaaaacattgttgtgtattggtaagataataaagcggaattttaaccttggttaattaatatttttaattgactgaattggttaacaacttttcgattgtttaattaaaaacatgaaaaaagcacgctttctcgagacccacgataatgatgaccttattttacctgaaaaaagcatttcacaaaaacgaatttgcttatttgattgaataatattttacggaaatcagaaatttaattctataaaaataaattttaattttaaatagaacaggcaaagaccggcatgagaactttttgaaataattaccaaataatttgcattatcatcgaccaaattttgcattaaaataaatgacccaaaaacacacagattcttctcagcaattgcggaaaatttctgcctgatttaaaccggtcgcaccattttatttctcagggtttctttgaattgaaaattaaattctaccttaaaagtgaaaaaaaccaagaaaaaagtgataaaaatctcaaaaagaagaaaaaagttaagaaaagccaaataaaacatatgtaagaatcttcaaaaaagtgtaaaatactttttaatcgttttaaaattcccatccctaataatcgcaatttgaatcactaaaaaatgtcattaaattttcgttggaactattaaatacattttttacttattaaagaataaaatagcaaattttaccttattctttgcgctaattgttttgctgcactttcgaccaaaggcttattacagtaattgtgctaccgacgaataccgtaccaaaggtgagaggaaaccctttctattttaataaagaacattttcatgagatttttggaggtatttttttgtctatggcaatttttaaaaaatgttgctaccaattcaatttaatgtacgagtataaaaagggcacggaccaacccaaatcccattataatccatgca

SEQ ID NO: 35631 - DNA, 2003 bp, Heterodera glycines
  misc_feature (1847)..(1847): n is a, c, g, or t
  misc_feature (1913)..(1913): n is a, c, g, or t
  misc_feature (1918)..(1918): n is a, c, g, or t
ttcatcccttttttgcccggggaatcaaccaaagttaccagtattgggggcctgattaactatttaaattattttccctttggatcggggttagtttccctaggttttcctgtattttccaatttattaattttttccggtttttctgtatttttgtatttttaaatcaatacctataatatttccccttgattaaaattttttttgttaatgctatatttttcgttttccttcattccaatggaccctgactggaaattctaatacaattataggtagagcatgaagcagaacgatatcccgcgcgagaatttacgatttaaattaaattattggttttaattcaatagaatatatgtgcgtataactttataaaacattaaaactattaagattaaattaaattaaatttttatatttttccgtttgaaatttttcttccaagaaaagtttattgccatctgccgcattcaaaacatttttatttctctttaaattcagatttgtttttgtataatgagcctgttgggcgtatcaattttgttgcaattttgctatttgcactataaatgtttttttgctaaatgaagtactgaattaaaattctaatacaattaaaggtagatcaataagcagaactggatcccgcgagagttttgcggtatccaggccacaattataaatttcccgggattaatcccgctggatcccgtctggtaacattttgagtctcaatcccgcagaaggacacgcaatttgctttttgtgcgtgaacccagcgggaccagtattgaatttttttttgttgagaaattcaaaggacattatgccaaatattttctattacaataaattcaaaattttgataaatgttaatattgaattatagaaataaatttatcataataattagggatgtcaaaaatatgtacaaaaaatggtcaaaatatgtacataatatgtaaaaaaaatcccgaaatatgtaagaaaaacccaaaatatgtaccaaatatgtaaataaaatttttaaaatggttatttttttggaaaaaaattcttcggaaagggtgaaataggcacaaaatgccatcccgaaatatgtaaaatatgtataaaaccccgaaatatgtaaataaaagtccaaacttttgtttgcaaacacaaaaaagaaaatggttttcctactaattagagcatggagaatccaggaaaaaaaatatgtatttacataaaattgacatccctaataataatatttctaaacgatggtcgaaaataaataaatatgccaacttccattctttaaattcataatcattatcaataaatttatttttaacaatattttatttaaaagtgtcttgtttcttttacattttttattattttaatgtaaacatgtaatttgtagtgtatacaaaaattttaggcataattttaatttagtttatagatttttttaggattaaataaattattatgccttgttgtgaaaaaattttaaaaaataagctcaaaaatttcaagagaatgtaattttaaaattaatttaatttcgtttcccaggtagtatagtggttagtaaccgcgcctgtcacgtgcgagacccgggttcgattcccggcctgggagttaagttttgtatttattaaaataaatttcgtcaaaaattaaagttcattaagaaaacattctgtacagtgcgagattgtttcctcaattactagcatcaattagaaaaaaaattgcttaaaatgtgaaaaatttaatttgggttgcgttaaaagaaatgtcagtgaaaagtaaaaaaaaactttctcttgagacatcaacaaaatttttcaaanatttagaaaacgttttagaaataaatatatagctttttcaaaataataaaatatattgattaattnattantttataaaatattatccaaatgattctgttcattatttgcttttttcaaagattttctcatgaaatcaacaaattttttcaaaaa

SEQ ID NO: 35632 - DNA, 639 bp, Heterodera glycines
tgatgactaatatctaatcatttactctttttctcattgtctttactctttttcttctatccctcttctttgcttatagccatatgacaatttgcctggggcggtccttccctttgtctcctcccccaatttgcttgtatatgcttttcctttgtccatacacacatcactccacctggccgttggatccggatcccgaccccctcccttccccgctccgaatcggggaagctcaccattgttaaacatgtaccttcggaataaaggatattattccacgtattgtactttctgtggtgggcttatcaaaggtacgataacaccataatcatggaggtcccgccacgggaaagggagaatgtatttaaattttgggctgtaaatatgctacacacttaataaaattattttattagcaagggatcaaaaaaatattatttaaaactttaaaaaataaaaaaaaataaaagaaaaaagaagtgactaatcccaataaatggaagagataaaaagagtgatccatccgaaaaatggtagagtccgtgtgaaaatgtaaaatgccgatgtgcttcagacaatcgaaactgaggcaggcttaagaaatgaatgttgaatgtgacctcggtaaaagggtagagc

SEQ ID NO: 35633 - DNA, 1184 bp, Heterodera glycines
ttttatttacaacttaattttagcactctgatgctttagtatcaaaaaggaagatggagaaaaaattttttaaaaaattttcccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcgaaggcccccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaacttggcagggatactgaaaggaagagaaataacctattttaaatattatctagtcagttcatttaaataatttttatccaaaaaatttttatttgggtgttcggggcagtccccctgatccgatgcgcccagatttatggggagaccgaatccttcacggaatagcttcactatagcctgtacattaattctacgtaggattttccctccccataattgtaggagttccccagcacggacacatgaaaaaatcgaaattatttatgggttcggggcaatccccccgcaccgatg

SEQ ID NO: 35634 - DNA, 1424 bp, Heterodera glycines
  misc_feature (300)..(300): n is a, c, g, or t
ttaacaaaaaacggaatttaatttttggaaaaataaacaaaagtattttaaagaaaccaagccatatacataggttaaacgcttttgtgcggcatgctttttccaaaaaacttttcgagtacagggggcagaacaggggtggcgctaatgcgatttgttagcagattttttcctaaaaatgacaaaatttacgtttttgagccaattttgcgggggaatgagtcgcgggggcgggggcggggctgaggccaaaaaacccgtcctgccccgggaacgcaggcgggggcggggccaaaaccnctaataaaaattttcagaaaattttcattaatttaaaaatattaccaggaaaaaaatttaaaaaattacccatgactttaatgaaacttatttgttagtgaattttttaaaatttatttatagagaacactttgagttattgaatgatagataattgggtttcttccttggcacttttacaaaacgatcagcactatttaacgaattttgttaaaataaaactttattaagtttatttgccgacagaacagaaatagaaatgcatgaatgtggtgaaagaatttccatagccaaatatgatcaacaaggatttcggcgaaatcaaattagacgaaactcgaaaggtaatttaaaaaataaaaagatctttaattaagatttttagtatttaaaaataacaaaacatttttaattcactttaagacaattttcaaattttaaaaagtctgaatgaatataaattttctgtgtatgaatcaacaaaaatgttgaagaaaatttacgaacaaatgaaagaaatctcttatggtaattacaattcttttcatggcaacaatcaaactgaagaaaaaatgccaaaaataattggagaattaattgagcaaattcataaagatttcagaatattgcatgaagtaaaaaaattcgaattttacttattaaaaattataacggattattttgaagaatgtgaatattttcgactacaaaaatatattttggtaaatttggagagaatgcttaaagaaaacggaattgcaaatgaaaaaaacgaatatcatgcgaatgttgacaaatttattcaggaaaaatttgaaaaagaatgcaaaatgtaagatttaaaagtgaattgaaatggattaaacttgctacaccttggaaaattttagctgtgcttatttgcaacaaagtacttgtaaaaaaaaacattttgcccaagaatgtaaaataaatttaagtttttggcattctgtcaaaattatttcattttttgctaaattatcagtattttctcagaagcgcaaaatttaagaaagcttttggccaaaatctgttaacaaatttcatttaaatattcaaaaaaaaaaaaattccccggtgccgcttatcgcgcttatcggcac

SEQ ID NO: 35635 - DNA, 594 bp, Heterodera glycines
ttctaatttttcaaattattcctttttcgataggaattcctttaaaattttaacatttaaaatcataaaatattgtcatttttggactaaatctattaacaatgtgcactaaaatttcaaattttccccgatttgaaacaacaagaagggatggcccagtatttgaaaaggtgcaaactaccaaaaatgagtgcatcgttcaaaaagaattgcagtagaagggaataattcttaattgtgatacgattaaaatattggaatttgtctttacagatatttgacctattatatcttataaatgttattcgcgagaaaagttcctaaataagaagagttatacagaaacagaatatatcggtttcatcagaatgactactgtaaatttttgctaaatatcgtatgtagattgaaagacctgaaattgtgtcgctaccgtttaatcaccccctcgtcccgtgaagggatgttagcaattcatgcacatcctactgatgccccggcacctaaagggatatgtgtcgaatacactcaagggccgctaaacaaaatacccccgtctcaagacatggactgatagctcgacttatccattaa

SEQ ID NO: 35636 - DNA, 731 bp, Heterodera glycines
ttattcctcatcaaaacgccaatggatttgatggtttgaaatcactaaattttggagggaatgcgacggggggggggaaaaaatctttaaatttcgacacggagccaaaaagagaatgcaatgctttatcatgctcatcagtcagaaggctttgttctgctgatcaattttaaaatatttgttctcctcactgttttttcttctccaattccccccccccccactcactttgaattgttttgccgaatttgcgccattggccgctacccaaggcacgctgaaacacattctctaagcctgaaagttaaaagcaaaaattcgtaaaacaatattaatggagaaatttttggagagaaggcgaaaagggacaaacgaaatgaaacgaaacgaaacagcccaatgggaagagaggggggggggggaggaacaaaagccatccgaaaataattgctgaattatccaattgtaagtcactgtggcaaagccgactacacttctgcgaacagtttccgttgtacgtccaaattctcagaaattgcctcaatgaccaaatcggcgcccgacaccgcctgcgaaatattcgtcgacaggtaaataattggaaaagaggcgcgggtgacaagttgattctgggttctaaaaaaaagcaataatttaacatttatccgaaattcaatgaaaattggtagggtaactcacccccgagtcttcaaattgattcttcggcaccc

SEQ ID NO: 35637 - DNA, 838 bp, Heterodera glycines
cagggaaatgagcaaaggacggaggtatgaagaaaacacagctaatgagcgacaatacagaaagtcaccaatggaattctgataattaataattgatttaaatgaacaatcgaattttattcattttgaatgtcattaattagggctaatgaatatttgaaatgtcctttaattgtttctttttcttcacatttacttatttatgattgcaaatgctctaatttcgcctcctcttacaatcagcagaaagcacacgatttttgacaattattcgccatccaaacattcgcacttccgttttggtagcatctgttctgagtcgcccatgtcccgcagtaaacgttggcgtcgacacattctcaaaggcattgactgatcaatcatttgatttgtatttttatcaatcgatgaatccgatcgattcatccattgtttccgcattgattggctgattaagcaacgcacccttcggcctgcagtacattttgctcagtgcctccgcgtccgacggggacagtccctcgcgctgtcccatctttgcgtcgttctcttccgggttcacttttgccgtcatcgttttcatcccaaattgacgtgccgcaattttgctgtcgtaatgcataacgctggagaagtcgtagcgaacgccgtaactgaaacgaaaagaacgaactgacaaaagaaacagcgacaatttgtgaacctcgagaatttgttggcaggcgaaacggcaaacatgtcatatgaaatgggaagggatggtcaaatccgacttaatcctccgccgatcaaatgaagaggcgatagccgacttacatcgctgggggtccatgttatt

SEQ ID NO: 35638 - DNA, 1105 bp, Heterodera glycines
acagtcattatcgacgtgtcaatttaggggttaattcacgtgacaattcacagtcatgatttacgtgttaattcaaaatcatgatttatgtgttaatttacggtaatgattcacatgttaattcccgggcatgatttacgtgttaatacacggtcatgattcacgtgttaattcacggtcatgtgcgtttaatttacagtcattattcagtgtcaatttacgggttaaatcacgtatcaattcacgctcataattcaagtgtcaattcagggtcatgatttacttgtaaattcacgggcatgatttacatgttaatacacggtcatgatttacgttttacttcacgggcatgatttacgtgttaatacacagtcattattcacgtgtcaatttaggggttaattcacgtgacaattcacagtcatgatttacgtgttaattcaaaatcatgatttatgtgttaatttacggtaatgattcaaatgttaattcccgggcatgatttacgtgttaatacacagtcattattcacgtgtcaatttaggggttaattcacgtgacaattcacagtcatgatttacgtgttaattcaaaatcatgatttatgtgttaatttacggtaatgattcacatgttaattcccgggcatgatttacgtgttaatacacggtcatgattcacgtgttaattcacggtcatgtgcgtttaacttacagtcattattcagtgtcaatttaggggttaattcacgtgtcaattcacggtcatgatttacatgttaattcaaaatcatgatttatgtgttaatttacggtaatgattcacatgttaattcccgggcatgtacgtttaatttacagtcattattcacgtgtcaatttacggcttaaagcacgtgtcaattcacggtcatgatttacttgtaaattcacgatcatgattcacgtgttaattcacgggcatgatttacgtgttaattcaaaatcatgatttacgtgttaatacacagtcattattcacgtgtcaatttaggggttaattcacgtgacaattcacagtcgtgtggggcgtgttaattcaaaatcatgatttatgtgttaattta

SEQ ID NO: 35639 - DNA, 1339 bp, Heterodera glycines
  misc_feature (814)..(814): n is a, c, g, or t
  misc_feature (1292)..(1292): n is a, c, g, or t
attagaatttgataaagaaaataacgagcatagctgcactttctttacatcaaaccatatgtgaatggttatgaattgttgaaaatcctcgatatttttatcgttggacaaatggcagaacaaaaattatataaaaaagaattcttggggtgcaggacgacataacataaacaagcttgcgcatgcctatgtaagtaatccatatgatagaaaattttatacagtatgttttttggagggggaatccgaagaccttttgttgttctgtggtcaaaattttaatgggtccggctgtgaagacgccttctaaagtattaccaaacttaaaatatttggctctattccggtttacgctcttaatcattttagccgtcaaaaacaaatttacgttaaaactattaaaaaaatatccaacaaatacatagatttattattttgttgtacgtaaacgcattgtcattccgaatcctgtcaatcctgctaatatgcacgtcgaactgccaaacccaattgatacggaaactcaaaaagattgaagaattgataaaacatcacgagaaaaaaacgggcaagcaaattgagtgccatatcaacaaaatggcaagtgatttttgaaattttaatttggggaataaatactgacaaagggagggatggcattccgaggcccaaaaaattttcggaaatcggaattccgtgggtcaaaattttttcggaaatcggaattccgaggcccaaaaaatttttggaaatcggaattccgaccccaaaaatgtcggaaatcgggaagtcggaatttccgtgccaccctggngaattactaaaaacatttgtgaaataccttttacttggttaagaattaaaaaatttagcctattaaaatatttagaaatttttttattatattgtatattttttgaaaaatttccgatttcttgcaccgcaaaaaagtggttttgaaaagaaaaaatagtcaaatttatgaaccgttaataatttgatttccgatcaactttttaccgtcggatccaatcgaaaaatcttagtcgacccatcagcccctttcaatgcatcccgccagcccctaaaaatttatttttcatcattttttgatttttggaaatttattgaatttaattgaaattttttcgaattttccaaaatcccgcaatcccgcacgtttcaatttggaggtgacaaaaaatcccaagtgaaatttcgaaatgaaattttaatggatagagaaggggcgctactttaaaagtgggccttttttaaaattttttcaaaanggggggacccttttgttttgctaaaattttttttgtgatagtcataa

SEQ ID NO: 35640 - DNA, 1137 bp, Heterodera glycines
aaaataagccaaaaatacaaagaaaaataatgttacaccgtccggattcgaacctgctgccccccccctcagaacatgtcccagaatccccaatcacacagggattctgaggtcttgacgatgtcaaaagtaaaatctgatcacgtattcgtgatcagcggcccaaataacgcctaaagacatgtttttggaagatttttggtgaaaattttttttcacttaaaaaccatgtgcacccccctttggtcccgaagcccaaaatcacttttatttttgtatctttttttaaaaaaatgataaaaagatgaaataaaatttatataatagagcaaaaaattgcagatttttgtagtattttactcttctctaatgacttttcagaaccgaattatgaatttttttctgaaaaatcgaaaatttccagaaattctggaataactttttttcttttgaacattataaaaccaaataaatctcataaaattctcccgattttttgctatttttaaagctttaattcacttaaattgaccagtcctccattgagttatgaattttcaaattttaacccaaatttccaaggaccaaaaaaattaaaaatattttcgaatttttaaaaaattccaaaaaatctgaaacttaaaataaacatcatatttgtgctcaggaccctaatttaccccagaaaaaattttttcaccctttttttcaacccaaaaaaaatttttgaaaatttctagggggcctagctcgaaaatttttgaaaattttcgaaaatgaagtataccgttcgatagagcttaaaaagctctacaattttgctctaaggccatttttggctaaaaccaacccctgacgagttatgggcccgggactcaaatgtcccgctcaggccaaaaattttttctatttccggaaaaaaatcgaaatttttccaaaaaaattaccagtcgatagagctcaaaaaatgatgttttggaagtggtctccgtttttcctgaaaaattcgttaaaaattcctaaaattcaaaaaccaaaaaaccgttttttaggcctagcgggaaaatttttcaaaaatttcgaaattttaaaacttgaaaggatagcctttcaaatactacacatttttgctcagaa

SEQ ID NO: 35641 - DNA, 879 bp, Heterodera glycines
  misc_feature (815)..(815): n is a, c, g, or t
tcacaccctaatcattcaaagttatttccgagtcccggacacgattataccggtttcgaccatttccaagcaattcttccgctcaaaatcattcgatcaccactcctttttcaaatcgtaaatattttctgatcaaggattgcaaaaactgatcattgtcaacacttactcgctcgctgttgctttgatcagcagcagtgatcagcggcgcatgataaaagcattaataatcagaagcaattcagcaacgcggctgacgtctcttacgtcacaacaagcacataattaaccgatcacgcaaaaatgctcgcgtgcaaaaactttgttgaaaagcaatttattttttcgcccatggtatcgcagtcaattgagtctcagccacgtgcgaatttgtaatagagtccctgcgggcacttttccatttttgaggagttaaaatctttataatttaaaaatttcgaaaaagcattccatcattgaaatgggaaacttatttattagaaggaacaataaaacttgtgaaatactttccgggctataaagttatgatcggcaattctaattatctacaatttaaatagcccaggctaattaatgtcactgttgattaaatttaagaaatattgtccaaattattttttcatcaaaatttcacaaaagaattcaaaattgaattgggaaattatattgcattttggaccgaaacaataaaattcgttaaacacttttccggctcaagatttgcccggtcggcaggtcgaattattcacaatttaaatagtctaggcaattaattaatgccagtgttgatttanatttgtaaaaaaaatactcaaatttttgctggtttgactctaaaattattattttatcgcatac

SEQ ID NO: 35642 - DNA, 618 bp, Heterodera glycines
tcgaaatcgggtccgagatcccgaattggttgaaatggatgccatattcgtaatcagcgcccttgaaatccccccataaacatgcttccaagacttttcagaacaaaaaaaaattttcttcaaaaaggggggtaccagctatagtattacccatagttggtaaattaaaaaaaatttcgatttcttaactaggtaggtagatgaaaacgggaaaaactctgctaatacatatatttagtataaaaatgcccccttttctttcctcctcctcattctaattctctcattattctcccaatattttccggtcattctgttgctgcaaatgtcttcagaaattctgtactttttttatttcctttttttttgacttttcgcatttcttttgctcaaattatgaccagaattgttcaaaaccaatttttatatttggaagctttaacttcaattttggattccctcgctttgatgcttttcccgaatccatttttttcagttggtgtgccgtgtttcttctattggtcgattgtgccatcattcttttttggctctttttggacaatgccaaaaaacgacgacgccctcacaaaaaagaaatgtaaaataaattaataaaaa

SEQ ID NO: 35643 - DNA, 1165 bp, Heterodera glycines
  misc_feature (75)..(75): n is a, c, g, or t
gcctgcgctcgtccgaagcgctaaagcgtcagaaatcgcacctccgccatagcggcggtgctgtcacaagaaganaatgaagaagagagaaagagagcagcgggaaaggccacgggcattttcaaaagggccgtcctttctctgtcatttcctcccccgcccccaaaaaagtgatcagagcgatcggaaaatgcttacacgaacacctattttgtgagttttaccatggatgatttggttttaactgtttagcaaacggcacaaaaatgaagcgtcgttggcaaagtgccgacgaaaaaagggaatgcacaacggccgaagacaaccgcagcaacggcatttgcggaaatggcaagggaattgggggagaggcggcaaaggcactggcggacacggcctcaacttctgctgctgaactgagcccaccgcaagtgaaacgcgcgaaaccgcagcaaaagcgacagaaattcagctcaatcgaacatttgcttagggaggaaaagcgacgagacgaagaaaatggaggaagaggagaagaaaggataagacggaagaggagcatagagaaggaagaggaggaggaaggaggacgagagggagtgggaccaaagagtagaaaagagggagagagagaaggacatactaatgagagatacgcaagggagagagaagaagaaagagggaagataatgatggaagaaggagggagcggaaaagatagggaagaggaggaacagagaggggaagaagggcggcagagaatgggaccaaagaggaagagaaagggcgaggaggaggaaggcattgaaagggaagaccaggagggggaggaggaagaggaggaggaggaagagttgaagaggaagaattggctaagggcaatcagtgtgccggacaatggaagtgcgttggacggactgaactgcgagttggagaacgccgagacgtggtcaatgggcgggggggggggccttggggagaatttgactttgctatggggggaattggacatgatttaattgtcctaaaacttcgggagttctgctgagccaacggagtttaatcgagaaaccgaaggggaggcaaaagtctcgaaaaattcaaccaaaaatgcttttcagggtaaagttcaataaactcggcactgaaatggtcagtttgatgt

SEQ ID NO: 35644 - DNA, 1422 bp, Heterodera glycines
  misc_feature (75)..(75): n is a, c, g, or t
aaaaaaatcaaaaattttattgattagcctttataattaatattcaccctaatttaaaaagagaaataaattcanaaataagattaagttacacgattaactcacaatattattttgttgtgaattttgtgtttgctttccatggtgtctttttgttgaacagcttcagttttgccaacatttcgtggtgggttttgttcgcttacatcactaatttttaaatatttacaaatatttgattaattagttattttttacggtaattcattagttaccaaaatgcttcttcgtttccctggcgttccaactcatcgcgtcgatttttgaaccattcctaattaattaaccaaaatttaattatataaaaaatcccaaattcgagattttaattctcactttgacttggtttatcgattgattgctgagcattgccaaaaaagtacattcagtacgattcggatattttgtcttcttaaataagccttccaatggtttaaattgaggggccaaatccaatggtttgaatggcgtagccaaaagcttttgttgtccatcctttaatattttataatttaaacgacggcatttggcacggccaaaaatggcacaaaccgaagggcagaagaaagaatcaatgccaatgccattggcattcggctgagactgaacctgcggcataattattcttattgcatagttttgatcattttcacaaacatttttttgttgattgtcgtttgctttacattctttatgctgtctgtgctgggctcgtcgcttttggaaccacgcctaattaaatttaaatattttaataaattagaaatttaaattccctctaattacctgaatttggtccaccgtaatccccgtctcccgtgccaattcctcgagcatgaaaatgtccgggtattttctctcatcaaatgcgcatttcaaaatgtccaattggtcggacgaaaagttttgcagtttggtcttaataaaatggaattatttatatttaaatgaatggcttataacaccatttgtctagctttgtgtccaattagctcagtttggtccccattttgtggcattttttccttttcgtgttgcagatcgcttaattattttaattgaaaatataaaatttagtaattttttgtgggtgctgtttaacactaattagttagttacccagcaggtgtttcttcttatgatccttgccatttccattggtcgcgccgattatgaaaccaaacctaagcaattaataaaaacaaatattaataataattttaaaaaaacgattaaaattgctataaaactcactttcacttccgtttcagtaaggccaatttccttggccaatttttcacgttgagaagcactcaaatatttgttagccacaaattcgcgttccattctctccaattgctc

SEQ ID NO: 35645 - DNA, 980 bp, Heterodera glycines
  misc_feature (838)..(838): n is a, c, g, or t
  misc_feature (843)..(843): n is a, c, g, or t
  misc_feature (849)..(849): n is a, c, g, or t
  misc_feature (862)..(862): n is a, c, g, or t
  misc_feature (864)..(864): n is a, c, g, or t
  misc_feature (870)..(870): n is a, c, g, or t
  misc_feature (873)..(873): n is a, c, g, or t
  misc_feature (877)..(877): n is a, c, g, or t
  misc_feature (880)..(881): n is a, c, g, or t
  misc_feature (884)..(884): n is a, c, g, or t
  misc_feature (887)..(887): n is a, c, g, or t
  misc_feature (906)..(906): n is a, c, g, or t
  misc_feature (915)..(916): n is a, c, g, or t
  misc_feature (919)..(919): n is a, c, g, or t
  misc_feature (923)..(923): n is a, c, g, or t
  misc_feature (925)..(925): n is a, c, g, or t
  misc_feature (928)..(928): n is a, c, g, or t
ggggggggtggggggggtgacggcgagaccggcggcggcacggtgcagcaacaaagaaaaatgaatgggatgatgttggggcaattaattaaatggaaaacccgagagtgatgggaggggggggggagagaaagagatttggcgcggatggatatgtgacagactgcggtagaagcggcatagccagcagcagaggcattggcacactgtccggccggcgtcgggccaaccacaacgcatttttttttggcaaggcacacagcgcacagagtaagtgctgtgagtttagtgcggttgcggtgggcgaccgctaaattaagacgtggacgacggagcggcgggaagagctagaatggattttggattgtcgtcgaatggggggacggacggtaaaaaatggtaaaagatttgaggggggcggaaaacgacgactttttgctgctgatgaggagctgcggcgtgtgttctcgccgttgccaattatatgtacgactaccaccaaattttctgctcattttttctctgtccgtcctccggtccgttctgcaacactctctctcctccctctctttctctgtctcttttctatctctctctccttcccactgtccgctccacccccttctctctctccgccctcatttctcactgtgtttttctctctctcccccctcactcactctctcttttctcttctctcactctctatctctctccccctctctctcttttctcttctctctctctctctctctctctctctatctatctctccccccccctctctctctttcctctcccatttgtcccctccccctacactttcaatccctcacgncgtcntccccnttccacacaaatnanagaatntcntccntcnntcnttntgtcgtcctcaaagattcnttttttttnnctnctcnanttnttttcactaaggagaagaatttctgttaaattgcgactgatatgatgtgtta

SEQ ID NO: 35646 - DNA, 1074 bp, Heterodera glycines
tgttccatgcctcgtaagttttgccactatttgtctttcctttaaaaatcaaaaaataaaattaatgcataatttataaacacctgcatgaaaaatgatctttctgttgatttctcgagcaagagggtaccaattgtgcggctgagtaagatcagaaatgacttgaagctctttaagacattccaaatgggggaacacacaacgggcgtgttttacgaagaaagggtacaacgaatcgacgctctgttctatgataaagaaaaaacaaaaatttatttgatgggaaaaaataaattaggcccaaattaccctggttttttatgtcgctgaaagtaattctcaaagtcggctccatactttgtggactcgcattctctgaacagcaaagcaacctaaacaaaaacatttaattttttggctaatttacatttgaataaaggatcaattcaatttcgacctgaagctctgaaaagccttgtcgaagagacgccccgtgatgttttgctcttcagcaagctccctgatatgcttttgttgtgcaaattgttcaagtgttgctgagataaattggcgcgaaagtttcgcttgaacgccttcaaactacaaagtcattaaggaaccaaggctataactctgataattacctcaatttcagtgtatcgctccattgggacacgttgcggcaccaaaatgtcttccaatggtaattttgatatttcaggctttccaaaacggtctcccacgctttgtcgccttcgttgcctctaaaaatgtttttaatgcgcaaatgcatgtgaaaattgataggattactggtcgttcagttcgggagaaggcacggcaataattttgatgataagaatgatgtccgcataataagaagcaggacaatttggcattagtgcgagaaaacatcaataaacgaattttgaattatttatttcgaattttatgtaaaaaaagtgagccgcaaaagagattttcactggtttttcgataaatttcgggtccggagtgatgaatcaaatgataaacgaagttgtaatcaatctaaattttattcatattcttttg

SEQ ID NO: 35647 - DNA, 728 bp, Heterodera glycines
acccaagcgaatgagtcggaatatcatggttggctgtcctcccgagacgaaaccaagaaacgacaaatgcaaatgattaactcagagattggttgaattaatgaaagaaaagtttggcaaaaacgggcgaaagggtaaaaaagaaaggcaaaataaattaaaataacaaacgaatggacaaaaagtatctaaatatatcaacaaaaatggttagcgaattagtgcgtcaataatagaagaatccgcgacattttgacgaacggcaactgaaaaacgcagcgaaaaataaattaatgaaatttggacgaatggaaataaaaaaggcgcccacgtgcactccttcttctggcgaccctttgcatttccatcaatggcacaatagtcgatggtcaattcctcacctaacaaatgaaatgcagaaaatgattgttaggagattcaatcagttttggaattgagtgacaatttttgaaaaatcagcaaccggttttgatgtcccgcttggcaaagaatgcaatccgatggtacgactcgtcgaaacggtcggcgaacaccgcacggacaaccaaattcggggagcaggaatggttgatgaaacgggcctcgttgccataagagacggcgtccacgacaaactgacaaaagagtgtaagtaatgcgaaaagaaatcattctccacagaaaaggtaacatggacagagagagacacgcggaaagggagggaggga

SEQ ID NO: 35648 - DNA, 316 bp, Heterodera glycines
tgggcatggatgagttgggtatggatgagttgggtctcccccctagttgggcatggatgagttgggtatggatgagttgcttttatggatgagttgggcatggatgagttgggtatggatgagttgggtctcttcccttcccttccccctctcctcccttcctcgctcttcccttcccttcccttcccttcccttccccctctcctcccttcctcgctcttcccttcccttcccctctcctcccttcctcgctattcccttcccttcccttcccttccccctctcctcccttcctcgctcttcccttcccttcccc

SEQ ID NO: 35649 - DNA, 1040 bp, Heterodera glycines
  misc_feature (976)..(976): n is a, c, g, or t
atgcgcattcactataggagagaggagagaaaaagagtaattgttaaaacccgaaaaaacgattaaattgtaaaaggacagcggcaactctaaagccccagcctaatggtattctcgggtatgcttagcaccactgcgcgagtgttcagccgtttttttgtgcccccaattaatcgatatcaacggaaattatcgatttgtgaacgcaacaatttttaaaacacatagaattatgaattgaaaaaaacttaagaaaaatgatcggaataaaccccctcggttctcttttgatcttcgaaaattaattagtgcggaaataaaggactatgaaaatgcacgattaaattaataaataaattcttttcaaatctatcccatattggaattcatacatctgatgaattcacaattaaaaggcttgtattttgggactccttccattaatcaataaacctcacacccaataccgaaaaattataatatgaataaatgaaaaatattttttaatgcacatgtaattaagaatcgaaaaaataaattttttgcgggaaatgaagggcaattttattctcgtttaatttttattaataagtatttttcccgatttatatcatgaaaattataataaatattttcatttcgggaaaattgctctgttgtcaaagggttttaaaaaaatatcagagaatttcgccctcatctaaagctatcagttatatctatttgttgttgttaaaaaataattaaaaccattaactaataatatatgattaaaaatagttaaaatatggcgggtaatacgctgccaccctcaaaatgaccccaacaaatcccgaggggtggggtacccaccaaaaaatcgttggcccacgtgcttacgtgtggtcggaatggtgcaacacttttttttgaaaagggcacgtatgtaagaagtgacccaaaggtcgatgcgcacgccactctcatttcccgcccnccaccaacccccctgccccatgggcacctgcccgccagcgaaacgtcgaaatgagcactcagac

SEQ ID NO: 35650 - DNA, 891 bp, Heterodera glycines
cttcctctttttccttctattcccctcctgtttctctttctgttcgtcttttgcttctcttcctcttctgatcctcttctcctttcccttctgttcctcttccccttctcttcctcttcgcattttgttcctcttcctttctcttcctcttcgcctcccttcctcttatcttctcctcctgttcctctttccctttatcttcctctttaccttctattcctcttcgtcttctgtcttctcctcctgttcctttccccatttctcttcctcttctgttcatcttctcttccccttcctctttttcccttctatccccctcatgttctttttctctttgcttttgttccacttctgcttctcttcaattctcttcctcttatcctgttcctctccccctttctattcccttttctttccctcttctcctcctgttcctcttctcttcccctttctcttttcccttctattcacctcctgttctctttctctttgccttttgttcctcttctcctcctgatcctcttcccctttcttttcttcttcctcttcgacatctgttcacttcctctttagttcctcttcgccttctcttccttttccccttcctcctcccctccttttccacttcctcatactcttcaccttttattgctcttcctattcagttcctcttccccttctctttctcttcgccttttgttcctcttctattcctcttctcatttgttcctcttcaccttctgtttatcttcctctttgtcttcgtcttttgttcctctttctcgttgtctttgacttttgttccttttcctcttccattcgtcttccctttcgtttcttcttcccttctgttcctcttccccttcctttttcaccagttcctcttccctt

SEQ ID NO: 35651 - DNA, 1363 bp, Heterodera glycines
  misc_feature (70)..(70): n is a, c, g, or t
acagggaccacttgcatttcgcacgatagctgagtgggtcagtcggagtggcatgtatacatgttgcacncagagaacaatatctgaatgcatcctcggccaaaaatactttttacacttttttaatgtttttttaatattcatgtgccctcctcctaatggggagctgtggaaggattcaaaaataagtgaccgtaatgacacagggacaaaaattcgtgggacattacttccaattttaaagtataaaactccggaatttagcaataaattacatgccaaaattgaaagttggtccttttcgctttccgagaaatcagccggaaatgatccatttttcagaaagtcaatgtatgccaaaatttcagggtcattcctctgttcttcggccaaatctatctgatagctattcccatcctcatgcctcagggttatcgtattaacaaacggtgcaaaaactatatgagatcttgactgaaccgaaaaacatattggaaattggactatgtcttccatttctggcaaaccatcaacctccttagttggcacttcctcagcagcacgtgacagggcatctgccagtgtgttttgccgacctgccacatggacaattttaatctgataattttgaagttcaacgagccatcgagctaaatggggatgggtttccgcttttttgagtaaataggctaagggcttatgatcagtatgcagttcaatgtcactcataaaaataaatggtctaaattccctcagtgcgtaaataattgcacacatttcaatttgtaccgtcggccatcgcctttcagatgccgataatgttcggctgcagtaagagattgccgagaaggtacctatttcttcatttttttgcatcaacactccgccaagtccagatcctgaagcgtctgtaaagatgtgaaaaggcttgaaataattgggaaaaattaggtttggagattcggaaatgaatttcttaagcatttctaaggctttttgttgttcctccttccattcaaacttgacagattgcctcgaaaggctcaaaaaaggctcagctattgtagcaaaattcttgatatgtctacggcaaaaacttgcttttcccaggaagcttttaacttctttgacattgccaggaattgacatatcttttatgagctctattctgctcatggttggtctataaccatcagctgaaagagtaaagcccaaaaattgcatttcttttgctataaaactacacttttttggactgagtttgagattgtaaagtctaaaacgttcaaaaacttttctcagcgaaatcaagtgatcttttaacgtgccatccttggtgaatactaacacgtcatcgacataa

SEQ ID NO: 35652 - DNA, 1088 bp, Heterodera glycines
  misc_feature (1081)..(1082): n is a, c, g, or t
gggttcaatcccgcgcggcgaaactccagcgcattcaacgcccacaccccaaaatctcggcaacccccatcccacaccctcaaatcccgaccccacaacgtcccgcgcaccaaccaccatcccaaacccacatctccatacacatcccccaccccattgccgtcagagacgcagacacaaccacccaataggcacggaccccccagctgatcctctctgcgcttagcggagaagatcaatcgataattcaagtagtcttaccatgtagttacggtctggagtcgtactaaagtataggtgcagtaaaagcatattaatccgatactataaaatcggttattttatgagttaaataataaaaatataaatagttcactttgttacagcttttagtcatgaaaggcaaaaaacttcaaatttttgggtccatttttaaaaagtgtattttgatcagaattttaaaatatatttgagaaaaaaatttactttttttgtactattttaagcatttgtgtaaatttaagaattttttttcaaaagttaatactttctgaaaataagaaaccctgtaagatttacacaattagtttccactataaatgaatttttgtcttttaatatattgtagtgaaaagaaaagacatttataaattagatggaattatgggttggtatagaaatataatgaacaaaacatttatttccggggggtcatgtaaatacattaaataaaaataaatatttataaaaatattttttgatgaaaaagaaaatgttcatacgcctcaaaaaaaacaagtcatgaaatagcacacctattctgtggctagatcggttattttataataatttatatattcatgtttaaaaaaaataatatttctttataaggttctttgatttgtatttgattcataaaaggttttcaatgtttttgtcgcctgttctatcctaaaaaaatttttttagagtgaaaattaaaaacaggatagcgtcatagaaaataaataaattaacattattagtttagagaagtaaatacgataaattttaaaattttaaattttgcttcacctgcagnngcatgc

SEQ ID NO: 35653 - DNA, 1078 bp, Heterodera glycines
  misc_feature (14)..(14): n is a, c, g, or t
actgggttagattntccgaaaatttgggtttattttaaactgtaatcctttgaaaccttaaaattcgttattttccccagctatggggtgcaaaatttattagaattcacccgtttttgctattcttcaaattcagagaattaagcgatgcttttcggcattttctttctgtttttgggtctcaagatgcggtccattctgatttgggatatttattttttcccattcattcctttttctcccatgcgcagtcgcggctgttgagtgtgtccggtatgagtaactacatgccgcagttgtcaccaaccgccgacaaggaactgacaacgtctttgagcgagttggcaatgaaccaacggccaccagccgccggagcgggccattgtttgaaatcgtgcaagagcgagtcggtgacaaaaattcaccaacatctgaaaggcttgcgctgtcgaagcgagggacaagttacaccggccggaaaaggttttttgacgggcataaaaatttttaagacaatctttttgaaaaattaaaaaaactaacggttttaattaatttgaatctccgatttattacgagaattatccaagaaacgagactgagactcgcaaaacccgatactgaaaaccgagcatctcgacaagcattaagatatctctctattaataggaaagtcaaactcggagacgtcttccattccgttccacgaagctcttgaacgtttcggcggtgacgtgtcgaaatcaaagtctttcgctcaaaagcgtaaagaggtgttcgaagtcatataattaaataaaaaaggttttttggatattgtaatgcaatcaattcttgaaatatttggctatttgacattcattttcatgaaaattttttgatgctgggtgggttaagggcccaaccgttcgctatttgccaattcccccttctctcatgcgcagaagcagcaccaggggacgacagtgtccgagatggtccaccacggccagcagttgggagaattggcacaatctacgagccaactggcaacggaaaatcaattgaacgttgaacaggacaacaaattgctcaagca

SEQ ID NO: 35654 - DNA, 1666 bp, Heterodera glycines
atgcggcgcaaaaagttgtttattcataaaaaaatgacgttacattcacagataacaaacccaagggtcaactcactatgggttgggactcaaaatttttgcgggattaatcccgcaaaatcccgtgtttccaaaaaatgcgaaatgctgggatcccgcaaaatcccgcgcgggatctcgtcccggcgccgggctctactacccagaaaatgtttcttgccaaaatttcatgaacatttgggggctggcccattctttaaggccccatttttaaaaaaatgaaattttgtttaccctttttaaattttcccccaaatcattcgcacaaacacaacagtcagtcaaatcagtacaaataagacatacataagttagcagcggctaaccgcaaacaagctgctgaacatttctgtttgctgttgttctccgaagcgctgccgaccgccgcttcatctttcatttccattcattcagtgctttttcaccgatgcttctcccccgccccgcccgctcaaaatgtctctcactttttttttctcccatcggccccattcatttggctgctaaaaggtcaacagcaacacaacaccaacgccagtgcgtcctcgtgttccctggcctttattagcccagggcagggcaaaattaatgattcggtttttgaaagtgtgccacgagaattttttggtattttttgatttcgaattttgtttcaaaaatttttttttgttcatttcattttcctagttcgggtagttttcgataagttttcgcccccagccctgttttagactccaatcattttggccataactctgggctgaccccttggataccgaaatttttttttgaaaaaaaaataaaaatgccataatgattctcaattatttccttcccccgcccgccctgccattggcccatttcccaatctctttcaattgttcttctgctgatcgctactggcttggcttaacctgtttagccctcacagcacagctctggtctactctctctctctctcgctctctctctctctctctctctgctggttaagaattaataatggaacccccgaggcgatggaatttgtggaatggaacaaaaacttttttccggcatttcctgttgaccaacaataaacagaggagtattataatgataagaaatgataatttgtgcctaattaacccccccccccgccccccattgggtctaattgcccggggcgaacggcggctgagtctattaatagccaattatcacagcaattaggtattctactgattgttgcactcatttctcatttatcagccgccccttcccccattcggtggccaaaaatgcacattttaattataccggtcgccgctggcgcggcgctgattaatgataattagtgtccacagtgggggaggggggagtgattaatgataattagtgtccacagtgggggaggggggagtgattaatgataattagtggggatggggtgtaattatgatcgaacgatgcgctaatgaatgtggggtagtcggcccggcccatccatcggcgacagcggcgagttcaacgcaccagcagcagcaggcagcagcgtttttatcagctcattttccgcaattatgcggctaattgcgttgctgttgatgttgatgacaccacacca

SEQ ID NO: 35655 - DNA, 905 bp, Heterodera glycines
aattacccccccccccctcccctccgtaaatggcagtgtgccacttctctgtccctgctgtgatggcattccatcggccgcctttcaacgtgccgccaaacaagcttcacatatgatgcaaatgcaagagattgagagactgaggagaaagatggaaacgcatttaacaaagcacttggaaattcggtggaccattgcgaggctaagggttcggccaaacatttcaatgcccttcctaaaccaatggaaaactgattcattcagttggacggtcaagtgcccatcggttcgctgctctcttctgtctctttcttgcgccgtttggctttgcccagcataacaattggtcggtttccaatcactcacttttgttggatttaattatttgcgcttttctctgtgctatgcttcgtttagacatgcttatcaatgacaaaaagtgtgcgactgatgagcaccttctcatcggaatgggggagttcgtgccaatccgagtgattatttattgctctttgggaggtgaattggccagtcaatccatttcttctaatttatattattaccaaattcagctaatttatttggcgaattgtctctttcatgttgtcaatatcaaaatgaaaattcggcagttttaaatcgcgagaatgttatgctaatttgtggggaggattgtgtgccttttcgagtttccgggagcgaagaggaaagagagggcgacaacaaatgccaatcggaggaagtgccatcggtggaggaacagcaaaagatgggcaaatttgagacggagtttcacgcggcattcagccacgagggcattttcaaaagtagtccggtgcttttgccaactcagttcgctgatgatgcagaaaagaaacgggaggggccgctgccaaatgccgagc

SEQ ID NO: 35656 - DNA, 526 bp, Heterodera glycines
ttgattggaatgttggtgggttgtgtcacagtgattgaatgctggagagtagactcccagtgattggtattctggtgggttgtgtcccagtgattgaattgtggagggttgagccccagtgattgaaatgcaggagaattgagtcacagtgattggaattctggtgggttgtgtcccagtgattggaattgtggtgggttgagtcccagtgattgaatgctggagagttgagtcccagtgattggaattgtggtgggttgagtcccagtgattgaatgctggagggttgagccccagtgattgaaatgcaggagaattgagtcccagtgattggaatgctggagagttgagtcccgttgattggaatgttgctgaggttgagtcccgttgattggaatgttggtgggttgagtcccagtgattaaatgatggtggattggcgcagaaaattgtggggggccgaaggccccagtacgaggccgcgaagcggccgagcgagtacctttggcgcaaaaaattgtggggg

SEQ ID NO: 35657 - DNA, 535 bp, Heterodera glycines
gataaacaagttaaaatgtcgggaaacggagtagctgtctgatttatatttaatgaatcgggattgggttaggtcgagattaccaattatttaaaaaaattgaacccctttacaaattagttcttgacgatgggcactcgaactacacatccgcccatagtaaaatataaaattgaaaaaaatcccgaaaaattagtcaacccattgaattcaaaattcgaaaatttttcattgactcacacgaaacaggggacatcaagctaattgcttgacgaaaaaacgattaaaaattaatttcagcagcacaaataaagcaagcagatttctccattagatgaaagcaataataaaatcacagaagaacggacctctttcaaacacacatcatcatgaagcagctcacaacaaaaaaaacaacaccatcaacatcagccagtacacacagccttcccaatacatatcaattttatgcctcattgagcaatttggcgattaacgacgaagataaacggggagggggggggagggatttggg

SEQ ID NO: 35658 - DNA, 876 bp, Heterodera glycines
ttagagttgcacgggaccaagactggtactgaaaaaaggcacacatgagtacccaagtcccggttttgaccggcaccgggactagtcccgggttttttccggttttgcgagcaaaaaggcccggtttttcaacccgaaaatcccggtaccggtttttttacatttaccgattaccgccctactctagttttttgagtgacggacgacccggaaccatcgattgtttcataaattaattctggcataggttacccgggcgatgaaagttggcaaccatcggaaaatatttattcgcaagaattggtggctgattttattgagtattctacggtaatgtgcgctgtacatgcattgtccggcaatgaatcagtgcccgagcatattgcagaagaactgcgcgaaaatgagaaattcaagaaatgtatgaaaataattaaaaattaaaaaatgaaattttaaattttaaattaaaaaacttatacaaaaaagtatcaatgtcattaaaaatgaattaaatttgatgttattataaacccaattagttttctatacatatgtataataaataatttaaaattcattttaagttttaaataatttaattaggtaagttttttttaataaaaatttacacaaaaaaatcaatttgagttattagcaaatatttttggcgttttgcctaaaatttgttaacaaaaatacaataaaaacgaacgattggggttttttagaagcaactaactattttgtcagtttttagcaactatcagttgcgtccctaattattatacatttaatctacacccaattagttttgtatatatttataaaaaaaatattaaaaagcaatgttaatatttaataatttaattaatg

SEQ ID NO: 35659 - DNA, 790 bp, Heterodera glycines
acccctcccctcccccccccccctccgtgctcgatgtgtgattttcggaaagaaatttccggtcgataatcccgcgaagttagcaccgctcgcccgccctccagccgccctgcttgctacttgtggtggtggtggtggtggcggcggtgtgtgtggtgacacattcgattcgcacaaaatatcaccgaccgattaaaatagatttgaacggtttaagacgtgtaaaaattttaacatgggaaacgagatttaaatccggtgcttttccattttggggcctagatttggattttaaaaaaatcatcgactcctatttgtgcgagttcctatggcgcgaagatgtttaaaaatcgtggcacagaaattgcgacacttatgccacccgccgttataatctagtttttgcaatcctcagtgtcctttgttcatttttaaaaaattcaaatcttgccccaaaataaaattaatactgtattgaaaattgtattgtatagtaaatgatgtcaagtttcccctccattaattacaaatttgattactttaatccaattttaatttcttttttcccacccaattttgcggggtttccattgattgactttcattttacgttaatttgttattacgtaggaattagttaaattgcgcatttggaggtcacattcgccccttacccttctggtacattacacatgaaaatgttgcatagaaattaatttttgttatgcactcattacattaaagaattttatttagtttatttcattgaaaaaactcctcatttattaaa

SEQ ID NO: 35660 - DNA, 1226 bp, Heterodera glycines
  misc_feature (52)..(52): n is a, c, g, or t
  misc_feature (59)..(59): n is a, c, g, or t
  misc_feature (64)..(64): n is a, c, g, or t
  misc_feature (99)..(99): n is a, c, g, or t
  misc_feature (123)..(124): n is a, c, g, or t
tgcatccgatagcgtttcagatttgaaaatttcaaatttttcgagctagccncctcganaattnttcgttttgaattttatattttttgccgattttcnccagggaaaacggagaccacttcnnaagcaaccgtttttcgagctctatcgattggtggcatttttgaaaaaatttcaaaattttccggaaatagaaaaattttccggaattgagctccccatttccgttcaaggcttataactcgtcaggcgttgattttagcggaaatttgtattagagcatttttgtagagaattttaagctctatcttatgtgctttatctcatgtttttaccgtgagtttaaaaaaagttataaaattaattgtgattttgaaactcaaaaccataggggggaccccatggttttgcatttcacgaaaaatttttttactcctaaaattgccaaaaaatacttttctggggtaatttgaggtgctgaacacgaatatgcactttatattgcgttttggattttttggagggtggtaaaaaaaatttgaaaaatcgtcaaaatttgagccccagaaaatccaatgaaaatttgaaaattcctaactcaatgaaggactgctcaatttaagtgaattaaagctgtaaaaatagagaaaaattgggagaattttatgggatttatttgggacttctatcttccatattccagaatttctggaaaaattcgatttttcagaaaaaaattcctaactccattctgaaaaagtattttataaaaataatatactcaaaaaatccgcaattttttgctctattttataaattttaatttagctttttttaggggttatttggccgctgatcacgaatatgtaatcagattttactttagacatggttaagacctcagaatccctgtgtgattggggattctgaggagtgggagcgcctgtcctgaggccgcgaagcggccgaacgtctcctaaaaaattaaagaacgggcgcgaagcgcccgtcctgaggccgtgatgcggccggattccccccacaaaattaaaaaacgggcgcgaagcgcttgtcctgaggccgcgaagcggccgaatgtcccccaaaaaaattacaaaacgggcgcgaagcgcccgtcctgaggccgtgaagcggccggattccccccacaaaattaaaaaacgggcgcgaagcgcccgtcctgaggccgcgaagcggccgaatgt

SEQ ID NO: 35661 - DNA, 1003 bp, Heterodera glycines
  misc_feature (939)..(939): n is a, c, g, or t
gctgtgttcgttcaagctgcaaggaaatgatttgacattttgtttgtgttaaatgcccctatgccctgcctgttgagcaatgtactgcttgaccgactcgttcaccaaatgcatggtgctgctgctactggttggtgttgttgctgttactgttggtctatttgctgacgatgcaatggataattgggcgtggaaatggacggccaaatcgaaggcactaatcaattgggggagggggaaaattcaattttcaattgttggaactacggttttcatacggttcaaatgcgaatcgcgccattccatcggccccggtagtcctgaccaaactgatgccaaacgagcgcatcagctccaccactcgttggaccatctgacgctgttcgtgcccgtcaccgccgccatcggaccacaactgaaagaggggaatttaggaaaaataattttatttggctgagagtgatgaaagctgctgaacctaggcataaaaaaagatatactgggttaaaatattaataattataaataaatattcacaatctgaggtcgctattttcatcatttgttaacattcagcccaaaaatgagtttcgtttcgcaccgaccgatgctttgacgggcggttggagaacaaaccaaaggagcggggcaaaccaagtgaacaagtcgacaagtccgatgcagcagtgcgcaccagtgaccacgttggcacggagggagcgcatcacttgctgattctcgcgctgctgctccacaaatggctaaacaattggcaaaaaatgttaattgccaatgccaaaattggactgtgtgtggcaccgatcgacctgaacagacaagttaaattggagtcggcgggacacgtgcagggcacagtgtaagtgaacaaaagcgagcgcaaagggaatgtaacgggcgagcacaaagtgttgggcccgntggagcagtggtttggagtgcgtccaattgggtgaacagagcggagacgaaacggcactgaaaa

SEQ ID NO: 35662 - DNA, 762 bp, Heterodera glycines
aattcctcaattcacccaatccctaaaatgtaccaaaattcgaaagaagtgattgactttgcagcggaaaatttgggctgtgaaaaaggagagcttgcggttgttcttcaaagaatttcaaaaagaagtgcgctaactaaattgatcaccgaaacactcaaccgtggcgcaacattgtggtatcgactcgacgatgggtatatacaaaaattgggcaacaagctgagcatatcggcagaccggccttttattggttcacggccccgtgtttctcatcgcatctttgcttttcaaatattgagaatcagaagaacacagggaagtgtgctcggcccaatggttgtgaccggcggcgtttattatccacttggggggctaatttttcggaattttcgagaccaatacgatgattttggagagttttttgccggttttatgaaagaagaattggtggtgaatgttgctaaaccgcgggtgaaaatgtgtgaagcgacgaacaagacgacttgtggagaagaatcggatgagcaacatgtaagggattcaacaaaaaaggttgaaattgttagcaaaaacctaaatttaattgtctcgggtttaaatggaaatttaaaggtggactatgaaagtttaataggcacggaaagccaagggggtgaagcaatatttaagatacgagggcgcggcatgatgaaaggcacattctttttactcattctttgtatttggtgtacggcatttacggataaaggagtttggcca

SEQ ID NO: 35663 - DNA, 1056 bp, Heterodera glycines
ttttgaccttgtttcattgtaatttggcatggcctttccgaatttcccataccaagcgccctcgtacacatcaacaaaaggcgcgagtgaagtggtgttgcggaaaaagatagtttgtatggcacagacgggtagaccattccaccggcgtgtactgatatctcacgcaagtcaaaaggctcaaacttgaacggggttagcttatagtcaccattgaaagccgaatttgacaccatcgctatgataacgcgacggggaatggttgcactgaacacgttgtattcaaactcatagcgaccaacgctgatgaaggaagacttgatctccgttttacgaaccgcataagtggctggttgtttttcaagtgttttgtacaagctcatattcagcgaaggttgtacctctaccatttttgcgtaaatttttacatcgtgaactgacaagcggtatttggtcgtgtcattgtcctttagcgtttgtataagaaatgaatcctttgccctgtaaattgtaaacagcaggtccaaattgtttataaggtaaagctcctgatttcccaaatcaaagtcgaggcgtgagaggaactgtgcctttcgcccatcttgaaatattttgcaacgttccttgaacccggtgtctgtggcatcatcatgtttagtgcttggttggtaaccggttgagccaaggaagtgttttttgacgtttccaggtaagctcaattcgttcgtgatgtatgctttgaagggatacaaatttccactatcatacacttccgtgttacccaaatgtcagtccaatggcttggattgccgatacattggtgtcttcggccttaattggtgtccaactgccgttagtttcaaacttttcaacagaaacttcaaggtgcagatagattcgtgacaaatcggtccacaggttgtcgctgtagagacggaagaggtagggcgattcttgtgtgattgtcgccaagggaagcacttggcggaagaatgatcggacaacagagacgttaggaaaggcacagagaacagatttaatgcactgtttattgca

SEQ ID NO: 35664 - DNA, 1047 bp, Heterodera glycines
  misc_feature (62)..(62): n is a, c, g, or t
  misc_feature (65)..(65): n is a, c, g, or t
  misc_feature (72)..(72): n is a, c, g, or t
ttatttaatttttatatcaattaaatcttttgtttctacatagaaattatttattttatttnaantttaatnaattctataaaagaagatcttattaattattccgtcataggcgataatgttttattaaataatataaaacaacagatattttaaagctttaataattatacttgatattggaacaataagtattctttttatgtaaaaaagaataaaatttaaaaattacttaaaaacaattttttgcagattcacaattataaatgccctgccggttcggaatattgctgatttcaacataaactgccggtcggccattccgcgtctcgctctttactttggaagcgcttaatgaaattaagcctgattcatttatcaaaaattttacacttgcatttagagaatagcttaacaagaacacattttataccacgcgaataaaattcaaatataaaaatttaattttacgaataaaaaattctaagaattaaacaattaaatacatgcaatcgaataaataaaaaaataaatattaatattatgattgagaatattattaacaataactcaggattctatttgaattatgaataaaaaactggataaaattatataaacgaaaaatgacgcaaaaaagttattttaaaaaaataagatacatgcttaaaaattgtaattttttcaaaaaatggaatatacaaatataataataatataatatctattctaaaaacaattgacatggctataaaaaaataaaaagtaaaatattcctaatttaattaatctgagataaaggcgataaagtaattccaataattattatataaaaagaataaaagatttatttcaaaatttttttcttaatactaaagaataatctattaaaatataatttactcgaataaataaaatttttgatgattgatagcactcaagagttttattagaatttatgaataaaagaaactgaataatctatatcatcgataaatctctggccttttttaaaaaatatattcgtaatcagaaataattaaataa

SEQ ID NO: 35665 - DNA, 687 bp, Heterodera glycines
gtcatgggaagagatgggcggcggaggaacggaggcctttaagagcagcaaagatccgtcatcaaatccccttagggcttttaatgaagaggtaccggatgggtgggagggggtccttgagatttcttcgttaatgagtggagagcggggcaggggacggaggacggactggctaaattacaatgagtgactgagtcagtgaatgacctgcagagcctttaaatggcggaaattttgagtaaaaaaatggaatctccaaggattacggtagagaagatgccctgtagagaatttaaatgccggaaatttgtgtctaaatttgaaaatgaatctccaaagattacggtagggtagaggatggcctctctaagaacctaagtgccggaaatttggagtctgtctaaatttgaaaggtacctaaattgtgatggactttttaatcacgaaaattcgaaaattcaaaggccaaatcgtaaccagatttatgaatttttagactaaaaatttccacaatttataatttttttaaaaaatcaaaaaaaaaaatggaatcatttaaaacagagtttaaaaataatgacaaatgtcggaacttcagatttaatgtctcatttatatgaagtaattttccccaaaaaacccgaattctagccctactaaatctaaaaaattcgaataactggacat

SEQ ID NO: 35666 - DNA, 923 bp, Heterodera glycines
tttttttccccaataaacttttcaaacccccatttttccccccgggaaagttttttttttttaatttttgaaccgtttgagtaaattaacttgaaaaaatgaaaaatttggaatcaagtttccccctccctttccccgggggatttttttgttaagtttttttttccccaataaacttttccaacctcctttttcgcaccgtgaatggtatttttattgaattttgaaccgttttgagtagattagactagaaaaaattgaaaattttgaaatcaagttttccccttccttttcccaggggtaatattttgtaaagtttttttttccccaataaacttttcaaacctcatttttcgcaccgtgaatgttatttttattgaattctgaaccgttttgagtagattagactagaaaaaattgaaaattttgaaatcatgtttcccactcccttctcccaggggtattattttgtaaagtcttttttcccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccgttttgagtagattagactagaaaaaattgaaaattttgaaatcatgtttccca

SEQ ID NO: 35667 - DNA, 861 bp, Heterodera glycines
aaccaaaggggagcaattggaagcgcaaaatcatttttggcgaagatcgtcaaccaaagtttcagtttttagttcttttactattacgttttcgttttagagttcactgaaaatttggggtcgactcgcattgaacgtgggagagagttggcgaacacggaaatgctgaagcagcacgttgaggacgtcatgaaggccgagcagtacgcggcttggcacgtcaacaagtaaatgcagcgtagagaaattggcacaataggacacactttcagggtaaagctcgagctgaagcgcaaaatggcattgaaggaggaaatccagaagatggttggcatgcttcatcaggtgaagcacagcgtaagaatgggaagcattggcaccgtttgctttcagaattcactcgaccgcgacattgagaaggccgaaaagacattcggcaacttttactccgacttggccaatgcgccgtggctgccggagaagcgcgagattcagagggagttcaagaagtacgacgacgagttggcgaagttccgtgaacagatcgccgagtacatcaacgccatttcaaagatcaaatcggaaggtgcgcaatggcattttgttgtttaacggactccaaaattcagcggaattgcatgccaagttgccgttcagaacattcgtttatgctctcgccaattattcaaggcaatcgggaaaagtttgtcagctgacgaaaagggaacagaagaaggcaaaacaggtgaaagtcatggatttaaagcagtaattcggcaattttacgatatttagctgaaggaaaagctgtcatcgatgagcgacgaggaaattcgcaattcaggggttagcttttgattt

SEQ ID NO: 35668 - DNA, 1195 bp, Heterodera glycines
  misc_feature (1115)..(1115): n is a, c, g, or t
gcaagttgaagagttcaaataaaccagtggttggatgatgcctcgggtgattggtcggagatcgcccaaatctctcttccaaaagccagtgggatgtccttgagaaccttccaatctaattggaagtaagcaaaaatttgtcatgaaaaccattcaaatccctttgctttgttaagcaatcaatcacaattcaatgatcatttacattaccatatgaatcgctttagcaaatgcctttgtttgcattcactttgtcttgtttaacttttgttggctcttttctttgtccatttgtcctcattacgaccgcccccccccgcccttcatcagaacacttcagaaaacaaaatttttttaaaaaataaaaaaatttgactagaccaatcgaaagctaacggtcgacctaatggaaaaaaatccccgaaggagagaatttaattaaatccattccttcgggggtccgtgccgggtgccgcggggtaagcagtgctggtttcgtttcatcacggcccccatccttttggctagtcagcaatcgttgcttaacttgccagatcggacgggtgcgcatgattccactgttccaagcaccccaccaaaagcaaaacgatataaccaaaatataaggaaaaatttttaaaaaattttttctccatcttcctttttgatactaaagcatcagagtgctaaaattgacttgtaaataaaatttggtgcgttttagagcactttctgaaaaaatatttatgaaataaaaaaatcgatttattcaagtgtccgtttggggtactcaaacaattatggggagcaaaaatccaacgcagaattaaagtacagactatagggaagctattcccgaaggattcggtctccccataaatctgggcgcatcggttcggggggactgcaccgaaaacaaaaaaatcgattttttcaagtgtccgtttggggtactcaaacaattatggggagcaaaaatccaacgcagaattaaagtacagactatagggaagctatttccgaaggattcggtctccccataaatctgggcgcatcggttcatggggactgccccgaaaacccaaaaaaaaattttttggataaaaattatttanataaactgactagataatatttaaaataggttatttctcttcctttcagtatcctgcaaagttgctgcgcttctgatcag

SEQ ID NO: 35669 - DNA, 993 bp, Heterodera glycines
attgaaagggtggttgcggaggaaaaagggaaaagacctccacgagtatggttttgtgaaatggcgtgggtacagcacacctttcaacagctggattccactgaactcaatcacgtcgaaaaacatataaactgcaaacaaatgaaagcaactaaaaatgccttcaaattcattttacgttatccttccttccaacacaagtgttgatggaaaccgaacaaactccttccgggtgcgtctgcctctcaaaatccaattcaattccgagtgggaagtgggtttggcggtcattgtttatccacattcatggccctccattgggacggtggaagaacaatttgtgcaggttgattggcagaccggaagcacagtgcacattgccgtccccactacaaatattaaaaatcctgatgatctgagtaaaagtttgtacaggctgttgggcgagggaagcgaaccgttggcaaaaaaagcgcgtaccgctcagttggcattcaacaattccgcctcggttgctcgccaatgggccaaggatgagtacattcgacgaaaaacacgagagaagcgagccatccgggatgaacaaatgctcctggacgcactccaaactggcggcactgacagcactgttgatttgatggacgcagcagcccaaggcattgtgtcgagggagaaacgtgcagagtcaagccaaattccgttgagagaaaagatgtatgacaaggacacataccaaaacaagctggacaattatttttccaccctcaagggggaggatttggaactgcttgatgaacttggccgaaacaaattgaacgatgagattgcaaacatgtttgacgaagatcgcacaatccttgacgccaccaaagaactgggccttgaggcgtggatacaggcatacaaaaagggtgagatttgcgtgcaagtttacttttgacactcacaaaaaccggttcacgctgagacttgacccccgttatgtacagcgcg

SEQ ID NO: 35670 - DNA, 962 bp, Heterodera glycines
  misc_feature (44)..(44): n is a, c, g, or t
  misc_feature (49)..(49): n is a, c, g, or t
  misc_feature (53)..(53): n is a, c, g, or t
  misc_feature (58)..(58): n is a, c, g, or t
  misc_feature (63)..(64): n is a, c, g, or t
  misc_feature (69)..(69): n is a, c, g, or t
  misc_feature (72)..(75): n is a, c, g, or t
  misc_feature (86)..(89): n is a, c, g, or t
  misc_feature (97)..(98): n is a, c, g, or t
  misc_feature (102)..(102): n is a, c, g, or t
  misc_feature (104)..(104): n is a, c, g, or t
  misc_feature (109)..(109): n is a, c, g, or t
  misc_feature (111)..(111): n is a, c, g, or t
  misc_feature (113)..(113): n is a, c, g, or t
  misc_feature (116)..(116): n is a, c, g, or t
  misc_feature (118)..(122): n is a, c, g, or t
  misc_feature (124)..(124): n is a, c, g, or t
  misc_feature (126)..(126): n is a, c, g, or t
  misc_feature (134)..(134): n is a, c, g, or t
  misc_feature (138)..(139): n is a, c, g, or t
  misc_feature (142)..(142): n is a, c, g, or t
  misc_feature (152)..(152): n is a, c, g, or t
  misc_feature (157)..(158): n is a, c, g, or t
  misc_feature (160)..(160): n is a, c, g, or t
  misc_feature (162)..(162): n is a, c, g, or t
  misc_feature (169)..(170): n is a, c, g, or t
  misc_feature (172)..(172): n is a, c, g, or t
  misc_feature (180)..(181): n is a, c, g, or t
  misc_feature (188)..(188): n is a, c, g, or t
  misc_feature (191)..(191): n is a, c, g, or t
  misc_feature (193)..(193): n is a, c, g, or t
  misc_feature (199)..(199): n is a, c, g, or t
  misc_feature (201)..(201): n is a, c, g, or t
  misc_feature (206)..(207): n is a, c, g, or t
  misc_feature (232)..(234): n is a, c, g, or t
  misc_feature (236)..(236): n is a, c, g, or t
  misc_feature (240)..(240): n is a, c, g, or t
  misc_feature (243)..(244): n is a, c, g, or t
  misc_feature (246)..(246): n is a, c, g, or t
  misc_feature (248)..(248): n is a, c, g, or t
  misc_feature (273)..(273): n is a, c, g, or t
  misc_feature (278)..(278): n is a, c, g, or t
  misc_feature (283)..(283): n is a, c, g, or t
  misc_feature (290)..(290): n is a, c, g, or t
  misc_feature (300)..(300): n is a, c, g, or t
  misc_feature (314)..(316): n is a, c, g, or t
  misc_feature (324)..(324): n is a, c, g, or t
  misc_feature (326)..(326): n is a, c, g, or t
  misc_feature (336)..(336): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (360)..(360): n is a, c, g, or t
  misc_feature (372)..(373): n is a, c, g, or t
  misc_feature (388)..(388): n is a, c, g, or t
  misc_feature (390)..(390): n is a, c, g, or t
  misc_feature (399)..(400): n is a, c, g, or t
aaaaaagtctaagtcctcaaagtgtaaaatgtaatcgtaaaagncaaanaggnaaggnacgannggggncgnnnncgcgcggccannnncgcggggnngcananaccgnananacncnnnnnanangccaggcnccannaancggccagccnccaannananacccccnncngaggaggnngaaaaanaananaccagncnccagnnagcagccaggggggacaaaaagaannnanaaanaannancngggcacaccgcccaaaaaaaaaagnaaacncaacncaacagnaaaaggggcnaagaaacgaacaannncgccccancnccgacgccanccagcccggcancancancagagnagggacgcaacnncgagggacggaaaancncgaaacagnnaactaaaaaaaaaaattgtgggaagaattttaaaattttaaaatcgcttaacattagtggtttgttctgtgactttagtgtgagacactaatgtgtgtcatgcttttgaaaaaacattagtggtttgttctgtgactttagtgtgagacactaatgtgtgtcatgcttttgaaaaaacattagtggtttgttctgtgactttagtgtgagacactaatgtgtgtcatgcttttgaaaaaacattagtggtttgttctgtgactttagtgtgagacactaatgtgtgtcatgcttttgaaaaaacattagtggtttgttctgtgactttagtgtgagacactattgtgtgtcatgcttttgaaaaaacattagtggtttgttctgtgactttagtgtgagacactaatgtgtgtcatgcttttgaaaaacattagtggtttgttctgtgactttagtgtgagacactattgtgtgtcatgcttttgaaaaaacattagtggtttgttctgtgactttagtgtgagacacatattgtgtgtcatgctttgaaaagacctgcagg

SEQ ID NO: 35671 - DNA, 998 bp, Heterodera glycines
tctccccataaatctggccgcttcggttcggggggactgcccggaaaccaaaaaaatcgattttttcaagtgtccgtttggggtactcaaccaattatggggagcaaaaatccaacgcagaattaatgtccaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgaccgtttggggtactcaaacatatatggagagcaagaatccatcgcacaattaaagtacagactatagggaagctattcccgaaggattcagtctccccataaatc

SEQ ID NO: 35672 - DNA, 985 bp, Heterodera glycines
cgtcccgcaaaaaattttgagttccagtcccgcagcgggatccgcaaatttaaaatttccggtctctagttacaagtgctgccatatcaatcgcactagtttgtgatgagaagtttaaactttttttattgaaaaatattaaaattaaaattggcagggctatattataaacaagtttaaaataatctaaaccatctaaacccgaaatattaaaccaattttgtctaccaaatatattttagaaaaacaaaaatatataaataaaacaagtatttgagtatttattaaaacaaatatcagcagactgaaaatcaaaaataaatacaaaaataaattgatagccgatataattaaaccaaaataaattgctctaattaggaatggaaatcattgttttaaaaataatatgaaaatttttaaataataaataacataattaataaataaatctatcaaattataaatgcaaggaggaacatataaataaaccaaatgttgtgaggataataattaaaaagaaacaaaaaaatccttaaatttttatttagtcggaaaagtaataaaaaaaattttatacctattttaattaaaacatatttaaaattaagcatcgtgatgattagggatgatatttttaggtttttacctatttttttcctgagctccccgtagtctgaaatgcacgaaaaacatgtttttttgggtgttgttaagctacttttcgagttattagcacctattttctaggtttttatttttagcacctaaaaaacctaaaaaaattttaaaaaacttattttcacctattttggtgttttgcccaaaatttgttaacaaaaatgcaataaaaaagaaaaatacacccctaagaaccggcccaaaattttttttcaaaaaatacatccctaagaaatcaccagaaaattttcaaaaatgcgcccctaagaaataaaaaatttctcaaaaatttatctccaaaatttat

SEQ ID NO: 35673 - DNA, 848 bp, Heterodera glycines
ccgccggcgccgttgcagaagttcacgctcgctaagcagcagttgagccacaactttggcaatgcggcggtgccacaattggtggccgagttcaacaatttggtccgactttaagcgcccgaagagagtcaattgtggaggacagggatggattattattaatgacgaaaaaaaatttcatgaaaatttttcctttttgtgtcatttttttgtttgtaacgccgtccctcagaatagttgttaatatttcataatatatttttgtttgtttgttttggtcggagtttcgatttggaatcacattctttgtttgcaattttttaatattgtctcctttttcggtgctattttttcactttttgcaaatggcatctgagttggtgttgaacaatttgagggtggtcctcgacagtgttgctgaactgtgcgtccattcatcaacaggtggctggcatcaacaaagcatgcataattttaacaattttccaagtttagcagttcgtttggttgctgtttccaaggtgtgtttcaacggatcagtggtttcggaatttgtaaattttaccaagcttggtatcatgacatttctaaaaaatttccataaacaaaacgttaatttggcattgagtgataattcaatttcagtactattatggggatcgacccagttccatgccgccgtttccttgccgcaacacgggccttacttcctaattttcgggccctggaagccctacaaagcgatttgaaatcgcttgagaattcggggaaaaattctcaatccaatttaagagaccggataaagctggtaaaatagacaaaactccattttaaaaatttctatttcg

SEQ ID NO: 35674 - DNA, 463 bp, Heterodera glycines
cgaaaagtattgattattctcatagttattaaatgaagttgatgaatagaattggagccttggccttcatgtaattcataataattttctaaattaatggaatggtatttagttgctttatgttaataatgtcatgattattaacaaaatttttgtgaatataaatttttgccttatttatccctgacttatttcccgacttgagaatcacacgagataatttcagaatctcttcccgccattctatcttaattttttcctaaccaactaaattcataaatttactatttatttaaaatatatttttatttaattataagtttttttttgaaaccagtctaaacaggtaggctggtccttttatgctgttgtgtgcccaaataaccttggctcaactattccctttttaaaccttgtcttcgtaatggttcaagtgtacacatcaaaatgccatggctttctg

SEQ ID NO: 35675 - DNA, 791 bp, Heterodera glycines
cacctcgtcaatcccacggagtggccctccgacggccctttcggtcagagcagccaggactttcctcatccgacaagaccttacgaagctcgctcgacggctacgacaaacaccccactgttttcaatgaggatggccttttgtgcctcaaaacccggctcctgcacgcgaatggtccgcccactctcgcctctcccgtccttctcgaccgccattcatctctgactcggctaattgtccaagaaatccacgccgaccgccgacctaactctccagtagggacgaactgaagtctgtaaattgtctgcaagacaattgacagatgcacaaatccttcggcgttggttgattcgcttctgttgaccttctctcgccgcaaaaattcaattggaatgctgagtttgttgaatgtacaagcaaacaacaaaattccaaatttgcttcaattaaattgtcgacaatattcaaaaagcacgcaatattgcttcaattgcaataaaaaaaaaataactgctgcacgggcgtcgccaattgttgtgccggccgagggcaaacaataattaccaaatttattgaagacaaaataaataaacaaagaaagctaagggggaatatcgattggggatgaagcaacaaattaaatgaagtgaaatacaagtgaaagaatgggtcaaagggcggactatttatggggaggaaagtggagagagacaacgggggcgaggacacatacaaataaataattggggcggctacatgattcccatccctaacatctccccccttaaaaa

SEQ ID NO: 35676 - DNA, 880 bp, Heterodera glycines
atttctatgtaattctagctgaactcatcattagggggtgtatttttattataagctgatcatataaaaattgatcccgataaatatttgaccaaacaattatttgagagcaacaatttggtagtggaaattggttcatcttcagaagtgttccgtgaccaaaatgcgcactgtcggcacgggccgcggcagcggaggggtcgcctgaggcatcgaatcaaaatgcatttgtgaaatgtttaccggttcttgctcgggcagtgcctttttgataagtgggcacaattgtcgcgtcgaataagaaattggagcaacgattaaaacggaaagaattgggtgggaaagggaaacgatcagcggaagagtggtgaatgccaattcgaccattaggcgagtgcacttgggggggggggggagggcattcatagcgattgaaagcatttgaaagacctttccgcacggattgacgagcacaaactgatgaaggaggacagaaccggtgagaaatgcacaaagtgaccagagaagggcctcgacgaaaaaaaggtcgcggaaggaaagagccaagtaaaggaggagggacggacgacgcgtggagagagtgccacgccctttttgtggaagcgaatgatgcggctaaacagagatggccaaatggcactcaaaaagggtggccaaatgagcggacggaccattctgttcttcttctgctgttgggaggacgacgccgaaacgaattgccacagcaacgattggaccaattgggaacaaagcatcagagtgagcagagcaaaaaacatttctttctgacgaacggccaaaggcaaagaacactaaaaaaggggggaaataaggcaaaaaaagaaacgaaaaaagaaat

SEQ ID NO: 35677 - DNA, 949 bp, Heterodera glycines
ttaatggatccttttcgaatgataataatttaatttaattttttgcggcacaggcaccggcatcgtcaactgcaaatgatggcacaattgaggatgaagaggaagaggaggaaagcgccggaggggcgacgaatgccaaaaaccgtaaaaataggaaaagccgacaaacccaacaacaacaacaaaagcagggaccaaagaccaagtcgaacaaagaattgttcaacggagtggtggaacgtaagtgattggtcattttattagccaattttgacacgagttttgatcccgatcaaatatttaaaaactaaatcacagcagtatgaagttaatttgaagtccgattctggcatggaattgagagaattggaactgattgaatgcaaaaatcataaatgtgtattttaaatgatttaagtccaagtgtttggcaaagattttggctaaaaataaaacaatcattattttcatgccaatttgtgcgctgattagtttcccggacacaattaccgtatttcctcgaatatagctctatggggctctattgtgcaacccctccaaaaaggggctacattcgagagtggggttctattcaagggtgtggctcaattcgaggatatacggaatgcttttggcatcattcaaaattctgatctgatcaccatacgccagcaggagatgccaaccaagaaaaaaacaacggtgtagcgaaatgatctgtgatcactgatcagtagcgcaaaatttaccaattttctgatcattattgtaaggctatacggttgccaagaatgtataatttttagaagcaaaagccaaactgacgcccaaccaagcactggtgctggtccatgtgctggaccgcaacgacaaccttccccaaattgagcatttgaacgtggacgggcaaagtggtgggtgaacacacacaatttgatggatttcataa

SEQ ID NO: 35678 - DNA, 1143 bp, Heterodera glycines
  misc_feature (84)..(84): n is a, c, g, or t
  misc_feature (123)..(123): n is a, c, g, or t
  misc_feature (160)..(160): n is a, c, g, or t
  misc_feature (207)..(207): n is a, c, g, or t
  misc_feature (301)..(301): n is a, c, g, or t
  misc_feature (1079)..(1079): n is a, c, g, or t
aaatttctcaaaaaaaagagatagtcatttttcttggatataagataaatttaaaaatttctctgagaaataaaatggcgatgncgcaccgccttccctctcacgctcgagcgcttttgtacngtataaatttctcaaaataagagatagtcattttctnggatataagataaattaaaaattctctgagaaattaaatggcgatgncgcaccgccctccctctcacgctcgagcgcttttgtaacgtataaaatttctcaaaagaagagatagtcatttttcttggatataagataaatntaaaaattctctgagaaattaaatggcgattgcgcaccgccctccctctcacgctcgagagcatttgtaacgtataaaatttctcaaaagaagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaagaagagatagtcatttttcttggatataagataaatttaaaaattctctgagaaattanatggcgattgcgcaccgccctccctctcacgctcgagcgcttttgtacgtataaaattctcaaa

SEQ ID NO: 35679 - DNA, 905 bp, Heterodera glycines
aaattgaaataataaaaagcaatgaacatttttttatacatttctggtaaatatcaaaatgtaattttatgaaaaagccacttaattattataaaaaaaaggaatgaatatgtcggactaatactaattaaattaataagaaaactaaaatccaaagcctttcaaattttatttagcgagtaatattaaaaaatatatatattcctaaagatggaaggaaatataaaaaatttgatatttaataaaagtaaataactatttatattggcacggaaaaatgcaaaagaaaaatgaaaagcttacagtcgggatcccgactgaatcccgatcccaatcaatctcgaacattttggaaaaacgatcgtgatggctcccgagtcgggatttcgaacaaatcccgatcccgatcgatcccgaagatttttcgtgatcccgcgggattatcgggatttgccaaaactcaattattttttaggttttgtgccaagttgtgttcaaatgcttatctaatatttataattgataggtctgctaaatatatattttttcctggcttctccatgttctgaacagtaggaaaaaatcttagaaaaaaaaattaaggaataaattaaatttcaggcaaaaatcaatcaaaataagataaatagccaattttaatctaattcgtcataaatttgaatgaacaccgaataattaattttatgtacgagaaatggttagtaattaaaatgcataaaaattatgaatacatttaatacacagtctaaccgaaagtaactcaaatacagtgatttaattaattaaaaattataattatcaaaataattatgaaaaattataaaaaaatataaacaagtattcaataaataaatataaagaaataatccaaaaaaatctttaat

SEQ ID NO: 35680 - DNA, 1074 bp, Heterodera glycines
  misc_feature (77)..(77): n is a, c, g, or t
tcatctccccccccccccgctgttttgctcaggctcgcgttctttagataaatatattttgcaaatcaccccccccnccccgcacctggtacatattttcgggtggctttttcttcccccgtcgaatgtgtccaatccaatcgattttcttcggttgcaaaaattcctcggcttttcattttccatgctttgacaaataataatttactttttacaatcatttctctttatttagaccgttttgacaattccttttaaagttcaattaatttcgaccctggctctcatcgccgcaatttcccacctttttgtctttgttttcttttccatttctttttccgaagatatcacaatgattggctccaaatcggaaactcatcaaatgaaaaccacggaaaattttgaaaatccaatctcaaaattcacaaattatgcgaattttccgccgttgccaacggcagaagcaatcattcagccgatgaatgccttttttgaacactttttcgccacggatgaaagcatagaaatggacaaatgggagaaggcattgcccaccaaattggaacagcaacaaatgcgaaaggtcgcagcaccgaaacacgtgctgagaataagcattttggatccgtttttagttgattcactttctcttccgtcttgacgtcttttccggcatttcttccgatcgccgtttcctccaacgatttgtgcccactttggccaaatctgttcagctcacttttatcggcgtaattttgccatgattttttcttcttacaagtgattaaactacaaaatgtttaaggagcttttctgcgtcatccatgaacattttccacccgccccttttcggagatttccccgcttttggggttacaccgttctcaccgcccgtgcccactctttacggccccatctccaccattccgccgcacacttcgaatcggacggtgcattttaatttgcttattttcatactaaaggtcaattttaactacggtagttaacaacatcactttttggtttactaatatttctcattgactttttaaaggcaatgtttgcaatcaatcg

SEQ ID NO: 35681 - DNA, 1028 bp, Heterodera glycines
ctcgaggaatcaaggtccccgcgcgggcgttaatttgggttaatttttcaatatatatttttttaaatcccatactctcgtggctcattcagtcctctcaaaacatgaagaaatgaattctcgagtttaatttatgattcaatcaggcccgtaactagaaaaaatcttcgaaggctgctctaaggatcggccaaaaaaatttgttctcaagtgatattttttcaaatttctcaatgctagggagaaaaggcagaaattcgtagtccttttgtaagaaaatttaggaaattttaatgaattttgttaaattagtccttttttcttgaaaaatttttaatttatggatccatgttaattaatgccatgttccgtggctatagtaattgtgccaccttggctgcttggagttgtgtgccacgccatgacggcactcgcttttccttctttccgtgccgactcctttcccaaatctgttgctcctcttcttcctcctcctcctcctcctcatccttttcatcctcttcttccttttcttcttctttatcttgtcttttttcaatttccttaagattgtttttaaattgccttaggcaataaaatttccactttttctctgacctcctccttttcctcttctttctcttcctcttctcttttcgttttctctctttgtctgtcttcctcttctttttccatttccattctttggcgcttttttgcttcttttcgtgccttcaatttggcttcctggtaacaattttttctatttttaattgcttctaattttcattttttgcctctttttggcgccgccgtgccatttccgccgcctccttcagctttgctaacatccgctcttcttcatcatcggcatcattatctttgccattcttcatctgttcatcctcacaaatttaaaaaaattatttttttggtttttcatttttgcctctttatttttccatatatcctattttcccctccttttacttcttcctcttcttcctccctcctcctcatcttcttct

SEQ ID NO: 35682 - DNA, 923 bp, Heterodera glycines
  misc_feature (620)..(620): n is a, c, g, or t
  misc_feature (893)..(893): n is a, c, g, or t
ataattcatatcaatttgcatttaattataccatctttccccctacgcacactgaaggtaaatgcccaaacatttattttccatcaattgatttatttgtgccaatattttccatggcaatccctttatgaaagtgacagattcacttttacgttcactccaaatgatttctcgtgaaaaatcggaaaatttttcaatttccatcgaaattgttgcgtcggatttgcttggatcatgagtgaattttgccacttttgcatttttcactattaaatcaatggccaatgtcattttgtcctcgcctttgttgtaaaaaccatttccctgatccatcaattccttaattagtagtaattagaacaattaagtgaaagttaaagtgcatcttaactgtcaatttaatgaaattgacgaagccccgacagttccatttattgttaaaaatgatgtcattaaatttcccaatgcaattctcagcttcggcattttgtgtgacaattcgaaaggttgccgagcaaaggcatgaaccttaaaaaaacaatcattaggcaatttaaacaaatgctttttttaaccttcttttgacgctttgcagaaaaggaaaaagcccaaaaattttntctttggtttttatattaattcttatttctgccacaattctccatccaaatcccattatttgcactgttttgctgtatcggcgactccccacagcttctctcgcaaatgcggacaatttttcaatgtccatcacaattgtgccatgaggtgaaatgcgtccatggcacggaaattgcagtgggtacagtatgccgttggacatcccacgaaaattcgtttggctatggtacttttcaatgctggtcacttcttccgctgttacacgccgaaangaactgaaagattagaaaaatgaataaaat

SEQ ID NO: 35683 - DNA, 658 bp, Heterodera glycines
tttttttttgcgcgctagttccgatatattgagcataaaatatatatttccacttggtttaaagcttctacgttgacttttattacgcctttttttgatttttttgggattttcgtgccttaaatgccttttttggtgtttcgccgttttggtgctttttggcgtttttttccgaaaaattccattaaaaatgcaataaaatacacctctaaaaattgaaaaatttctcaaaattgatcttcaaaatttaattattatttttgataaaaaaaaaagttaaaaattttcctaatcaaaaaaaaaatatatataattatttattaatcatttaaatgattagttttttttattacgttttacgtgctttattccataaaaatccctaataaaaattttgtgcctattttcatgcttttttcaattttttggtgcctatcatattgcctttttcgcgaattatggtgcctttttagtcggtctctatggaaaaaagcggaaattattaagtgatataaaatgagtggttgcgattggttggaataggacaaaaaatgtttttggaaatttcaatttattgttaaaaaagtaatagttcaaaaatttggctatcgccgaaacgacccattccggtttttctgaaatggataaaaaaaaatgc

SEQ ID NO: 35684 - DNA, 980 bp, Heterodera glycines
aaaatccctcaaaaataaaaggtctatgcgcaccgccctccctatcatgctcgagagcattgttatgttataaaattttcaaaaaaagagatagccatttttctgggatacactctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttttcaaaaaaagagatagccatttttctgggataacctctaaatataaaaatcctctgtgaaataaaatggcgattgtgcacagccctccgtctcatacgcaagcgcttttatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagagccatttttctgggatagagtataaatttaaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccat

SEQ ID NO: 35685 - DNA, 734 bp, Heterodera glycines
cgatgacatttttattgcacgtaaaatttatgaaaatgtgatatgttgttatatgggtggggcttttatacaacaaattgtgactcgtgaacccattcacgctcgggataccctatgaacttaacaagcatctcagtggacccattcgctccctttctctttctgtacaccttttcaatacgatagcttgtctgtgcatcctttcttacacgcgccagctcctgctcatagaaactacctttgaatttctctccgcgctcatcccgtagcttgcaccgaatggggcgtaccgctttcagtacctcgtcaacctccaatattttgtcaccataatttggcaaatagcttttctcaaactatcacttctctctgctcatgcgtacaaaatcgtctttgcggaagcatagcggtcgtcgtttttgtggcgcaccgtgtccatcaccgtcaccatataatcgcttcacacgctctgagcattagaaaagcccacatcaatcggacgcattccgtgggcacgtgacggggagcggttaatcccgtccacgattttctgtgctgcatccacccagttcagcgtctccgtttccgcaaaataccggtacagccgctgtttcacattgcggatggcccgatcggcgaccgacgccttgaccgacgaatggaccggctcgtgtttttcaatttctcgctgctcaaaaaagtccttagtaatctgttcttaaactcggttccct

SEQ ID NO: 35686 - DNA, 1272 bp, Heterodera glycines
  misc_feature (28)..(29): n is a, c, g, or t
  misc_feature (35)..(35): n is a, c, g, or t
aaataaatataagcaatatttattgtannataganaatttcggtgtttctaagataatattctcggtccctgaaagctgaaaacccgattggctttcaaactcgcaaatttgaagccaaatgttagtccaatctccatgcaaaaatataaggggtcaacaatgaatgtgtggagggtggagggggaaataacaaaaacataatgcacacatattcaaatggtgtctcccgaacacaaacatttaggcctttttgtgtgaacggacaaagtgtagacaggcatgacaaaatgtccatatctcttgaaaatacaacttttatataaatctttttttacaggcaacaatggtggcggaattgaaacgccggctcagatcatcgcagatgcagctcagaccgagccagcggcggcacccatgccaccgcctccgcctcaggacgtacaggcaggctcaagaggcctatttttgtttcaaatatttaatttgttatttcatttccaatttaataattatttttcttattcttgccaatatttgttcagtaggataaaatttaatgagatatttaatattaaatatttccaatgagttaatttttatgctttctaagaaatcagtagaattgcgatttttgtcatgtataaaaaacatattaatattaaaattatatttttgaaaaatagatacaatttattttgagaattttctaacaaaatgaaattattactattgttttattcaattttaattttaattaccctaattaatccaattgaatcaacaaataaaaagttaaaagaaaaattaaaatgaattgaaaaaatcaaccaaaaattaactaaatttttcatttttttaaagaaaatgatataaggttttgtgaacgatttttgcataatcagggaattatacgttttttttattaaaaagtttttgttacttggcgatttaatatttgaatatatttaaaataaatattagacaattgttaataagaattaagttttagaaactttaattttcaactataaaatctgttattttgaaaatgtttcttatttttcaaattagaataaataattctcgtcaaacttctgttcaaatatctcaataattattatttttctaaatttacggctgatcattggttcatatcgttggctcgtaaaggactctggcggtgttgggggcttggtaaataaagcccccccccacacaagtctcatagcctacccaagaggcactgatgtcgtccatcagggtcaaagtga

SEQ ID NO: 35687 - DNA, 254 bp, Heterodera glycines
tccagtcgctcggatggtggggcatctttcggtagctgcttttgaaaatcagcctcttccatgagtagttttggatcgatactcaccacgtcagacggttttggcatcatcatgcgggtgataaatggcatcaccacaatcaacgccacagtgatgaaaatgttaaaaccactgaacagagtatcgcccaccgggatcagcccggcgatatgctcaaccgggttgcccggtgttgcagccaacagaggcattga

SEQ ID NO: 35688 - DNA, 905 bp, Heterodera glycines
catcaattatgaagccgcgcatgcactagcaacgaagtcctttgcgcgaagcgctcatgtaatgcatattcttttcatctctcacaagtatactgtctacaccgagcaattactgtgcaaagcataatgtctacgccgagcaattactgtgcaaagcatactgtctacaccgagcaattactgcgccgccacacgctagtttatattactctacagaaaaagggggtttcgtcttcaaaaacaaaatctcccggccgaaggccgggagcgccctgaaagtagtggaagggtcttacaactttttgaggcgcatctgggaaaaatacgggtttttctctcaggtggccaactgagtcccggcggctaatttctcacttttgcttgcgtttgatggcccgtaactttttttctaaaactcgaatcaaaaaatgcccgctgcgagggcaccccgccaaagtgtcctctacatgctggtattatttatttttttaatagagccaccccctggcctgcagaaaatggcaactgaagcgtgctcaaaaagtacacttcagtaccaggcgaataccgagtcggggttttatctgagggaaaggtgcccagcagacttattgtagagttttggaagctcgattttctgaaatttaaaaatttcgaaaattttcaaaaattttcgagctaggcctaaaaaacggttttcgggtttttgaattttaggattttttaacgaattttcctggcaaaacggagaccacttccaaaacatagtttttcgagctctatcgactggtatttttttcggaaaaatttcgattttttcccggaaatagaaaaaatttttggcctcagcgggacatttgagtcccgggcccataactcgtcaggggttggttttagcaaaaaat

SEQ ID NO: 35689 - DNA, 1037 bp, Heterodera glycines
  misc_feature (10)..(10): n is a, c, g, or t
cctattctantgaccacattctgaaaaaaatcccagaaatacgaggaaagatatgcttggtcacaataaaataaaaaatggctagtatgtaaaaatttgcggtcactaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaagggcaggacaagaaaagaatgaagttgatgcctcatgaaactcggaattggttatgtttagtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcgactaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagta

SEQ ID NO: 35690 - DNA, 888 bp, Heterodera glycines
catattcatttgcacagcatccttttcacttgaagaaaacgcaaaataaataaaacgaagaaaaatggacaacgcaatgaatgtccaaacgaaaaattgttggaaaaaataattaattacgtttgattgaacagctttttgaggagaaagaatggagaaacggttaatgagagacaaattacgatttcttaataaaatgcaaatttcaaaaaatgaaaaagagagaaaatgtgagaattgttgagcatcagtcagacacaaacaatcaaattttgagatggaattttcttcgctttctctccccgtcgttgtcattcattcgtcgagttgtaatagagttgaaactgaaatgagagatggactcttttctgtgttcttttcccccggatttctcgccttgccaatcgaatctttttttgttggcggataaattaatttcaacttgggacagaacagcgcgaaaaagtcctccaatcgttgactgtcctgcatcagtttggcgtcgaacaacggctcacagtcggaaagcactttgtggagcaggtcaaactgaattaaaaatgggggaaatgaatggaatgacgcgagactgaactggccaaacgcactttgaccggcgtggaacagcggaatttgtatttgtatttgcagaaggaagtcgcaatggcacccaaatggtgcattttttcctgaaaataaaatggtaaaaagtaaatatttttattattatttttgcattatttatgcctcggtgagattctcccagtcagcagaatgagcagcagcaacagccgacttggaacttaaagggagcatttgcattttagggcgatgctttggcacactcttcgcccaccatggcaccactccgtcgtcgtcggatgagtc

SEQ ID NO: 35691 - DNA, 1296 bp, Heterodera glycines
ttttaaatcctttttaaacagtccaaaaaagttttaggctaaaattttttttcagaaactgatccaaagcgcgccaaactttgcagggatattgtaaggaagagaaatagcatctctaaatattatctagtcagatcatttgagagatatatatccaaaaaatatttttaggtgttctcggggcagtccacctgaaccgatgcgcccagatttatggggagatcgtatctttcgggaatagcttccctatagtctgtactttaattgtgcgttggatttttgctccccatatatgttagagtaccccaagcggactcttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatctttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaatagggtagttaaatattatctagtcagttcattt

SEQ ID NO: 35692 - DNA, 814 bp, Heterodera glycines
  misc_feature (8)..(8): n is a, c, g, or t
  misc_feature (38)..(38): n is a, c, g, or t
  misc_feature (75)..(75): n is a, c, g, or t
catcaatngggcatcgtcgttctgctgctgatcagctnggtaagcataataatcttggctccctgcgccctctcncatgtgctgttgttgttgttgttgttgtgcaatgaacatttgttgcaactcctccagcgaaatttctgcaaattgcggcgcaaatgcatcaatcggttgctctggctctgtttgacgttgcatcgctttgtccatttgcatttgaaaatcattttgattaaactgatcgaatccgcccattccctgctgtgcaaattggtgaagctcatgcgattgttgccaattcggcggatcggatggacaataaatttgttctcctgctacaaattgctgggcatatttttgccaccacaaatccaaagacaatgattgttcccaattttgatcagttggataagtattgtaaagcgtttgttccgcataaatttggtgccaattttcagttggagtttgtccaaattgtgcctctggcatttgatgccatggcatttgcccttgttggccaacagtttcgtcagtgactgaacttgttcctgacgatgatggtgtcatctgctgctcattcgatagcattggcactttcgtcaaattcgtctgcggtggtgccgtccccgtcttcgtcctttgctgggcgtttgagttggagcatcgtcctttgggtgtccattagggcacaaaacttgtcaccatattagtgatggtaatagtacaagtagtgacgtaattatcaagaggtttgagcattgcaatgtgaggggtaatatatgaacgtaggagagtaaagagtttgtcaagaaaa

SEQ ID NO: 35693 - DNA, 745 bp, Heterodera glycines
agtctaattacacatcaaataacaaaaaatatactttagccttctatgaagcttttatgattttgttttctatccatatttctccgtttaattggtccatactcaagtgtaggagcctcaaaatgtaaatgccaaaaatctgtgtcgggcgttcaaatgtcaaatcttcaaatgccgcaccacatctctctatccatactgtacctgctgcttgcgagacgggcatttggcttcttgttctccggacatccgccctcgccgtccttgcggcaatttttacacccttgcggacagtccctggcatacagtttatcgcaacagtagtaacagctgcacgacacatctatgtcacaatagtccacggagtgatccttgtgtttgagatcaaacgcgcagaccacacagttattgccgaaaatgttgcaatttcctggatgcactggcagcatacaactaaaaaaaattaaccagttttcgttgaaaatttttcttttcctgggggtcgcggcttattggggaccgcccactttggcgcctgccattttgggccaaacattaaagcataaataaataaatggcctctgctggtgtaattttagaacgcttaatagtctttattacgggcccttttgtagaaccgggctctcgcaaagtgtcagtggaaatgcgtcagtgataaagtatttttagaactatagtattttgtgtatgttgtactgtaatataaaaaatttaaaattgtcta

SEQ ID NO: 35694 - DNA, 1004 bp, Heterodera glycines
tttctgttgttgttcattcatcacaaatcgcgtcaaattcgaattggatttcgcttcatttctcctcaaatccgcccccctccattcgccaatttctctccccccgataaatgcggtcgaaatttgagcctaggatatttgcggtcactttcttaaggccattttcggacatttgcgccaagactttcgcggcatggattaaaataagtctcttgatttatactacactgtgttacattaatataaggacaccttattttttgttagttcccatgaaccgatcgagttgaaattttaactgtacatagcgattctgaaaatattaagattctaacagtgacaagacgaaaggatttcggaaaaaaattttatggatttttttttcaaaaaaggggtgttacataaatataaggacactttggaatactgagaaaagcctcaacaactacaaaaaagaaactgataaaacaagctaaataataaagaataaatcttttttcacatttctgtttattttgcgaacagaaatatatcttttagggagagtttgttgaattttctaagttttccgtagaaattaagggccaaaaggcttaaatcgcctctaacatttgcccaaccgatcaaactaacagcaaccaacactaagataatgtacagacatcccttaagcatttttattcactttatgccagaaaaaattcattaaacacaaaatttttgcgggtgaaaaaatacgaaaatctgagtaaattcgaaaaaaattctagggggttgggaaaaagtttccgtagaagatgaatatgacgaacagaaagagcacaaaattctctacaaaaaggcctttggatgattgctctatggcaagtattcgctgacaaatgaggagcgtttggttaaacacgaatgtcgcaaaaagtaaggaaaatggctaaaaattggtcatttttgtggttgttgatatttaaccaaatgctcctcagcggaaacgcggcatagtgccc

SEQ ID NO: 35695 - DNA, 963 bp, Heterodera glycines
aatgctatcgaacggtgtgctctatggccggaaattttctataattttcgagctaggccccctagaaattttcggaatttttttttgggttgaaaaagagggtgaaaaatttttttctgggtatttttaaggtgctgagcacgaatctgatgatcattttcagtttaggaaattttagaattttttaaaaattcaaaaatatttttcaattttttgccctcgggattttgggcgaatattggtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaagggaagtattttcccacggtcaattgtatacggccttctctcgggcaacagacggaaacaatgtccgtgttcatgctcccaaccgggaaattgatgcccaaggccgagccaaagtgctgaatattgtagctactaatatgctcaagttacaataaatggcttagtccagagcagttgggcacatggtttttggagagatgccaatcccattcccatctgcactatgttgggtgcgaaaatggtgagaagcttggatccgggacatggaccggtcagccctctttagggcctacaggtgaattgccatttagcgctcaacccaataacgtgccaacgcctggactaagggagggaggagggccatgatgtgcaacgttagggcacttccggtttccattgcattatgcgatgtgtcaactccaattattggaggaaaccaagtgcatgtcggctgacgcaaagaccctaacagactaaaacgcgcctaggtagcgaagctcaagaagcgcgcagcgctttcccaagcgccaccctcgcatgcacacacccgctagttactata

SEQ ID NO: 35696 - DNA, 1603 bp, Heterodera glycines
  misc_feature (199)..(199): n is a, c, g, or t
tctttcgttcatcacctcaaattaattgacgcggttggcggagagtgccaaaaaaagggagggcaaaatgcggggaaggaaaagcaaacatgcgaatttactcattgttttttgtgctgcttaattgctttttgatgttattcttttaattatgcttattgagttcgtatgttcgcttatttacattttccgtcccctntctttcctttccttttccccccgggggtcattcattcccttcgcttgtaaaagtgccaatttcccttttctcctctcgtccttttttggtcaattacccattcgtgtgcccatttggccttactttgcttctcatttgaatgcgtccaatcgctgtaattccttttcctccttttctcttctcttttcttccctttttttccttttttcctttccctccgccggttttcctctgatgatttattgcaatttgttattattattattattatttcttgttatttttctgatgggtttttttcaaggaaatcaaaaaatttaaaaataatttccctttttataaaataaaaaataattcctttttttttgcccttaaaatgtttaaattcgtccgtcgctcattcaaatgaatgaatggccaacttttccttctccatttattcgccgcccattgtcagttgcaccggcaaaaaggtcacttttttgtgtctgtcctccgaaagccccggccattaattaattaattaaataataattaattaattaaaatttttcctaggcactcaccgattcggccttcgcccgtccactctttctgatcgcttatttgtctctgttttttgtcggtttcgttggcaattttctcgtcgtttgggtggtcgccacttgcaaggtcccatcaaataacaaaatgtcattttattaaatttcaattcaaaaacagaatatgcagacggtgaccaacggtaagacgaacaaaaattgtggaaaatttcaaaggaaaaagggggggggggaagaaaaaccgaaaaacgaacggtggccatggaaaggacaccgccaacaatcaaaaatcgcttcttccgtccgtcagttttcatcgccaatttggccgtgtccgatctgttcgtctgctgcacttccatttggcttacgccttcttacactttcatcggtcattggatttggggtgcttggatgtgttacgcactgccattgttccaaggcgcttccattttcatttcttcactaactttgacagccatcgcattggacagacattgggtgggcggagaacggaggggaaacgattaaggaaggaacggggaatagggaaggggggggggcggaaaagggggaaagggaagcggaagacggtatatgggaggcggaagcggaagatatatgaaaggggaaagcggataaaggatatgagagaggggagtgggggagaagcggaagacggaacagcgggaggagcaaagggagggggaaggagtaatgagaaacggaagatggacctttgcaggtgatctgccgttctcagcctcgaactcacgcatcgacctccaatgaggtgtctgttgtctgttttcctttgtccgatgagtcggtcatttgtccg

SEQ ID NO: 35697 - DNA, 1111 bp, Heterodera glycines
ggcactcatcgccatcccgcccatggaattcctttgcctgttcatatgcgttgcctcgtgccccaattgctgagaccgttgccgctaaaatggcattttatcgggatttgggtgggataaaggcgattaattggcggaaggaatgcgtgtcaaatggcactcacaaattgacgcccgcaatattggcacgtgaacggcttaaggccggtgtgaattcgctcgtgctggtccaaatggctctgcaacaccaattaatgaaatgggacggattgcgttttttgaccttttgcgtaaatcgtttggggcaatagcgacaatggtaagggcgatcattgatgtgaatttttaaaagaatacgacttttgcggttgaaaaatgtgcaaagcaattaaggaacacccaataatgaattccgccgaaaattaaaaaaaattaataaaataaaatttgaatacaaaataccaaatgccgtttccccccccccccccccacccaaatttgactacgagtcgagcacaaatgaaaaagctgattaatttgtataattgatctgttcccaatgggcaatgtgatcaaactctgatcacgtaggaatggcctaacacttgacttgccaattttgagtaatttttaaatgtcttggataattgagtgctaaacgtgggttagctgccctcctccgctgcacgtactgctgtgctgctgcagtccgccgcgtgctttgaaccgctttccgcattgcgtgcactcgtgcattctgaccattctgcagtcttccaaatgcgcttgcagttcggcttggccgcccacaattttcttcgggcagtatagacatttcagcgaattgccgccggatgagcgctgtcgccgttgagaagggatgccgccgcgagaccacgggacggccaaagagccggcctgagcagtgatccagggcgacgccgaactagggaaactgacagcactgttgatgtgatggacccagaaggacaaggcattgagtcccgggagaaacgtgcagagtcaagacaaattccgttgagagaaaagatgtatgacaaggacacataccgacacaagctggacaattatctttccaccatcaaggggg

SEQ ID NO: 35698 - DNA, 430 bp, Heterodera glycines
cgaccaagaacagcagcgttttgcgcaccgcaaattttcttgtgatttagccgaagcgtttcggaaatgcataaaagaagtggtagttggtcagatggatggacgaaatgcacaggaggaggtcctgggggcatttgttgatgatgttgggagggaccgaacaaagacgacggaatggttggtggaaaagtggggggaaggggggatagaggaaggaagagggggacgcgaaaaggactatgacgacgcaaatgatgcctcacagaggggaaggaggggacagagctgttgtttgggattggaggttggttgaatgttgggtggtagggaggggagaaaaaagggggggggggaggggaggggaatattattgtcagtgaggagcggtatggcggagtgagaggcaatggcaatgaatgctaaactcgga

SEQ ID NO: 35699 - DNA, 946 bp, Heterodera glycines
  misc_feature (916)..(916): n is a, c, g, or t
tgatcaaatgaaaaatgagtgatcagagagaatgaaaatgttggcattgggtaattaatttaaaaaatgaaaattttcattaaaaagtgccatttaaattttaagaggtgctttggatggtccatacttcagggcatttgcaaattacttcaaacggtaatccacttacataaattaattatgttatttgaaattttgttgagtttcttcgaggaataccaacgaagtgccaatgtcactttttggggccttacactgaccaacgaaccgttgcacggacaacggccgggcatgtcaatgaattcgtcagtccaacggtgggtcccgggaagggcagcaggggaagacgaataccgaaactcgagatcgagaaattaccctgaaaccgagaaataccccgagaaccatgactctcacaattaattcaatagtgccagcgaaattttggcattttcaaattcgagtttcgataattttgacaaattccgaacttaaaatgtgaagagaaattgccataaaaactttagttaaaattgctaattaagcgatttggtagttttttaaatattaatgaaaaatattccacagcgattgggccaacaaaatattggcaccgcttcttcaacaatcgccaatctccaaaaatgtgaccataatggcgcatgatgacaacagacatttgcttttcgatgcggcaaaagaaataagatttcgtaatttaaaatattttaattttattattttttagatttttggccaatggaatgagtccaaaaatgccatcgccggccttggcgtccattggtactcccctcccgaatatccgtacgacgtgctctcacgagtccacacgcttttccccgaaaaatttttattggccacagaggtaaatgtgaatggtttcataaatatttanacatttaatttatatatcccataattcata

SEQ ID NO: 35700 - DNA, 1160 bp, Heterodera glycines
  misc_feature (35)..(35): n is a, c, g, or t
  misc_feature (39)..(39): n is a, c, g, or t
  misc_feature (98)..(98): n is a, c, g, or t
cgacaggtcaaatgggtagtagtgatagagacaanttancattggtgatgaaaaaaatgaggtcaatgggcagttgtgatatgagttgaaatttaatntaaagaagcggaaaagtcgacctccagcaaagggaaattggtttttataacaatttgagtaaaaaattttttgtgggaaatttttaagaaatttgtagtagaaataaatggaaaaatgaaatgaatttcaataaaattaaaatgaaaataatgcaaagaagtttttatgtgagaaaaagaaaaaaaaacattgacgatttgatgaatttaaaagtttatatggccaaggcaaacagaaagaatttgtgaaggaattgggcatttctgaaatgacattttggaaatggaaaaaagaattaatgccaaattgtcataaatgtaagcaattattttaattttgagaatttttttattcagttaaatatgtttttagcaccaaataaatattccaatgaggaaaaattaagaaagataaagcaatatttcgaaaccaaagaaaagaatccaaaaatttgtgatgaaacaaaagctaagaaattgagaattgcgagtgacactctgagaatatggaaaagaaacttactttagttccggaaaagtgattttttaaagaagtttatgtttttttgatattagcttgtttatgttatgataaaaaaatttaattgttttatttttttgtgtgactaatagcgaaattttaagctggttacaaaggcctaaattaatttaaatatgtttagaagtgttttagcccattttcatactgctcgagaattttgttcaaaaaattagcatttgagtcttaaagctataaaatttttaatcaatttaaatctcatttatttaaatttaattcttttttccattttatatatttttgcaactttctcctgataattttccaattttcttttgattagttttgatagcattttttcattggaatattcacttgtttggtcaattgattcggttccattttcttcttctctggtttcttgactttcttttttgtcccattcttagccgaatatttcctttttggtcccagtgcccggggtccaaatcctacagggcggtttcctaaaaaccgcccaaggggggggtttcctaaaaacc

SEQ ID NO: 35701 - DNA, 1632 bp, Heterodera glycines
  misc_feature (1499)..(1499): n is a, c, g, or t
ggggaagttgtattcttacattacattttaagaaaagtatattttaaaaaatgacacatgtgtttttcgatcccgagtcggtcgattggtcatcttttatcactccccaacatggaagaggacagaaacaatattttgtcggaagcaagtatcaacgaggattcggtttccttggtaatgtggcacgtttcttgacccctattgcgaggaatattgcctcgagtgcaggacatgaggggctcgccgcggggcagagagttctgagtgacatcgctcagggccgtgatttaagggatgccgtcagggaacattcaagacaggggttgactaaccttaccgacaagttacaacaatgtgggaaaggaaaaaggtctctgatcactaataagaaccggaaacaagtatatgatcagttaagtttcatctaaaggtataaatggaataaataatacaaaaagttaaaaatgacaactctcaagaaaatcgacacggcgagtgaggacggtctcgaggggggcctttcacttttcgacatccctccgacgaatgttgcaattaataaatccagtattcgggaattgctgccactttcagcaataaatcaatctggaccgtatatctttagacttttttcagataatcagttttgtgatctcaataaaacttttctttatttgtcaacttcaattgagagaaaagacaaaagcaattggattccgattaccaaggacagtgaagctgaccaacatgtcggtgtcattcaaaattttgggcacagctttgtcaaaaccttaaaggtgtcaatttcaggtgttgagtcttatgattccggcatttactatgcgtttagggcatatatgatgaatgaattgggattttcagaagatgtcaaaaagggtctctgtgaagcgtcctgctattatgtcgacgatgtcgaccaggatgattatacaaacagtggctttaaaaacagagcgtcacgttttgctgatggtgcaaaatgtgaaacaatggtgaaacttaattttgatctcgcccgtcagtccaattttttgcttaataactctgacgtgatttttagcatacaccgtaacaccgatgattttctaattatggcaccgccatatgtttccggaaatgcagtcatagtgaacccgcacacatatcgtattaacatacacgatattagaatttatgtaaaaacagtagatgttacccagtcattaaataacataataagcaatcagctacaaaccaccccggccaaatatcctatgagaaaaattgagatcaggagtcttttcatcccgcgtggcacttctgatctttcacacaatgtttttatttacaagaccccgacataagcgaggacctcaaggcgaagagacatgattggctctataaagaaagacgtacggtaaaggggatacttgaaaatagaccacagaaggtagtgattgagaatcatgtaccaggtccaaatgttgcaccatatctgngcctcaataaccaatccaaccacaggagaccgaagaacacgggaaataattattcctaggaaaagacttaaagagcaaactcctgatcctgaatcagataatgatacactttgagggagtaactccggagccc

SEQ ID NO: 35702 - DNA, 1022 bp, Heterodera glycines
  misc_feature (1011)..(1011): n is a, c, g, or t
cccccccccaaacgaaaatttaaaaattttatgggtacatttttgaatataggcaattttcataacaaagtgcactcaaattttcaaatttttttccaaaaaaatcccggtcccgtgcaactctactttaaatattaaaatgtctaaattaaagtcttaacattcttttttattattttggatcagtagtaaaattacattaatctagtccaaattttcaaagctttcgtttattctaattcattcgattttgaactgcgaattatttaattcaaatttaatttaatttaatttaaaaataactgttttaattaggtggctccgccatttcccacctttctcaacaacatttaaactgatcgatcagaatatgactgaaacatttgacgcaattgacaacgaaattgccaaaattgagaaacaacgccaatttgagacaaatttatgtgccgtttcgttggtcgaccactttttggatgcaattaacaacaatgaacagcgcaaaaagaatggcacaatgccattggcacaggacaaatattttcagtaaaattttaattgaaaatttattaaaaattaatttgtttttggttgtttttaattgctgagacggactgggcaaaaacaggataaatgaattttataaaaaagaattctaattttaaaatccctttttacaattgttatttttcaaggaataatttaacataaatgtttacagcatggaatccctccgatcagtgtgctttgacttttatattgctgctaatgtaagtatatatactgtagtatactgtatttgatttaaaaatatttgatttactctattcatatagaaataatttaattaataaaaaaaaatatttttatacatacctacatctgtgaatgttcaggaaacgactggaaacacattgaatttcatgttgatttacatgattttaaatcagcatattcagaccaaattgcataacgaattgacggcattaattattattattaattatatanaacactattaa

SEQ ID NO: 35703 - DNA, 668 bp, Heterodera glycines
  misc_feature (12)..(12): n is a, c, g, or t
atgcgattcgcncacttttacatttttgtccaatatttcctcaacatttccaattaattttgccttttcctcactttttggcgatttgtccgcttttcctcccactctttcgagctgttcaatcgcatccaatctctgctttatctcgaaaatgatgcttgcttgctcaagaataaacactttctcgacgcatggcgaccgaaaaaaggcgtcgaacagctcattgagctttaattcgtcacaaaattcttaaattatttatatttattatactctgatttatgctgattattttgatttaccaaatacagagaaatatttcaaaaatattacttaaaagtcgaaaaggatttagaaaaaataaataaataaatgcctccattctctgggaagaaagattttgagttactatttttttaatatatttaagaaattggggctggctggggtcggcgtcgcatgtgctaggtcgtttcttaaaaactgccagttgtaggtaaataaaaaaatgtaaattggcccaatttcaacctaattaatatttcatggtgtcattcaatagctttatgtgttctctatcagaatattaattttcaaaatttttaaaatagtataaaaaaaagttatggttattaaattccacaaaatcataagtcggaattttttgt

SEQ ID NO: 35704 - DNA, 546 bp, Heterodera glycines
cgccgatccagccaatgtcgcagatccatccgatggtaaatgatctgcccgactgttggtcatggaagcccttcaaaaatgtgtgggggagggatagtatgccaaaaaaccaacaaaaaaaaaagagtgccaaatttgaatgccaaatttgacctgataagcaaatgagccgccaacaaagtccatttgctgttcaaacaacttctcaaacgtatggccatcaaaatgtccaacaatcagagcattcattcgttccctgaaaatttttttcgaattttcccgtaattttgcaaaattttcgatttttaaatcactaaccttccctccgcgtccttgccaagtacagggtatgagcctttgtccgacacatatgacagtacccattttgtgttacggtccaatgggtcgcccattgcgacaagcattgggcactcgcataagcgcaactcgaaacggttgtcctcatacacgacgccccttcaaaatttgggccaaattaagaattaaattttttagacactcaaaattggtcacccccgtaaattt

SEQ ID NO: 35705 - DNA, 754 bp, Heterodera glycines
tctccccctccctttcccctttcctttttccttcccctctcacctctttgcccccttcccactctcccctttcccccctacccctccgtcctcttcttctcttccccctcctcccttactgctttctctccccctccctttccccctttcctttttccttcccctctcacctctttgcccccttcccactctcccctttcccccctacccctccgtcctcttcttctcttccccctcctcccttactgctttctctccccctccctttccccctttcctttttcctttccttcttacctttttacccccttcccactttccccttttccccttaccccccataccttctcttttcttccccctcaccccttactgttttatctccccctccctttccccctttcccttttcctttcttccgaaccacttgaccgtataaccactttccctttttcccctttcccccgacacatagtatatctttcacaaatgcccttatttgtttatttatcttctctctttaacacaaataacacttagaaagcctcaaatccattagaacggaatcaaaaaccaacctgaatatcgaaattctccgctccttgttatatttctgacataaaacctaaagattttagacaaaatatgaataaaatatcgaaatatggacatcctacatcgcaaaatatggaaaaatatggaaatatagatatagaaacccattctaaaagcttctgaccaagctaaaaactaa

SEQ ID NO: 35706 - DNA, 780 bp, Heterodera glycines
ttttgcggtgttcacctcggtttcgtcgttttcctcatcggaagaagaacattcggtgcgatcaaagattgcaaaagcattaggctcaggccgtggcgaagacattttgtctgccctcggatggaataatagagcaatgttggaaggcaatgtaaataaatgtcttgctaaacatggatgactgtattatttgcacaattacaaacactagtgtagagtagctagtgtagaatgtctacactctacactactgcactcagtatgctgatgctggacaaaaagtgacagcggatgagcagtatcgctgcacttatatagacttttctggtggaacagtgtagaattgctacactagactagtgtagctgttctacactctacactactgcactcaatatgctggtgctgaacaaaaagtgacagcggatgagcagtatcgctgcacttatatagattttcctatgggagtagcgtagtaactagtgtagctgttctacactctacactactgcactcagtatgctgatgctggacaaagtgacagcggctgagcagtatcgctgcacttatatagactttcctatgggagtagtgtagagcattttaaggcagttttggaaggaaaaaatttctcagtttgaaacccaaaggggggaccctatggtccggaaattcgagatgacttttcgggccatagttttttatgaaaaagaggtagttaaatggtgtaaagagcttttttgtagagcaaaatattacgggtttttgcatcattcaagt

SEQ ID NO: 35707 - DNA, 1430 bp, Heterodera glycines
attccaatcgaccacgttaatccctccccggtacatttagtgtcttatttcatgaaattatatactatttaattttaaataaagaggcaaatttttacagaaaataaatagacgctgactaattagctaacatttataaagaaagtagaaatttgattaaatgcatatacaaaatattacttttttaaaatttgtataaagttcctagtcgtatgtgctttgcgttggttggttggcgtgggtgactgtggtggttgggccgtttttgcgatattatggctggaaaaaagatgcgatttcgctatggggagcgcggccgtctgggttcaagtgcttgcttgcgcttgtgctcggcattgaacggtgatggctgctgctggggtgccacctttgtcgtggcctcagtttctccagcgattggcagctgtcgaaatgaataaacatgcagctcgtctgtgtgttaaagaaatttggcgagttaattgacttgtgtaaatgtggcctaaggcacaaatgctgtggggaactcagcactggggatgctgaacctaaagttgggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctcggtcgccttcgccgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtag

SEQ ID NO: 35708 - DNA, 750 bp, Heterodera glycines
ttgatttaattgtttttttttaaagttatagtttatcaaaaataagtgtattcgaagtgttttgcggttgttcgtctttcgtcccatcggtcggaccctttgatcggcgcctttcaaaattaggccaaacgtgtcattatttttaagtttagtaaattccgaggttcaaggcattgaagtgattggccgaggtaatcgactgtttgcctcaagcatcagcaatgtgccatctcttggtgtttgtgtacctgcccccccccccccccccctccccactgcgaatggagaataatccatgccgattaatacttgtaattactttaccattaactttatgtcaaatatttccggatgttgttaattaatggactgcttgcttaatgtttgattcgttgctgatttgacattcattctgctaaacaagacgaccatattcaattatccatccattatttcttaaattattatttttattgagtgaaaaattgttaaaatgagaaaatatacaatatttgcgcaaaattcggcaaagtaacgcacggaatatttgtcaagaaaaattgtctgaagattctcgaaaggcgaccggaaaacgcacaataaatgcttattttggcaagcgaagggaccagcagagggaagtgatcagatcattagaaaaggggtcagcagaaggaggtgatcagaatgagaagtgatcagaccatcagaaaaggggacaacaaagggaagtgattagaccatcagaaa

SEQ ID NO: 35709 - DNA, 1166 bp, Heterodera glycines
  misc_feature (39)..(39): n is a, c, g, or t
  misc_feature (67)..(67): n is a, c, g, or t
  misc_feature (129)..(129): n is a, c, g, or t
ttttagtatcttttttgaaaaacaacaatttttaatacntgatacggtagcccaacatccattgccncaatgtacccttcggtttgtcaacgggagctaacaattgatgagtttgtttggtttcttttntaagcaattttccctcattgctcaccaaatgttaggcgtacagcaacggcggcacttgcatccgatgcagctgttcacgggctctctaaacctatttttattttttttctatctcttctctgaatggagttataacaatttttcacaacagttttgcatttaacagacacattctaaaatttctaattagtatggtagtccaagcctattatttttttttttgacttgtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccctcattgctcaccaaatgttaggcgtacagcaacggcggcacttgcatccgatgcagctgttcacgggctctctaaacctatttttattttttttctatctcttctctgaatggagttataacaatttttcacaacagttttgcatttaacagacacattctaaaatttctaattagtatggtagtccaagcctattattattttttttgacttgtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcaccaactgttaggcgcacagcaacggcggcacttgcatccgatgcagctgttcacgggctctctaaccctatttttattttttttctatctcttctctgaaaggagttataacaatttttcacaacagttttgcatttaacagacacattctaaaatttctaattagtatagtagtccaagcctattattattttttttacttgtctctgaatgggggtattccaattttaatattctttttgaaaaaacaaaaattt

SEQ ID NO: 35710 - DNA, 833 bp, Heterodera glycines
tagaatttaatgttttagttcagcaatattatcatatttttaagcaaaaaatttgattgaattaattttttataattttagaaagcaataattattaattttatttatcaatttgatttcaaattagttaaatttaattagttaaatttgacaccgatttctttgctctttggtcattgggcagttgcccaccacagttttgttgtttgcctgttgttgatgttgtttttccccatcattagtgctgctggttataaaattgttgctaccagctgcgcaacacgtgtaaatgcgcttgttttgcactgttctctgaaaaaatagaaatttagcgactaacagatggacaattcagtgctagcaaattcagtacatttttacgggtaaattcccgggttttcagggtttactcgacaattatatttaattgacattaataaatacataattagttaattagttcatgaaattatagtaaatttgaatttttgagtgaaattttccagatattcgagaatcttttaacagttcaagaatagcccggcattatcagtaaagtcgggattttgtaattaattaggccaatcccataatttgagtgtcgaggaataaaaatcccggtaatatttaagaattaaaatctcgattcttgagactaagcttcggtgtgcgtcaatttataaattattttatatatttaaaatcagtaaaatgttttaactgaccttgaagaagcctttgcagctgaaaagtattgttgaaaataaaatgcaaaattgttaaaatgtaagtaattagaaccacaaaaataaaaaaataaatgaaaaaatata

SEQ ID NO: 35711 - DNA, 833 bp, Heterodera glycines
tggcagagatggtaggccaaggaaaataggggggagtacgggatcgcgaaatagcatcgtagaacaatttccctcgtcgcattcgcgacactgcccctctcctcagttctttccgagctggtcggtcacttccgtcggcgggggcagcacaaacagggcattcgagaggttcaagagttcggcctggacgtctcccaagcgctcctgcattgatgccacccaccaggccagggcagggggaaggccggtgggagtcgtcaagtcagcgtgagcggtggagaggagggcagcggtattatgagtcctgtagcgcagaacccacagcgatcggtgcaaatcgggaggaagagaagaatgtaggtggagaggataagtccgggggtttctcgggacgctctcgactttgccagggcgggccggaagagaggcggggggaggggggttcggagggagagggggggtcggagagagacgacgactggggagtgaagctggaggggggacgacaaattgagtgggctgagggcgacggcggggataataggggggggttgaggcgtctgccgtttggtggagagtacgatctctggaggtgaacgcgacggtggaggggggagcgagaacggcgagacggggagtgatgagcggaacgcacattggaggacgatttttctgccacctcgtcggtcgccgacggcgcgctggagcagacgaccgaagctagcttagggattgggaaaccgggcagagggtcaaatatgcgattgtcctcgtcgccgctgtcctcacgagtttgggcggacgaactaaggctcgcttattcatatccgttt

SEQ ID NO: 35712 - DNA, 726 bp, Heterodera glycines
acgaaacgaatggttaagagaaatgttctcactttaccgctcggatgagaaaatttggaagagcgaaggtggcgagggaaagaggggaaacgagagagaaaactaaagaaagagagagagaaagaaaatgatagagagagaaaaagaaagttagagagagaacagagaaagaaagagagtaaagagagaaagaaggtgagagagagagaaaaaagagagaaagatagagagggagagagaaaacagagaaaaagagagagagtgggcaaagggtggtgggggggggggaaagagtgtgttccccggggaataatccatcgaatgggcgggggaggggtaaattgtgtcctgtcatcccaaaaatttaatttcaccatttgaatgcgaagaaaatccccgaggggacttctttaatgatgggctgtgggggagggggggggagaagatccctctcgattttaagacgaaaatcactcgacggatttggggcattgattgtgcacaagaaagtcgtcgattgaccagcaaattttgactttcaggttaccgataagaaaatcgaccacaaccctttcgccaaagggttccgcgactgccgcgcgggcaaacgcgagaagaagcggcagctgaatgccgcgcagcacagtcacgcgctgaaccacgcgcaccatggggcgaacaacgccaactcggcgacggcggaacgcgttttgcatggcgactatt

SEQ ID NO: 35713 - DNA, 1621 bp, Heterodera glycines
ttggcttttttttaggcatttcccgttgcaccactttggccccgcttacctgtttcaattccgatggctcctactactcctattgtgccattcgaattgttaatgaacagtctcaagtatatctgacacagataaccgagatcttaattggaagtctttatggtggcagatgaagcggtgcccaactagtgtaaaggcggcgcttcaatgggaattccatattttggaaggattgatatgattagagcatttattggcataatctctatcaaatggggtgagcatcgacggcgctttaactgcttatcgaacatctcgaatctctgctgatggatagattttataaataatattcttaaaattttttaaaatgattaatcttgtgatagctattttctttctatttatcggaatttttattcaaaatctctccataaagtatttataaagagtgtctttggtcggaatttacaagtgatcagcgtgtgttgtatcttcatgcttgcacaattcgaattagtgttttatgtttattttcaacaaactctcctattattgcgttttccatcatttgctgatcagctacgaagatattaaattattaattttcgatataaattcatattaattattttctatcaaccaacatcgtggtggtttctattcaattgtccttcttaaaaatcctaattaatgtcttactttgctcatttctttatctctccctcggaatcaaggagtgagtcccttcggtgcaggaaaattattaaggaagagagttcattatttatttgttttttgcataattaatttataaatatttttttcagaaacgggttctgaaacgcaccaaattttatttacatgttagtttaggcactctgatgctttttctatcaaattgggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaatggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctcctaaaattttatttt

SEQ ID NO: 35714 - DNA, 837 bp, Heterodera glycines
ttttatgtcaccttcagcaaatgaatcccgactatttcttctatgaaaaagcgtaagaatctcgaacaaactaagtcccgtctttaataaacaactaccttaaaggcaaaaaataggaaatcaattttttatgatcaaatgagtcagatcactccgattattttccaatattagtagctcaatcaataatcaactcgaattgtcgaatatttttaaaatattagcaagaaaatcaattaaaaattaatgtttttcttttttatttggctttttattttatgtcaccttcaacaaatgaatcccgactattttatattatgaaaaagcgtaagaatctcgaacaacctaagtcccgtctttaataaacaacttccttaaaggcaaaaaataggaaatcaattttttatgataaaatgagtcagatcactccgattattttctaatattagtagctcaaccactaatcaactcgaattgtcgaatatttttaaaatattagcgagaaaatcaattaaaaattaatgtttttcttttttatttggctttttattttatgtcaccttcagcaaatgaatcccgactattttatattatgaaaaagcgtaagaatctcgaacaaactaagtcccgtctttaataaacaactaccttaaaggcaaaaaataggaaatcaattttttatgatcaaatgagtcagatcactccgattattttccaatattagtagctcaatcattaatcaactcgaattgtcgaatattatttaaaatattaaaaaagaaaatcaattaagaaattattgtctttcttttttattttggtttttattttatgtca

SEQ ID NO: 35715 - DNA, 1019 bp, Heterodera glycines
ttcttttttataatttgattcaattcaattcgaataccctaattcacaaatgttattttaagtagtgagcaccagggttgtgtgccgacgacaaaaaatttttgaaaatcggaattccgagggcccaaaaattcggcaattggacggcccaaaagaatcagaattccggtctcaaaagagtaggaaatcggcatgcctacacattcctgctgctgtcctatcataacattattatataccgtacacagaaaaaaaaaattatgggtaacctatcgctactctatgcctctgcgaggtataaacctatataaatgaatttgaagtgtgacaattgaaaaaaattatgcgtaaaaatttataagcgcctcacatgatcaccacaatgcacaccaattggagcagccagcccggctggtcgtccaactcgcccagcgcgttggccatcagtttggacagtcccgactccttgacgccggccgccagggcaaagccaccgccgagcagcagcacaacaccccactgaatgatgggtgagtgaatggggtggacaatagagcccggaattttgaaaaagttgaatcgagatttgggattggcatcaggctgggtaggattaacgggaatcaaatcccaattttgtcagaatcccgatcccggcccttttttctaaagatctagggaaaatcccggcgtgatcccgaccccgttcgggctttagttattcttgagccgagactcgggaccagaggatttcgagcagactacgagtgaacaagtgaaacaaccacatagatcaaaacggtggaagaaaagccaacaacaaaaagacaacgaacgaatggacggcccgggagtttgggaaggattgacggaattgcttaaagaacccagggcctgtcctaggtgcttagcggtacttaaaattcgggccttccctaaaatacaaccctccgcccttaaattaaagccgccctgagatagagccccctccctaattagagccgctctggaataaagcc

SEQ ID NO: 35716 - DNA, 1281 bp, Heterodera glycines
gcatggcgtagattttggccatgtgtcccctgagaattcgtcggttccgcagctgaatgcgcccgttggactctaaattagcggctgccaatgccaatgtcgtatccttggcttgtttccgcgcttcctgaacccgattaagcattgatcagtgacgtgttctcatccgtccccacccttgtgctgatttggctccgaatattctctttaaatccttccgcttccttcgataattgattgtgatcaaatgtcgtatttcgctcgtcatttctctccctaaagaatttaaaaaatggctaacattttgtctttgattgtgtttatcttcttacttgaatggtccttgaatgaatgaaaatgaatcggattgaagaaaattcatttttgtatattaatagacgaataaattttgttttgaaactgttgtaaagtgccgctggatggcttaatcctaaaaagcaaagtaaaatcaaattcattgaaaaaaatttaattttaaaaataacggcaaaacacattcttaaaacattcaattaaatttttcctttccctaatttgtttcctaaacaatgctttatttgattttttgatggaatttcccattttctttttcccattgcgattcgtttttctcccactgattgggttttcttcctttgatcaaaattcaaaatcccttttaactttcgtctgatcgcaatgctaaagaatcgcggtccctaatttaacttttttattttttttatttttggctcaaaaatcacgaatctgaactcggatttactcaattccgaaccccggacccgaaatcgaacaaaaagttgaaatttttttccaaggattacatttttcgtggataaaagcttctaattcatttaacactatttattttgatccaaaataatgcctcaacattaattgcataaaaaatatgcaatttacgccaaaatttgaccggttttaactttttttggaaaatttttttttctacttttttgtcgaattcgggtccggggttcgaaattgggcaaatccgagttcatattcgtaatcagcaccctcgaaaaccccaggaaactgaatctgagcccagaataaaaaagttaaattggggaccacaaaccattgccacagaatgataatatttttcattgatttattaattttatcttgtttaatcagttttagagcaatagggaaaaattttgaaaatttcagttttcatctttttgttctaattcgcgttcggggttcggaattaatagaaatgggtgtcagatt

SEQ ID NO: 35717 - DNA, 1467 bp, Heterodera glycines
ccctaaattgaaagtttttagcaacatttttccaatttaaaaaaacccaccggtagctcaggaaaaaaagcaaaaacctaaaaaatattagccctactcatgacaccaaatttgaattattttttttggcgaaatattttaattttgaaaatttttaaaaatgcaaaaacaatgatggcctgtgaaaaataaagacaaaaattattttaaaaatacagaatcgaaattatattatcatctggcattctgtttttttcttcttcattttttgtctctcggctgcaaggtgtgccaacggacaacctaaaaaaaaacttgaaattttcaaattaaatttcaaaaaaacattcttaccggcctcctggtcagcatcatctcattccactgttcttgagcagctaaactgacggaagccaattgtagattggcagaggaaagaagcacctgaaaaacggggcggacggaaaatttgtcggttccgaatttgtggcgatttgtacaaattaaaaaaaaaaaaaattaattcttagtgttgttcgagactcccggtttagacacaaaaaatctcgaaattttggaattcgttcttcacattgacggcctcgcaatttatataatttcccattttcagttatataccccaaaatggatcgaaatttttcgaaatctcggttcttgagcctagaaatcgtaaaaatttcatatttttttgaggatgcgaggagagggggtggccaaaccctgaagttttaatgtctctgaaatgccttacttcaccaatgaagtcatttttgctcattttatcgtaatcccatacggtgatgctcagatgaactttctgagaacaaaagtaaaaatttatatattttttatttttacaaaattaaaaattatatatttaatttaaaaaaataataaatttatatttaatttttcaacacgcgccaaaagcatgtttaaatagtaattaatattgcaatttttgagaatttttaagaaaatatttcataaatgcccgtaaataaatccaaaatttcacatttttttgtagatagttttattatctgtatattttggtaaatatttacgagtttttttacatgtttaatgtttttgcaatttttttacatataattcctagccctatgcttttcggaaaaatgaaattttaaattttgatttttaaaaatttattcattaatttgatagaaaatttttttttaggcggaaataaaaaacttacgtccattttgtccggaaccattttgaattggaaactttcgttgtaactgaaaaaagtgggaaaaataaatgtaaaattttcaaaaaaaaaaaaataatatttacttactaaggattcaatgttttgtatttgatggtcgtttttttctttgcacacaattttttgccctcataaggtacagcttgacgtaggggtctaaaaaattttaaaattaaattttttaa

SEQ ID NO: 35718 - DNA, 1046 bp, Heterodera glycines
  misc_feature (55)..(55): n is a, c, g, or t
ttacaggcatgccgcacttttactccttttctttttcctttaactcaaaatatancaccgcgaccccactccgactctcatctcacacaaacccaccctctggcatgattggaatatgcctgtccttcaaaaattttgccttgaagatcttcataacgactcccgcaattgtgacactgtcctttattacatccaaatctcctgttatccccaaaaataaccgccggaacttcaaaattgattccatcaaaatttcaacatcgttttcgcaatacgtcttaagttgttcccctaaaaccaatttaaattaaaaagcccatatttttccgtctacctagttcaaattccttttgaaaattctcattatgccatgcttccaattttacggcttcttcctccttcatattgtccgggcaatagtcttccaaaggtggcaggttggatactctcttccgaaaattctcattcttattgtatttgtgtggaaaatacaatttagctgcagtttttaagtccaaggtttttggaaggtcggccaacctattctgactaagcatccaaaaatcccgaaaatacactcttcccgcctttatttgataaattttcaaatctgccatcatcagttccgtcgcgatttccttcttcgttagttcagacaagacaaagtgggaatcgaatctcccagcataatgcgcgaaagcaatcgtttcaaatcgttgaaaccccattacccaaacgacaaactcgctcattgggtcaaaaccatccgctactgaccatgtgattttcctggggccttcgcaaatctcacattcccgctttttctcccgcacaaatgttgcaagtacgtgcagcactaacaagattaagcccggtgttctcccccatctacagtcgtctccaggtcgaatgccacaaatctgtaagctttcctgcggtcgcacttgaattttttttgatgaaacattgccccccctggggggaaaattttgcaaaagttgcaaaaattttccccccccaaagggtttccaaacgggtttggaaaa

SEQ ID NO: 35719 - DNA, 860 bp, Heterodera glycines
gtaaattaaaatgacaacaatcagataattacccaggcattttgggcggaaaaacggcatcggaccatggaaacgaggcataacgacacaaaaaatggataccaatttacctatttttggatacacacacagagcccttttaaaaagtcccaaaaatggcacataaccaatttgacatttagctttccatttaaagaaaattaatttaccccaaaccaattttcacacgccattcttttgactttctaaatgggttttgttgtgtgagcacagcaaaacagtaaacatccaaaaaaaaaaaaaaaattttagcagcccaaaaaaaatgaaaatttttaatgggccgagagcctttgtccacaaaaataagaaaaacccgaacccaaaatcaaatgttagccgcactctgaaattaacatcatcattttgcgaagtgttggcacacacctcaagccacgacggtggcaatccggtgaacttttggccatcatagccaacatggattcgatggaccacgtcgctgggtgccgaaatttcgttgatggtctgctggtggcatccctttttcagtggactggtgctggtgcgttgtgccatcatcggagttggtggtgttgttggccactcctccgctgctgaaaattcggccaagaaggtgccgtagtcggacctttgagcttttgtcacgcgacggtgtgccaatggtgctggcggtgtccattaataaaagttcttagagaagatattgtcaattgggacattttgcaaactcttaaaaaggagcgaaaagttcgtttagtaaaaaaagagagtaattttcttcccgatttttgagttattttcataacaaaaaatttttc

SEQ ID NO: 35720 - DNA, 1277 bp, Heterodera glycines
ctatagggaagctatttccgaaagattcggtctacccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaagattcggtctccccataaatctgggcgcatcggttcggggggactgccccgaaaacaaaaataaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcct

SEQ ID NO: 35721 - DNA, 1719 bp, Heterodera glycines
  misc_feature (1608)..(1608): n is a, c, g, or t
ttttaaaaattttttattccttttttaacaagcccaaaaaggttagggtttaacttttttaaggaaaaattcaacccctccatttgtggaggtagtgatccgaaggcgcacccagattttgcaggggccctaaaaaggtcaaggaaaagggtcctctccgttgatttagcagtagtacctataaatttaattttctatgatttttaaagtttcttgaaatttttttgagtgcaaaagtggtggtgtctgcataaaattttcacctgggtttaaaaaatctaggaaaattagtaagcatttgtagtgtgccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctcctattattgggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttccggaatagcttccctatagcctgtactttaattctgcgttggatttttggatttttgctccccataaatgtttgagtaccccaaacggacacttgaaaaaatcgatttttttgttttcggagcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgttcgagtaccccaaatggacacttgaaaaaatcgatttttttgtttcataaatatttttttcagaaagggttctgaaacgcaccaaattttatttacatgttagtttaggcactctgatgctttttctatcaaaaagggagatgaataaaatttttaaaatttttaattcctttttaaacaggccaaaaagtttaggcttaactttttagtgaaaattcaatcactcatttttcgagtagtgatcagaagcgcaccagattttgcaggggcctaaaaaggtcaaggnaaggcgtctctgcgttgatttagcagtagtacctatgaatttaattttctatgaatttttaagttttttgaattttttttagtgaaaaagtgtggtgtctgcaaaaatttt

SEQ ID NO: 35722 - DNA, 666 bp, Heterodera glycines
tcggtgggctggcgagtttactttgaacaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaataagttggctcattgcttctgtgggcacaactttcttataggaattttc

SEQ ID NO: 35723 - DNA, 1370 bp, Heterodera glycines
ttaaatttagcaggcagaaagtatttatactaaggtatttctctgcaaaaattcatatttttctgaaaagtacgaaacgaacaggaaaatcagcatttttaaattccgtgaatcttatttacctaaaaatcgcatccctactcattagtgaaagagaggggagagaaagagagacatagaaagaaatacatagagagagagcgagagagagtgaggtagagagatgagaaaacagacagacaaataaatacacgcaaagttacatagcacagcagagatagagaggaacacgcacacgtgtaaaacaaacgccgtggggcgagggacgacgaggcggtgcggtgagtgagagagtgcgtgcggtcacaggggcgacaaaacaaaggaagcggaaggagaaaaagggggagaagaaagaagggaaggaagggaacacaaaggaaaaaaagagacagcagagggagagagaaaagtgacggccaaacaaacagccaaaaggggaagagaaaaacaaactcacgcaaaacaaacacagaaaacacgtccaagagcaccgttctctgttctctgccctttccttgttgccagccgaccgacgacggcggcggcggactgtcccttgccccacccccgcccctggcgaggctgttctcagcgtctcagcgacggcacgtgtgcgttgttcgttcgtatgggcgaatttaatgaacacacgctgcctctttgccgtctccgccacctacgtggtatttctctctctgccttttctgtcgtcactctctctcttttttctatgtcgcgcctccccttactattttcgttttttttcgctgtccttcttgacaatacacagaaaagttgtgaataatgaatgattggatgacggatgatctctgacttaaatggccaaagaattccgctaattaacttttcttatctttttttctctgctttctcgcttttccactgcgttttatgtttctctgccccttttctccaattttcttttctgttctttctttccctttacgtcattgccatttttgctcttctcttccttcctctccttcttgcaacatcgaaatcgaaaatgttgccagcggcaactgcgtttttttgttaataaagtctttttttcagtggcttttcgttggaaggcaaaacacaaagcaatggcggggaggggagaaataaatgaatttacaaatgatgtttcattgagataaaaatatcgtatactttgtaacactatacggtgcttcaccgatagtgtactgtagtaaagtatctaaaaactgttcttttaaaatatcaatttttcctctagggggacttctcactctccggcacagggggaagcatttttttat

SEQ ID NO: 35724 - DNA, 737 bp, Heterodera glycines
  misc_feature (727)..(727): n is a, c, g, or t
agtgcgatcagagaccaaacaaaacacaactgatcagacgacaaaaaatgatcagagaatgtcagatcagatagtaagtatttaatcatttaaaattagaaaaaaggataaaaatgttttattgttgccttatcgctggtgaatccggcaaagagtttaatgccgaactgcgccagcggagccaacgatgccgaaacgccagtgtgagcgacggggaagtgcagcacggagttcaaatagctgaaaaacagccgaattttggaattttttacgaattgcgcacctcggcgaatagagaaacatcatattgacacacaccttaagagaaggaacgaatggagaaagggaaaagcatttaaaagacaaaacaaaaaagtgataaatgaattaaaacgcacgaaattgccaatggcggcgatccaaacagcccaaacggagcctaatgatggattaattaattaatgagtgagtgatttcgaagagtgtccccccgcattagccaatttcaaaattatgccattcccttttgtctttggcatttcgtcccccccccctcccccactcgcctgtcattaggatttgcttcagcgggatcttcttcaaattctctttgctcagctccgatttgcccaccgcaattttacgtagctcaacttcgcccacaaaaggatgcttatctgatagtgatcagagggaatttgcacaattataaatataattttttaanctttttttaa

SEQ ID NO: 35725 - DNA, 1106 bp, Heterodera glycines
  misc_feature (1054)..(1054): n is a, c, g, or t
  misc_feature (1072)..(1072): n is a, c, g, or t
  misc_feature (1100)..(1100): n is a, c, g, or t
atagcggaattaaattatatattatttgaattcattttttcggcggtacattatgtaaaccatgtgtggttagcacagaaaatttataaaaatctctacccctcggtttcatgaggaaatacataaaatttcagaaatttcataacggaattaaataatattatttttattcattttttccggcggtacattaagtaaaccatttggggttagcataggaaatttcaaaaaatctctggccctcgctttcctgaggaaatccatcaaaatttccggaatttcatagcggaattaaattatatattatttgaattcattttttcggcggtacattatgtaaaccatgtgtggttagcacagaaaatttataaaaatctctacccctcggtttcatgaggaaatacataaaatttcagaaatttcataacggaattaaataatattatttttattcattttttccggcggtacattaagtaaaccatttggggttagcataggaaatttcaaaaaatctctggccctcgctttcctgaggaaatccatcaaaatttccggaatttcatagcggaattaaattatatattatttgaattcattttttcggcggtacattatgtaaaccatgtgtggttagcacagaaaatttataaaaatctctacccctcggtttcatgaggaaatacataaaatttcagaaatttcataacggaattaaataatattatttttattcattttttccggcggtacattaagtaaaccatttggggttagcataggaaatttcaaaaaatctctggccctcgctttcctgaggaaatccatcaaaatttccggaatttcatagcggaattaaattatatattatttgaattcattttttcggcggtacattatgtaaaccatgtgtggttagcacagaaaatttataaaaatctctacccctcggtttcatgaggaaatacataaaatttcagaaatttcataacggaattaaataatattatttttattcattttttccggcggtacattaagtaaaccatttggnggtagcataggaaatttncaaaatctctgggcctcgctttcctganggaatc

SEQ ID NO: 35726 - DNA, 946 bp, Heterodera glycines
agtatataccaaagaaattaggaatttaaataaagttcatgcttccaactccattgacgacaatctgtcaaccggtggaaaattcggaaatcattttattcttttcaactttaatgatttgcaaaagccgttctgccgatgacatctttcgttctcccacattcattgacaaaaaaatcctttggtccatcgattgtccgaaattgggtcacagccaaaggagggcaccattcaactcgttccaagcggagcaaaatgccaacaaaaactgttgctgtggttgaggggggggggggggtggacattctccgaatttcctccctcttccctctcttttcgggtctttccatccttcgctcatttgtcttcccattctctgatcattttttaaaatcattttcccctttttggacctctccctaattgggtaattatttttctccgtttttctgtacttttgtccgcccacccattcactttttcaattagaatcgattaattttgtcagtccgtcgaaagctgtcggatggtgggaaagtgatcagtcacttgtcaaatcggagattgactcgcaaatagcgaattattttgatcaattgtttgtttttggactgacaaaaactgcaccaaattcgcaaaaggcgccgaagaaaagagagaaatgcgtaaaattaaactatttttgtgatagttcactttcgacacttttcttccgccgcctttcatcgtttgccaattaatctaacccccaattaatttgattaattaattaattgctgcctttggcatttatttccttttccatttttcattctgctttctgccatggatgatgatgtttttctgccaacttctgcccaatttgacgccatttacacggacaccgtcggcattttcgtcgatgctaagtgggggagcagcacccaagcgggggtccaactttgcc

SEQ ID NO: 35727 - DNA, 974 bp, Heterodera glycines
aaagtccaagtaccttattggacatctacgtgtcaatgagcacagtgacctttgtccagtaatgtatcggaaaaatgtgaatatcagacaggatcccttacaattctaaaaattcctcttttcgtctaaccatccctcccttttgtgcactatttcgtttcaaaattgaatcattttttttgtctttttgaaataaattgtgaaaaatatacgaaaattattttcgcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaataattttttttggctttttgaaataaattgtgaaaaatatacgaaaattattttcggttttaattatgctgtacaatgcttttaagccccgccgtgaggcggctccccttttgtgcactattttagtttttaaaattggttccggactttttggctttttgaaataaattgtgaaaaatatacgaaaattatttagcttttaattacgctgtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttggcttttgaaataaatttgtgaaaatatacgaaaattat

SEQ ID NO: 35728 - DNA, 838 bp, Heterodera glycines
ctgagttatgatgtgatttaataattaatttgcactatttttagcattcagtgtaggaatcgctccgaaaaagaaacaattaccagcaaaagtcggctcttccgaagaaggaattcctgtttttgggagtgccaattgaaatggcatttatttttgcatcaaaagacaaattgcccacctcagctgacaatacgcggatcaatatgaacaattttggaatattcgcgaattattttgtcgaaaatattaaaaaactgataaattctgacaatttcgacgaaaaaatgaatcagggcgaaatgaaaattcaacaagaccttttagacaatccgagttgttttcgcagttagattaatcgattaaaaaataattaaaatattttataaattaaaattcagataaatttgaaatggataaaattttgaaagagaaaagacaattagaaataacaaaagaaaaagcacaagaaagaagaaaaatagtgggcgaacaagaagcaatgctaagggcactgtcaagtgaaatttataaataaatcgaaaaaaaataataataattttcagggaatttaatgaatgaaagaattttggaaattttatcgcccgtccaaaaattggacaaaaattacaataaaaaagtgtttaatgaaaatagcaacgaaaggctgcgcgttgtactcgcatatttggaattgtgggccaaaagtaagaatggaaaaatataaaaataaataaatgattattattaaattgtttcagaattatgaataaataaataattcagacaattttatctacgggacagaaattggttatttgaactcgtctggtgttattga

SEQ ID NO: 35729 - DNA, 147 bp, Heterodera glycines
tattttattagtgggagaacaatagaaatggatcatgaaagggatttttgccatccggcgatttcctccaacaattagggattggaaacgagaatttggtacatttgcgggcaggaaagatcatgacggaagtaaaatgggtcgggg

SEQ ID NO: 35730 - DNA, 892 bp, Heterodera glycines
tagacgttttttcaaattttcagagccaaactcgcccacaatgaaaatccataaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagcgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctactattccgaaaatgtggttggaattcatttgagtgttgagcagaaaagagatagacgttttttcaaaatt

SEQ ID NO: 35731 - DNA, 1682 bp, Heterodera glycines
tttcatattttgtttgttttgacgggcgctccgcgcccgttttttaaatttgtaagctcagacgggcgcttcgcgcccgttttaaaaatttagttggccttttcggccgcttcgcggcctcagaaagaggtacaaaagtgataaaagaggtacaactgtgattagaagaggtacaaaagtgattagaagaggtacaactgtgattagaagaggtacaacagtcattagaagagatacaaaattgttagaagaggtacaaaagtgattagaagaggtacaacagtaattagaagaggtacaaaagtgattagaagaggtacaaaagtgattagaataggtacaaaagtgattagaagaggtacaaaagtgattagaggaggtacaaaagtgattagaagaggtacaacagtaattagaagaggtacaaaagtgattagaagaggtacaaaatgattagaagaggtacaacagtgattaaaagaggtacaacagtgattaaaatttgaacaaaagtgattagaagaggtacaaaagtgataaaagaggtacaaaagtgattagaagaggtacaaaagtgattagaagaggtacaaaagtctaacttgttatgagatgtacaaaaataatttcataattttaaatataattttatagaattaggtttatttaaaaattttaaaaaaacaaaataataaaaaatgtaaaagtttattttttaattaataaacggaataatttattttactttattttgaaatgaattattatgcatccaaatttttaaatctaattttgcttaaaaataaatctattcatcaaaagaaaaattaaatttaattaaaataattttgttaataataataaaacaaaaaataatttctttaatttaaaaaaaataaatttaaataatttaaaacaaatcttcaaattaattaaaaacagtgaaaataacccaaaaatgcatagaaaaataatgtacaccgtccgggtccgaacctgcctcttccctcctcataagggtgcctcagaatccccaatcacacaaggattctgaggtcttaaccatgtcaaaagtaaaatctgattacgtattcgtgatcagcgggccaaataacccctaaagacatattttttgaagatttttggtgaaaaaatttttcaactaaaaaatcctatgctcacccctttggtccataatcccaaaatcggttttatttttgtaacaattcgtaagaaagtgataaaaatgtaaaataaaatttatattataaagaaaaaaattgcggatttttgtagtattttaattttcaaaaatttcttttcgaagggggttatgaatttttttctgaaaaatcgaaaattttcagaaattctggaataactttttttctttttaagatagaaatcccaaataaatcccataaaattctcctgatttttctctatttttataatataattgcatgaaaattgatccacccttcgatttgttatgaattttcgaaaattaacccaaaatcccgaaggccaaaaaattgacgaattttcaaaaatttttaaaaaattccaaaaaatctgaaacgaaaaacaaaggtcatattagtgctcagcacctcaaaataccccagaaaaatatcttaggagccttttcaacccaaaaaaaaaattccgaaaatttctag

SEQ ID NO: 35732 - DNA, 944 bp, Heterodera glycines
  misc_feature (840)..(840): n is a, c, g, or t
  misc_feature (845)..(845): n is a, c, g, or t
  misc_feature (850)..(850): n is a, c, g, or t
  misc_feature (907)..(907): n is a, c, g, or t
tgatcagtatcggctaaaatgccctattatgcgggattcattcgtctctgatgtgatacaaacatgtacaatgttttgcccaataatttgtatttgtcaaccggacactcaacttacaatgtaattgccttagtcatgtcaacccttggtggcattcccattttcacaccacgatcattagccagtttgaccagagattcgatgaattgcctgaatttttttgttcattttacgcgtttctagtgcaaaaagaataattgatatcacattggtaaaaaccgattttaattattttaattcatttttggcagcaaaataagcttttaaggctgatatcttaatttgaactttttcatatggctcctcgtagttagcttacttgcatttatccttgcaaacacattctcctacaatggacaccgcccaagtttgtggaaattcacaaggcgacgcgtattgacggttcaacggcaacccgccttcaaccattttgaaatccaattctggaaaataaataaactaaattttgacttcaggcaaccgaaaatttttatgttgataacaatttaattacatcttgttgaaccattttttgcctagcaagacaacagacattttgggtgaaatttgttaatgataccgtattccttttttcaagaaaaagtgacaaaactttataaaagagtgaaaaggaattctaaatttttcgagtttcgcatttttgggttcaaaccctgtttaaaaacaaatagtcagcagtacttcaatacaaaaaaacgaaattcaaaaatttgagttttcgactttttgttcgaattcggacccaggatgtcggactanattanatganattgacaattatgtgatattttgcacatttgtatcatattttaatttgctgcattgntaaaaaatgggcaagtttgcgtcaaaattaaaaatcc

SEQ ID NO: 35733 - DNA, 366 bp, Heterodera glycines
attttgtcgataggaagcccatgagtatagaaaaaaaaaattcaaaatatttcaatttctgtagagggattgaatcaggggaaagacgaagggaaagtcaaggagaatagacaccaggccatctgcacttttgtcagtggaacttttaaagaatatattaattattattttttaaattttttccttcaactacaattttcatcactaatttttcactcacaaatcagacccccattcttaccagtgcttgtttttcccggttccagtttgccctaccgggaccgggaaacagtttttgaaaatccgggaccgggaaccgggacctcggaggaccgggaattcccgccccagtcccgtcctacccta

SEQ ID NO: 35734 - DNA, 1362 bp, Heterodera glycines
  misc_feature (287)..(287): n is a, c, g, or t
  misc_feature (1344)..(1344): n is a, c, g, or t
ttttggggattataaagttcaattggtaggattttcttttaaaaaaggataaaatatgtatcaatttaaaaaaaaattaaaaggaatcatatttccttatagggaaactcccgagtatcaaaaaaaaaaaataattggaaataaatctaatttctgtagagggattgaaccaggggagggaagaagggaaagtcaaaggagactagctattaggccatttgcgcacttgggcagtgttactttaaaaggatatattaattattattttttatttttccctttgactncaattttcttcactaatttttcactcagaccccattcttaccagtgcttgtttttctcggttcccggttgccctaccgggaccgggaccgggacctgagcttttaaaaacccgggaccgggaaccgggacctcggatgaccgggaattcccggcccggtcccggtcccgtggcactctacttaaaatgtcaaacacatgagataaatgaaagcaaaagccaaaaatcaaagtcggaatattatgaaattccatttgattcgaaaggcactgaaaactcgagaaaataaaaaaaaataattttcaactattgtccaaacgagtcttagacgataagattgacttgaaatgtaaataaaaatggacgaaggaattaaataaaacaatattttttttattttaattaaagaattaaataaaacaatattttttttgattttaattaaagaattaaataaaacaatatatttttttgattttaattaaatttaaatttaaaaaatctatttcatatagacaaacaaagtcggtatataaaaaaattaatttaaaaagcaaaaaattactacccaaagagttcaaacattaataattcataaaatttaactgaataaattattgctttattaattggaatttcgatttaccaaccaatacatatataaaaaacaatatgattgattggtacaactttttgcgagacatcaagaaaataattataataaaaatattagtaaaacaatttaattaacagattaaataaaaccgacggaaattcaattaaattcactaaaagcaaaataagaaaattcattatcagccaaaatttaataagatgaaagagtttaaaatgaaaccagcacgttttttaacaaatcagtaaaattgcttaattaaaagaccaattaaatataaaagaaaaagctaacctttgaaaaaggaagatggaagatttacgagtgccaaaaaagtaaatttactaataatggcaaaaaaaaagcctagcaataataaacccaataattataattaatagaaaaacaattataatatcaatanaaccggactaaaaatgaa

SEQ ID NO: 35735 - DNA, 693 bp, Heterodera glycines
agcaaaaatccaacgcagaattaaagtacaggctatagggaagctattccggaaggattcggtctccccataaatctgggcgcatcggttcggggtgactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaatgtacaggctatagggaagctactcccgaaggattcggtctccccataaatatgggcgcatcggttcggggggactgccccgaaaacaaaaaatcgattttttcagtgtccgtttgggtactcaacaaatatggggagcaaaaatccaacgcagaataaagtacaggctataggg

SEQ ID NO: 35736 - DNA, 1158 bp, Heterodera glycines
attaaaattctcagtttgctaattattttatgttttgctttgcgcttcgatgtctaaatggtgatgtgatgaagttgtaggattatgagaaagtgcccgagtttggattcaaaacttttaataattatttgcttttaaccgcttatatttagttttatctgctttttgtattattattttgtgcttcatttatcataaataaattttgtatttttttttataattttctttggtattccataattaattgttcgcaacattaataaattgctccttcgttgagtcaattatgtcaataaaacaaaaattcttcccagctcaatttaatccaataatatcatatttttgaaattaattttcaaccgaataacagttgttttaattttaaattaaatatgctaaaatatttatttgccgctttttaaataatttttaattacgcaacatatcctttgtcattaacattgacctttgtcattagtgaatgtcataaaattttgttttacgtatttttcaagacccgctcgtttaattattcattttcactcaaacaaagttattatttatcattacaacatttttatcatacagtcacaatttgtatgattgtaatcgaatggtaaatttgaagggatgcaattttaggtgcaaaaaaatcacaaaagcagctaactaaggaaaaaacacaaaatattcatagggtaggtacgcaaaagccccaaatagacaaaaatagtgctttaaatgtgccatgcttttgaaattttataatttcgggtccagaagccgcctaaaatatatcccaaaagttttggaccaggattattccttcgaaaatagatttgaaaaatttgctgataaagcgttttctgtttcattaaggacaattcaagtgtattttctgaaaatgaaattgtttgctttttcggaatttgcctaaaaagcatcccgtcaaaatgttaattaaaaaatcgtccggtatctcttagaaactgcaaattcttggtaaacgaaactttcgcctgaaatgtttaaatattaaaaaaatttactaaaggattatttaataattaatacatttataccaattttgtgcccgaattaatatgggtttagcacctgaaaaaaagtaattaaataagtcataaaataatatct

SEQ ID NO: 35737 - DNA, 1077 bp, Heterodera glycines
  misc_feature (147)..(147): n is a, c, g, or t
aataatttaatatttgtgatgattttcttattatctaaattgtgatatttcctattcaatgtgattttcgtgcttagtattagtcactcttttttgttgttgatcgttctgtctaaattgctccacctccgcttttcctctctattnaaacacgcacgtttttcgcttcaacacattcttttcatctgacatcttattatatttaccaaataaaacttcttttatttattcggtatttatcccccccttattcaccccgccctctctccctcgcgccttcccaaaatttttttttttaatttctttcaacaattttttttttagatttttactagaaaaacttctaacaataagaaattttaaaaacgaaaatatttttttttctggggtagggcacccaactggcccagtcattcgtgagaaaaagttagttccaacttcctaaaaaatgtagctttgacccatgtttttgaattttatcaccaagaaaatttttcaatttttgaccaactcagtgccatgcgtttcgtatgccttttgctgttcctgctcttcgttgtccaactgttcaagttcgactgtgagctgtgcgcttcgttcgccttcctccgcctcggatttggccaaatttgcctcctcaattcccaactaaataaaaaaggggaaaaatgccaaaaaaaaatgtgccaaaattttcaaaacacctcttccaattcacgttccaattcctccaatgactgctgctcattggcggagtttattgcttctgaattaacaaaaaatatcaaataaacaatttaaaaattaatttccgtttcaaaacttcaaaaaaatttttttaacccctaaatgatttttgtccaaaaaaaaattcaaaattaccaatgttttgctgttgttgctccatgtaaaccattctgataatcggcatttgactagcaattccgtcgcgccgttgttggccgtcaatttcggcaccttcctcttccatgacaatcaatcgttccccatcatcatcatcatcgtcctcattctccgccaaattcaatccccgaaaaaattaggtattttttaaat

SEQ ID NO: 35738 - DNA, 1114 bp, Heterodera glycines
cattggtttggggatattgatccgtaaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggaaaggctcggcctcttcgcggcctcgtggtgggccttcgccc

SEQ ID NO: 35739 - DNA, 883 bp, Heterodera glycines
cttcattagcaaaatccgccccagggcattcgttaccttttgtggcggtgttcgaaaccaccaaagtaaaaaaaaggagagaaaatgaatttaggggaaaattgtcgccgccatttggaaaaacaaagtaataaaacaaaggccgaattttggatgaactggtgctgttcagaaatcgtcaaacaaaattggaaaaataaaaacagaatttgtaaacaaataaaagggtcgaattatgaaaaagagttcttaaagaaattagcggcccaatggtgccgatagacacgccataaacatttgggaaatttgataaaaatttgtgaagaaatttaataaaatctttataatattattcttagaatgggttaatactagagtgccacgggaccgggaatttttgccaaaaccgggaccgggacttgccgggacctgagaagccgggaccgggacctcgatttttttcgggaccgggaccgggaccgcaagaaaaaccgggaaccgggaccaaccgggaaattttaaaaattcaaaaaaattttaaattaaaaaaaaattcaaattttaatttatatcaagtgaaaataatacaaaattatttggttttttatttaataaattaaattaatgaaaattttcaaacaaattttcttcaattatttcaaacaactaatcatttttggactaaatcatcgaatattaatagaaattcagatttgattttcacatcactttttttcggagcgctttttcaaaaaacttttgggaaagaaggggtccggcggtgccgataggcgccgccggggaaaattttaaaaatttgggtgcaatttgttaacagatttacagcaaaaaaaggttggtttttgcgattataagctcaatg

SEQ ID NO: 35740 - DNA, 1003 bp, Heterodera glycines
  misc_feature (12)..(12): n is a, c, g, or t
tttacgattttntggtcaatgtaattccgagccctatttattagttacaacaacggcgccgtaatgaactgatgctgcactttaaaatggcttcttacggtgcgcccgtggcattgggcactttggctgccggcggaatttgtgcgtacttacaattagaattcgctttccaatcactcggatttttattcttttcagtgtcttctttgccaaaaatccttcgtcttcccaattcgattggcttcactgtttgcgggtttggcctttccattggtgcatttattgtcggtgctcttcttttggacggaccgatgtacgcgtacaccgaatgggttcagcaacggacagacaaaggaacagaaaaacaaaaagtggaatgaacaaatgcaaagtccaaccaaccgactatgatttttttgttttgttttctttaaacggatttataaaatatgaaagaaactaaacaaattgctgattcatattttattttaaattgtaatatttcaacaaataatcgttttttatccgtaagtcgtaaataacaaattgtcgtcacaggtatctacaacgatgccaactgaagtggtaaacaacaaatgtgataaacaatttctggagcttttaggggtcgcgtgtcatgagtatacatccattcgggctaattcagagtcccaaactcggggcaaaaagtcgaaatattgtgactgggatttttattttagataaatccgttgtctaaacgtcgaaccatcaaacaaatgattcttaggattggctaatcctaaaaaatctttcagaagtctttgtcatgggctgcaacgaggccctgtctcctggtgacttttccgaacatgcgaattttgctcgactgtgccgttggcatggactcgatggcctcctttctgccatgtcccgtggtccgaaggtgtgttcgaattccttcctttttttcgatttgtcggcttttacctaagcaaccgaatatcgggcaaaagaaagtgca

SEQ ID NO: 35741 - DNA, 473 bp, Heterodera glycines
agataaagaactaataaaaacaaattctttaaatcaatttaaaataaaacttaaagttcactagggtaatatgtaagaccgggaaagctagaatgtaacaaatttctaagtgatttggtatttcgacctcatttgactttgacctcaatttatttattatttattttcacatattttgtctttttttaattcctgtgatcatccatatattttgtcacttactctacgacacatttaccggaatagtcgtcagagtaagtggttttcgcccttctgatgacttttttattttttatgaataaacaaaattcatttttcatcaaaattcacattcatgcaactaaagcaatacaaatgcacgaaaagacgcataaagatatattttgcgttctcttttatgtttccagcttattaattaatatggctgcgttggaagcgtttcggaatttctcgctgaaaaaattgcacgaaaa

SEQ ID NO: 35742 - DNA, 671 bp, Heterodera glycines
actcaacccaccagcatttcaatcactgggactcaacccaccagcatttcaatcactgggactcaattctcctgcatttcaatcactgggactcaattctcctgtatttcaatcactgggactcaacccaccaacattccaatcaacgggactcaacccaccagcatttcaatcactgggactcaacccaccagaatttcaatcactgggactcaacccaccagcatttcaatcactgggactcaatccaccaacatttcaatcactggtactcaacccaacagcattccaatcactgggactaaacccaccagcatttcaatcactggcactcaacccaccagcatttcaatcactgggactcaattctgcatttcaatcactggcactcaacccaccagcatttcaatcactgggactcaacccaccagcatttcaatcactgggactcaacccaccagcatttcaatcactgggactcaacccaccaacatttcaatcactggtactcaacccaacagcattccaatcactgggactcaattctcctgcatttcaatcactgcgactcactccaccaacatttcaatcactgggactcaacccaccagcatttcaatcactgggactcaccccaccagtatttctatcactgtgactcacaccaccag

SEQ ID NO: 35743 - DNA, 748 bp, Heterodera glycines
acattcggtatgtttgtattaatgaaaatcaatttgaaatagtaatgtaaaaaataaagttaataaaaaaaagtcaccggtgcattttttatgaaaaaattttttgattaaaaatttttcattttttgcatgaattttttgcaagaagaaaacttataaaaaggtgaccaagcatgaaaaagcttaatattacctcaaaaaaaattttctggttgtaattgcagataaggcaaatactttcaaaaagaagaaaaaactttaaaatgcttgtcgcgaaaaaataaaaatattttataaatttttcaagtttttccattttattattttttaaaatttcatcttgtctttatactgatatttttatttgttatataaatttgcatgagaacttttcgaaaaatttaaaacttccaaatttgtattgcgaaaaacaatgttcaaattcgtactcagcacccctaatttacccaaaaaaatattttcacccccgttttggtccaaaaaaaatttcggaaaatttctagggcggcttagtttgaaaatttttgaatttcccggtcatatagtattcgatagagcttcaaaagctctacaatttgccagaaactattttctctaaaacgaaccccaaaggagttatgtgcccggagctgaaatgtcccgctcaggccaaaaaatttccctatttccgggtaaaaatcaaaatttctaaaaattatatcaatcgctcgaaaacggttgcttgaaa

SEQ ID NO: 35744 - DNA, 1016 bp, Heterodera glycines
attcattgctaatataacccgctttgagcgactttttaatccaaagctgtgccaaagcaaaagcggctggcaaatctaagtagaggtccgcaagaacagcataaagacgggtgaaccccttgacgatgcaagaatcgagcaatgttcctttgtctgacaaagccttaaattgaagaaatttaggcttcatagcggagtcagtttaattccttggcgacacctactagtactgattcatggacaaaaaaattaacaaaatttccatgcttattgacaatttctacataagagggagatgtgatcatcatatttagcgaaaaaatttttgattctgaatcaatgctctttcgtctgcccatatcgccaccaaaaaacacactttgagaagtgtcgcgaggttgcccatcacattgtcgtgcatttgttcaagggcaagaataccggcctttaaatgagtcgcctaatttcttaccattcatttagggttggcacctgatacacaaactcgtggttgaaatgtggcactttcaattcggacaaacgcaattccgccgtttcctggtcgttgctttgtacatattccttcaaaatcaatttgaattgtgccgaaaggacatcaagcgattgatgaccgccagatggaacgcatttcccattgagaagatggcgattgttggcgaaggcaatggcatcagcaaaaatattcctgtccgaatgaaaacggggttgaaatgaatgtactttaacccttaagtttcctagtgccccctcccctcaaaaaaaaacaaggcgtaaatcccagagaaaaattctaaatttctgactctttatgggtttaatgtaagaaaaacttgttcaaaaacaaacttacttaacggactccttgccatccgaatttttataggccaaaaacgaaataacgttcgatgtgacgatgttttgctcaaccagcttagcaattaacacagccaacgtgtcacacagtttcggcacgtccttactcagctcatcaaccg

SEQ ID NO: 35745 - DNA, 1165 bp, Heterodera glycines
gataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcatctgatcagtctagaacgttgggtgataaatgaaaaaaataattaaaaaaaaataatacttgtgtggtattaattcataaatattttttttcagaaaatgctctgaaacgcaccaaattttatttacatgttagtttaggcactctgatgctttttctatcaaaaagggagatgaataaattttaaaaaatttttaattcctttttaaacaggccaaaaagtttaggcttaacttttttttcagaaactgatcagaagcgcaccaaacttagcagggatactgaaaggaagagaaataacctattttaaatattatctagtcagttcatttaaataatttttatccaaaaaaaatttttttttggatttcggggcagtaccctgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttcgatatacctctactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttt

SEQ ID NO: 35746 - DNA, 854 bp, Heterodera glycines
tttgggggtactcaaacaattatgggggagcaaaaatcccccaccgaattaaagtacaggctatagggaagctattccggtttgattcggtctccccataaatctgggcgcatcggttcggggggactgcccctaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacatttatggggagcaaaaatccaacgcaaaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcaaattaaagtacaggctatagggaagctaatcccgaaggattcggtctccccataaatatgggcgcatcggttcggggggactgccccgaaaacaaaaaaatcaattttttcaagggtccgttgggggaactcaaacaattatggggagcaaa

SEQ ID NO: 35747 - DNA, 737 bp, Heterodera glycines
tgcttggcccggcactgttcaaaattcgcttcccactcttctcacaaatggaattttttgagaaaatcggtaaaagcggatttactaaagaatttattttatttattcttacaaagaaagaaaaataatttaagattttgaatattaacggaaaaacaatttgaatatgttttttccttccaatttttctaaaataaatcaaatcaagatttttaaatttgattgattttgagtgaagctgtgaataattttttttttaaattttcttttgttggtttttttaggtttgccaatattttcaaaatttgtgtttaacctttttcagttccatctggtgtattaacacaacaagaagtgacaagcgtggaacagtactgtagcaaacctaaaatttgtggtggtacgtccggtgggataccgtacccattgaaatttccgtgccatgagcgtaatttgacatttggcaaaattgtgatggaaattgaaaatgtgtccaaatttgcgcatgaaaaaatgtggcacattcgatgcagcaaatttgtgcatataagcggaattccatggagaattgtcgcaaaaataaacacaaacgaagcgttggcattttacctccaatgcgatgtttcaatgaaaggttcgcattaaagacgcgtggccggcttttaccgggcggcccggtccaagtcctgttttttagacaaacctcgggaccaggacgccctcttaattggcttttt

SEQ ID NO: 35748 - DNA, 1234 bp, Heterodera glycines
  misc_feature (1182)..(1182): n is a, c, g, or t
aaattaattatagaaaatttaaataaaaatgcattaataatctttttaattaattcaatgtttatttctcgactattatttctgagaatgcgatttaatgagcaaagattaaattgaatacaacattcttcaaataatttattgtttcttcttataaaatacaacagatataggttttataacaattattgctggaatttaaaatatttctttgtaaaaaaacttaaactattattaataatttattttttcatacattaaaatatgaacctagtttcgttggtttattttcttaacactaaaagtttttataatttagcagtttcaaataatttgaaagtacataattgtaacaaaaaagtcttaattttattttcttctgtttttgaatatacctgtatagtttaaggactttgggggagcgtgccattgcataaacaaaaaagtttagctatgataaagtagttatttgaattagtaatattatttttaagataataatatttttaacaaatttattaaacttataaatgtgtgacttggtcgccttaaattttgtaaatttataatttatctttttcaaaattcaaaaaaaaacttaccgatttattgaggtattactgatgaattatttaaaaatacttgggaaatatgtttacacctaattaaattttatgtaaatttataaattaaactatatttaataaattttattcaatccagctccttgattttgtaaagagcttcgcgaaattcgatggttgacaaatttcattaaaaaatgtttattattatattacttatttttgtattaaagtaaattattttttcattttaaataaaaattttgaaacaaattaaattgcttttagttaatttctttgttcaaatatgtaatttcatataatttttcatgcaaaattgtcaatttcgtttaaaaaacgattattaattttttttattattaaaaatttctcttaatactttcattttctgtaaaaaaaattaaatgtttttttattttaattttaagacagttatctaaattataaatttttttcaaatattattctaatttaactaatttctttaaaaattagaagatttataacaaaacaaaagatatttgaacattaatgttaacataataatcattttctggtattttaatttataaattanatcacattagtattaagaccccttattgtgtagacgaaattttatcttatgt

SEQ ID NO: 35749 - DNA, 1077 bp, Heterodera glycines
  misc_feature (73)..(73): n is a, c, g, or t
cagtgattgtaccaaaacaatttactgaatgattacctcttactgatcagccgtcattttgtcacacaatttntgtgcactctttctgaaacaattagtgtattttataaatttattcaacaaaaaaaaaaattcgacgaccatttcatttttgtatcaatcggactttgagtttttcgagtatcataaatgtcagaatcggagcgagttgttttcaatctcagaatcggggttccaagcctaaagaaagtgatgtcgtcatccttttggcttttggcacagtttaaaatggcacattttttgttgacactctgtctcactttcgcattgttggcacattgtgtctccgcaaaacggcggcccggcttgcgcacttgggactttgaggcgaagccgggcatggacaattcggtcggcaaagcgaaggatgaacaggatgaagatgaggaaaaggaaccaaaagcggatgatggtgtaggggataaagcagtaacagatccgattccgccattcaaaatcagcagcacaacgaggcaagcaaaaatatgaaatattttatttttaaaattatttttttaattttaaatttatttctagtataaaattaaatgagtcaactattggaatccatttaataaacttcgcgattttccttctttattaatcataaatgcgttggtctaatcaaagaaaatcggattaactaaataaaaatttgtaaaaaaaaaaattttttttcaattgccttatttagtgatattgacaagaatgaaatatcaaacgaatttgatgaatcaaatcgaaacattgagcagataaaagaacaaaaagaagatggtaaaaatatttaaataatataaaaggattaataaataatttattattgttttttaaatttaaaaatttcattcagaagcgatcagaaaaattcttgagcaatcattaaatatgactgaagacacttttgaagaggagcaaatgccactgaacacttcacttcttttaacgggttaataaaaattattttttaattaccaaattaaaatgataatttttcagatatgacagacaaaaaaa

SEQ ID NO: 35750 - DNA, 857 bp, Heterodera glycines
ctaatggaaaaaaatccccgaaggagagaattttattccctaattccttcgggggaccgtgccgggtgccgcggggtcttcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttcaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaaatcgattttttcaagtgtccgtttggggtactcaaacaattatggggagcaaaaatcccacgcaaaattaaagtacaggctatagggaagctactccggaaggattctgtctccccataaatcctgggcgcatccggttcggggggaactggccccgaaaaaaaaaaaaa

SEQ ID NO: 35751 - DNA, 1623 bp, Heterodera glycines
aaattcaaaaataaataaagaaattctttaatttaaaaaaaataaaattaaataatttaaaagaaatcttcaaaaattaattaaaaacattgtaaaataagccaaaaattcaaagaaaaataatggtaccccgtccggattcgaacctgctgccccccccccccccctcagaacatgtcccagaatccccaatcacacagggattctgagggcttaacgatgtcaaacgtaaaatctgatcacgtattcgtgatcagcggcccaaataacccctaaagacatgtttttggaagatttttgtcgaaaaaattttttcactcaaaaaccatgtgcaccccctttggtcccgaatctcaaaatcacttttatttttataaaaattcttaaaaaagtgataaaaatgccaaataaaatttatataatagagcaaaaaactgcggatttttgtagtattttatttttcctaatatcttttcagaaccgagttatgaatttttttctgaaaattcgaatttttccagaaattctggaataacttttttccttttttagatagaaattccaaataaagtccataaaattctcctgatttttctctatttttaaggctttattcctgtaaaattgatcaacccttcgatttgttatgaattttcaaatattaggccaaaatcccgagggccaaaaaattgccaaaaaataaagaatttttaaaatattccaaaaaatctgaaacgaaaaataaacatcatattcgtgctcagcacctcaaaataccccagaaaaatatttttgacctcctttttcaacccaaaaaaattttttgaaaatttctagggggcctagctcgaaaaattttgaaaatttccaaacataaaatacaccattcgatagcatttaaaatgctctacaaaaatgttctaagacaatttttcgctaaaaccaatctctgacgagttatgagcccaggactcaaatgtcccgctgaggccaaaaattttttctatttctggaaaaaaatcgaaaattttccaaaaaaattaccaatcgatagagctcgaaaaactatgttttggaagtggtcttcgtttttctgggaaaattcgttaaaaaatcctaaaattcaaaaacccgaaaaccgttttttaggcctagctcgaaaaattttcaaaattttcgaaattttaaaatttggaaaaatcgagctttcgaagctctacaatagtgccgctggccaccctgcgctcaggtcaaaacctaatgagttattcaacggggactgaagtggacaaagttggtactgaaaagttctagaagcacccagcccagggggttagagatagaggtctggaattttttttaacttttagtcaacatttcaacttagggccctcacagcgggaattttttgatccgagtttctgaaaaaaagttatgtgccgtcaaacgcacgaaaaaatgagaaatccgtccctgggactcagtcgtccgcgcagaatttttttctatagttttcccggattctcctcaaaaagttgtaagacccttccaccactttcagggcgctcccggccttcggccgggagattttcttttttgaaacgaaactccttgtcaatataa

SEQ ID NO: 35752 - DNA, 193 bp, Heterodera glycines
tgttactagatcggggatcgatcccccgttaggtcgctcgagcaggacctgcagaagctagcttgatgcttatcagattgtcgtttcccgccttcagttcaaactatcaagagtatgagtatgatggtcaatatggagaaaaagaaagagtagttaccaattttttttcaattcaaaaatgtagatgtccgca

SEQ ID NO: 35753 - DNA, 845 bp, Heterodera glycines
cgtcgcttgcttcgtgctaattgcgctgggaatatgccattcggccgaactggtggggttggaatgcgaattgcgaagggaccaaaaagtgggcgaattgggccaaagagttgtgccgaggaactgaacggcaaacaacacgaaaccaattaagggcaatcagcagcagaacctcttgggaacttgtgcccggttcatcggcatgagaaagaaagcgacgagcggagtcgggggaagaatggaaaaagtgggaggaggggcgggaggaaacactgttggcatacagcttctgcagcagggaatttaaaatggcaaaggttggattgacagagggattccagaccaaatcaacaaggtttcaaataaaagagttaatttggtaatccatcccaattaggctaatttgattaattgaccccaccccccccccctttttgatcacctcttccaccactgttttcttttggtgccgatttgctttgctctgctgctgttttccttcttcgatgtgatttggcaccaatgggcatttctgctgctgtgttccatcacttaagtgtttcatccatccctcctcatttggaggcaaatgagcacattggcactgtgaaggaattgccttttgaggagaatttgaacgcgactttgagcggacgagacggcgcagaaagttggacatggaatcagcagggaaggatgaagataaagcacaaaagccccggcaggaagaagcagcggcgtgaatgatggatggagagagagagagaggcaaagggagagaaaggggaagggggagaagcatcgcctgggaggggggacaattgcaacgatggaagggggggggg

SEQ ID NO: 35754 - DNA, 693 bp, Heterodera glycines
cttgatttttgttggagttctaggacgccaccgatcgcttcaacgtctcctttttcctcgacgacgacggtgcgccgacgtgcccactcattggccgacttcccgcctctttacaatttttcccagcgcccgttgactcacattcggcacagcagtttgggtgaaaacagtggagcggacccaaattttcaccggaggtaattgcacatcgatggcgtggggggtactccggctcgtttttaggaaagtttgttggagaaaggaaattaggcgatgagtgccgccggggaaaatttaaaaaaaaaatgacaaaaaaaacttatttataaatttgagaagtttatgaaaaatttgtttttaatttttgagttgcaaatacatgttttacgaatttcatacaaaaaatgagttaaatctcttccttgctttaggcgttttatcaactcgttgctgaaggaaatccggaggagcaaggatttggagcgcaagttggacggacgtcgggaggagttagacgaagcatgtcgtcgagacgcacatgaggtttatttgagtggggcggggtgatgattcaaaaaaggcgggggtcgagaaaaggggaaaagaggacggtgtggaggaggcgacaaaagaggaaggtaaaatgcaaaaaaaaaaatgggcgggcgatcggcgaattcaagcaaagaaagg

SEQ ID NO: 35755 - DNA, 1592 bp, Heterodera glycines
aaacaatttttttaaaaatttttttgccaaacaaattgaacaatcttgatatcatttgaaagctctggatgagaagaaacgttttcaaagcaaaagctaagctattagaatataccaaaaaaaagatatggacgtttaagtttgtttttaataaattgctcttaaaacccttacatttttttcgtaattttttttctttatcttttatgcacaatttaattcaaattgtattaatttaaaaaaaagttttattgagagaaatgattttgtttttctctatgaacagagacaaagaaatagtacgcctaaatgagaggtgtatttttctctgcactctctactattttaggttcatctctcgctgaatttacctaatagatgaatttttttaaagtatttgaaactaaaaatttctgcaaaatcaaataatttatttctttttttcagctttaataaaaaaacttttcttctttttcacaaaaaaaaatgttgcgccgaagagcctcgtcgtttgcggcccaccatcgccacgcatcgccgccatcgcgcagtggcggcggcggacggtcatcgcggcactcgccgccctcgtcgtcaattcggcacgccgactttcgttctgctgccggcccgtcaaggtttttgttggtcactttattaattttctggtgggcttaaactaaggcagactcaacccccccccccccccccccccacaaaattttttttggatgacaggcggactttttttggcaaaaatctttcttttgaaattcatacagatattttctgaattttcttgcattgattacaaaaaattgttttggtacaaaaccgagcttttttttgaatgcattgcatttgatttagacaaaggctgccttacggaaatccatattccaaggcttttaaatacggaaaattcctgcccataaagttgatttttttactaaattttatttgaccattttttggtcaaaattttggctttaaaacttcgttaaaaatcattttttcggggtattcaatggagctcccacacgaacatgacattcatatggtcattttcggttcttaaattaagccggattaaaaaacgcataattttttaatatagagtttttgggtgccttgcatttcatccactttttctgtcaatttttttaaatttaagttccttccgcgtgcgctttccgccgtccgctccgcgcggcattggctaccgtccgtatcggccccgcgcgccgccgccgttgaatccccgcttcgcgcgcagcagcgcccattaccgtgcctcgcccccacgtccgtcattccgcgccgctgtgccacgtcgcggcgccggtggacgcttcgcagccgtgcgcggtggacgcccgcctcctccgcgcattccctaccattgccgcatggacatttcgccgcgtcgctcgccgtgccgaagtcgcagtcgttcaccggtggatgctggcggtgccgcacgaccgcgccattcctccgcttcatccgcaatccggcaccgaagtccgtcgttgccgctggcggaaaggggtagaggaggcggtcgacgcccgatttaccggcgtggcggc

SEQ ID NO: 35756 - DNA, 1237 bp, Heterodera glycines
tatcctcgaattaataaagttttgaattaaaaaatcttccttgttccatgtgaatgaatctttaaatttatttttggttaaataattcaaataaatttcaagattatttttttcaaatatttcgaaatgcatttacaagaaaatcaaaatattaaacataaggttaaaaattaaaatttacggggcaattttttttacatcagccctttaaaataatgaagtgtctatggtgagtcatagaaatgccatttgttcataataatacactgccattttatggacaaaatgatgaataacaatgtcatttgtgcagtcaatgaaatttcattcgttaaatcaaatgccaaaattcggcttattcttttcaattattttattatcatccgaaaatgatttttggtctctctgtaaaagcattttataaagtcactcaatgatagctttttgtcaatttaaatattttatttatttttatactttaagtcgcgttttgtttcttttttagcaatgggtttggcatcaacattttcattgctattcttcataaaaattgctctgttctcatggaatgttttgggccaaaaaagtcatcagctaataaacaatttatttattttaagttttaatgggtaaaatcatattttaatgcctttagatgatcgacaacttcggaagccagtaaattgtgaattgctgaaggatggcaattatgtgtgggactgcagcaggtacatgtcaaaaaaacaaacattttgaaaataatattaattgattagtgaaatagccattccgaaaagcatgacaaaacatttagtgggttaattaatggacaagagtcaagacaaaaccgtaacccttacaaacactaatgaactaaaaatagctatcatttttatttgaatttatatttcagttattactcaatttgtgccaatgggcgcgaattgccgatggagtgctattccgggctgaagctgaacccgaacaccaaccaatgcgatacgccaagtttggtggacccgtgccacagaaaacatcggccttcgaatgtgctgtatcgcgcggcggacccgttcaattgccaagtgagcagcggaccaaagggggagatttaggattttaaatctacaaaaataaaaagggattagcttaataattttggattcaaaaaattaaattaataatttaataaaattaattattattttgaacaaaaaggaaaacccggacggcgatt

SEQ ID NO: 35757 - DNA, 59 bp, Heterodera glycines
ttcaacatgcacttttggatcaagtgagcacaaatgccttttttccatttttgatgact

SEQ ID NO: 35758 - DNA, 615 bp, Heterodera glycines
ttttgaaaaataaataaaataataggagactcagaattttgtaaattttttataaaaactgatgacaagctaatgtgataaaacaggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaacaaataaataatgaactctcttccttaataattttcctgcaccgaaggtactcactcggcctcttcgcggcctcgtggtgggccttcgccccccccccgataagcattccatccatcaatactttctcaggttctaacagctaaaccatcaagctgccattccaagttctgaaaattggcaaaatgcttttttaaaaaatgcggtgtctattatttacctatatttgtttcttcagaaaaataatcgaacgctcaactcaagggcttcgcacattttcacaaacagt

SEQ ID NO: 35759 - DNA, 1107 bp, Heterodera glycines
tcgaatgcttttcattgttttcgaccgaaaagtcattatattttaggccattttgaaatattttattcatttaattattttaaacttttgctattgatcacagcagatctgatcagttcgcctctttttcaccttccccccccccctcattaatcttcacattacaacagatgttcttccctttttcccttttcttcccttttattctccgttcaaatattatttattattaatgggggggggcaaaaggtcaaattgtccatttggaagggaatgccgcgggggaatcccatgcccaaggggctaattgtcggattcattccaacgccttccccgggattttgggcggcattcactcaaaaagtgtccggcgacgaattgcgtaacggtgctctaataaggaaatgacgggcccattaataatgattgctggtgatacattgcggaatggacggaaagggagcgactaacgaaaggcgaatgaatcctttgggggaaaagcgagtcgagagtctcgaggattgactaagcgaaaaataaaatgtgaaaggattaattaattaattaatgcaacgtgacttttttggccactctttcccgaagaaaatattccgtaaaatttggtattttacgctccgacaattcttcggcgttaatgaataaatttacgcggtcaaccctttgatatgagcggaacagccaaaaacaaccctttcaccattcatcatcattaccaacaaccgcggacagaaatggcaaattgcgcaatgccatagaaaatggggggggggggaatgaccggggaatgaaagaatcactgatcagtgatcggtaaaaaacccaaaacgaacgaatcacaaaatgaaatgcgataaaatgggatttaattgcatagaaaaaagttggcaggcacaaaaaggtaaaattggcactttgaaacaaaagaaataaataaaaaagatatttgacaatatgtcctttcttcttttctttcgttcttttgtccgttttgcctttctcagcttcggtccgccgccgtcgcttcgttttccaaaacattagttaaatttgtgatgtgattgtacgcattttgcagtgcttcgaatt

SEQ ID NO: 35760 - DNA, 1182 bp, Heterodera glycines
  misc_feature (167)..(167): n is a, c, g, or t
  misc_feature (175)..(175): n is a, c, g, or t
  misc_feature (177)..(177): n is a, c, g, or t
  misc_feature (184)..(184): n is a, c, g, or t
  misc_feature (186)..(186): n is a, c, g, or t
  misc_feature (193)..(193): n is a, c, g, or t
  misc_feature (205)..(206): n is a, c, g, or t
  misc_feature (209)..(209): n is a, c, g, or t
  misc_feature (219)..(219): n is a, c, g, or t
  misc_feature (226)..(226): n is a, c, g, or t
  misc_feature (228)..(230): n is a, c, g, or t
  misc_feature (232)..(232): n is a, c, g, or t
  misc_feature (247)..(247): n is a, c, g, or t
  misc_feature (253)..(254): n is a, c, g, or t
  misc_feature (256)..(259): n is a, c, g, or t
  misc_feature (267)..(267): n is a, c, g, or t
  misc_feature (271)..(271): n is a, c, g, or t
  misc_feature (275)..(275): n is a, c, g, or t
  misc_feature (281)..(282): n is a, c, g, or t
  misc_feature (287)..(287): n is a, c, g, or t
  misc_feature (290)..(290): n is a, c, g, or t
  misc_feature (292)..(292): n is a, c, g, or t
  misc_feature (297)..(297): n is a, c, g, or t
  misc_feature (308)..(308): n is a, c, g, or t
  misc_feature (314)..(316): n is a, c, g, or t
  misc_feature (319)..(319): n is a, c, g, or t
  misc_feature (323)..(324): n is a, c, g, or t
  misc_feature (326)..(330): n is a, c, g, or t
  misc_feature (332)..(333): n is a, c, g, or t
  misc_feature (1145)..(1145): n is a, c, g, or t
acacaatggtacggtagcggcgggggaagagcactggaaaatggaatggctttctggtcatcgattgatcgttaattcccgacagattctcgaccggctgagtgcgcgagggacaagcgaattgctgcgcagtgcgacgcatcaacacctcgacaaattcgcgacgnacgttctncnaacattntncacaacntacaaaccaatnnacnccgaatactnctccaantnnntnttcaatccctttttntttttnncnnnnactaactnaccntccnatcatnnccatntantnatcantttctcatttncctttnnnctnatcnntnnnnntnncctcatcttcatttgtttttttgattcaattaactgtcaaaggatcgtcttcgcactgcccaattggactcccagcggaaggacgaacttgtggaggcgctgtacgaggagatggagcaggacatgcttctgctcggtgcgacggccatcgaggacaaattgcaggacggcgtaccgcaaacaatcgcaactttggcagcggcgaacatcaaaatttgggtgctcaccggcgacaaaacggtgagcgaattttgaagaattaattttactttaatttttataaatatttttttaaggaaacagcgataaatattggatattcatgtcgccttttgacggaagaaatgcgcgaagtgttcataatcgacgggaaggaggagaaggaagtggaagtgcagctgaaggacacgcgacgacgcatttgtagcgccaaacagacacagcaggcaaaagaaatgaaaagagaaaaataattaggggtaattaagggtaattaaggggattaatggggggtaatggacggtagggagtcaattaagcgggagggaggggtcggaatggagcagactttcaccatcctgactcttcaggtccatttcaaatatttaaaaaaacaacaaaatgctttttaatcatttgttttttaatgggtaattaattattatttattaaatggatattatttttttcatttttttcccttttcttttttctcacatttccccaatttttgtcttcttctaagatccaccgaatgtgcaatcaaaatgagcgcaacaattttttttattctcaaaatttgacactttgtncaattactaaaagcaaaataaacgaaaaaagaattga

SEQ ID NO: 35761 - DNA, 869 bp, Heterodera glycines
ttggcagaattgaatgtcaaattcgtgttcagcaacccagaaaatccccaaaaaaatgggctttatgaactttaaaaaaattcgaaaaaggggagggcgtaccatcaaatcaataccaagaaatattcgaaaatttgccgcattcagatggctacgagtatgtgatctcccgtgacatggcccgacgtcgtgatggttggaccaaaaagacaaaatttggggaataaataagggaaaactcgaggaaatttggggatgtgtgtccaataaatttgccacatttttttatccattcccccatttttatagaccaaaaaggcaaagaaggtggcaaggacggggagagcaacgggcagacggtgcaggaacattttgcattcggcgacttggaatactggggcaacgaaacggagacggtaaggaggggaaagaagggagagggatacagtcagtttcgtaatccaaaattagaaattttttttctgcgaaaattttaaacgcaaaagagaaatttttgtcaccgattttaaatttttgaaaaaaacataattcataaaatctcgaattaatttgctgaaatgtttttcttttaattttggaaaaaattacatacttatttttttcagaataaaattttaatatcacaccaattttgaaacagaatttcccaatgccggacggggtggacaaattcaccaaaattgcctcaatgaatgctgaattggtggcactggcggacaacggccaactttacgcgtggacatgggcaaagggcagtgtgccgtcaaatgtgccgcatgttgtcaacagtcaatttgcaatcacaggttgagaaaattaaaaaaaaaactaaataattatttttattt

SEQ ID NO: 35762 - DNA, 1009 bp, Heterodera glycines
tcttaatttcactaataatttctcaattttcttctataacagattaactcttctatggtgagtttttcaatttctatgtactttattaagtaaacaataataatcaaacatttttctatgattgcaaagcatttaaaaaatcataggcttgtttattttcattatgttttggaataggtcaattaaataaacaatttttttttgtaattttattaattgtataaatcttatgcaattttctataagcaatcgatagtgtaacaaatagagaagataagttctgatcaaacacacacctttcattatttccggttaaatatgtgttcatattttaacaaaaagcagtcttgaatgtcgtcgaaatttgtgataattccatggcttatagccgaccaattgcgctggaattttgccatgaggcttattttttgtgctggtttcgaatttacaggcgcccatgcaattggagcgcattaaattttttgtcgatttttcttcaatacccactttaaacgctaagcatttcctcgcacaccgctctatttgctctgttttaaacaacaaaattttcccaagcattcatacctactttcttaattgcactgggatcacatctaaacgactatgctaaaaacggggaactaaactgtattaatatttttaacaaattgcagtccttttcgcctaccctgttaagagaaatcttaatttcactaataatttcccaattttcttctataacagattaaatcttctatggtgagtttttcaatttctatgtactttattaagtaaacaataataatcaaacatttttctatgattgcaaagcatttaaaaaatcataggcttgtttattttcattatgttttggaaaaggtcaattaaataatcaatttttttttgtaattttagtaattgtataaatcttatgcaattttatataagcaattgatagagtcactaattgagatgataagtgctgatcaacacacacctttcattattt

SEQ ID NO: 35763 - DNA, 808 bp, Heterodera glycines
aaagagagagagacagtgagaaaagagaaaatgagaaaaggtgggagaagagagagggagagaagaaaaaatgctaacattcaccgaaatatggatacagaaaaaggacgcatttaattaaacagtatcaattaaaataaaattcccccccccccccccccgctgacctccttgagcttggcctttcgggtgaccaccgcgcgcagtgacgcgcgctccacgtaactgcgctgcagcatgtcctcaatgcgcaactgctccacccgcagcaggttcaacagcatgccgtaggtgagccggaagcgactctccagcgcaattggctttccctggaccaatatttgttggtttagtttaggccaaaaattggggccaaattttatttatttttttaaattcagtggaggactaggagggattcccggcccatgtttgaaaatttttttgaacgttgcctggcactaataagtaagccaagtgccgaggaatgttaaatgggagcagttcgtttcccgcccaaaacttagaaatttttcaacaaaaaaatcttacaaatttttttataagaaaattctaagaaaaaagatttttcgacaaattttcagcaattttttggaaaagtttttgaaaaatctttatttttaaattttttaataaatttttctggtatgaaaaatattagtaattcatgataaaaattaaaatccacgaatttggcccaaatgaccgcctaggagtcgttgatacaaaaaatgtcaaaaattattttttattttttttgaccgcgagactctcccaatgccaaact

SEQ ID NO: 35764 - DNA, 1380 bp, Heterodera glycines
tttatttaccgaaattgagaggtttttcttcataaaatgcatttgatcactgatgaattaggtcatttttaattaattcatttcttctgcagctcatcattgtgttttttgttcttttgtccatcactaattgccagcaaaagacggccaatttgtgatgctttgtcccgtttcttctgccggtggcggagacaatggccttaattaagcgcaaatctcaaatttggatatgtataaaaacaaatcccctttttattgctcacccaatgcaattagtggtaccgaaaagccaaaagaacacattgttgcaattgttgtcccaatttccgtctttccaataaaccgtcgcggtctccccaataattttgcatcgtttcattatccaaccgatgccccattcattttcatttgctttggccaatgtcagcttttcctttgtccattcgttcaccaattcaaacggcaccatttgcattgacggcgcaggaacagaaaaatgaatttcgtaactgacggaagaaatggcattggcacggagaaaatgctaaacaatttgaaaacaaaaatcaatcatttgtcgaattatggccacaccagggatggcactgaattccgatttccgaaatttttgataaaattcggaatttttcagaaattttcgatttataacttttttggggtcgggtttcagaaaataactcagaatgccatccacagaccgagtacacccctaaaacgtcgccgtctcgtataaaaactaattttctgaatttccagaaaaagaaaaaaacgacttttttacatttccttgaattttcttaataatttttttcgaatttatctattttttttgatttaggttaggcaactaaattttaaataatttttttaattaaaataaaaatttgcggctacgttttgtccccccccccccggaccgcacctccttgaaattgtggatccaatctacgatccgcttggccgttgcaattatcgcaacacatatcgcttgggatggacatcttttctcggagagtgcaaccattttgacagaacttggccagcagaaattgatgcatttggcccatcaaaatcatcaccaatcgcctcgggcaaccgaccaaatgaatggattgaattgagttggttaagatcgatgagaattgtctgcgaaatttgacaaagcaaattgtgcaaatgatcaccatcgctatagcgcaagtggcgaatgtttgccgaaaaaattggacatatttcacgagcaaaaatgacccatattggatggccattcgtagggagtgatgatggaatccacacatatacattggtgcctcttttgtcgaagatttgatgatttgaacgattaacagcgatgacgga

SEQ ID NO: 35765 - DNA, 1075 bp, Heterodera glycines
cccttaattaagtgtttttgttattgatgagaaaggtgtggggttttcagtggcaaaagccccaaaatatttaattaaataatgacaacattggcaaaaaaagcgaaaaatggcaaaaaaatggtataaaattttaaaataagaattttttttttctgtaaaatgaaattaaaattgctttaacaatttattcaccgattttaattttcaaaagaatgaacttttttttaattttgcaaaaaaaaaacctaaaaattttttttcaaggacataaaattcaaggaaacgcacaacttaacgaagaaatttttaaatcatcgaaataagtattaaaaaatattttttaataatttattatttaggggaaatggctcttgtataaattggttttttaaaatttttttgaatttgtccctgttaagagtgaaatgggcattttgacttaaaagctattattttgtttagttttagtgtccttatcttccagctttggcctccgtgaagtacacccggtggttgaccgtgtccagcgccaggtggtccagctcggccaggtcgatgttcaccaacaccaatgggttgccgccgtccatgtcggcacgtgccacctttgtggccacaccgcccttgccttggtcaagccaaaacagcaggccccgatcagaatccaccgcaatggcaatgggttgcgcaaccgcggtcggtgtttgatcattgtgcaggatcaccgcccggaactgttgttgatcagagggagaggatgatttttattgaaaatcaataaaatattattgcaatataaccttttttgaatcagaaaatttttttataaaattcatattccgaaggacaagctgaaaaatcaggacatatttgaaaataagaatcctttttgattggcttaaatcagattttgttttcgcaaattattttatataaatttccctattttattataaattaatgaagaaaacaaaaaaaaaaagaaaatattttcactattattaatttttatttagaccatttttttttccaaatatttacaaattttaatatgaaaaatttataaattttt

SEQ ID NO: 35766 - DNA, 1051 bp, Heterodera glycines
  misc_feature (1035)..(1035): n is a, c, g, or t
ttattaaaaaaggcaaaattcgccttaaattaataagccgtaagtttgaaaatgtttattaaaaaatttcaggatgaaatataattaaaataaatcaaaaagaaaaaaaataaatttatttttctaaataaataaaaaacattgtcagaggcagtgtctgccgaaaaaatagacaaaattttttcaaaaaagccaaaaaaaaaattgaaaatttaaataaatttaaaagtgaaaaaaattaaagtaatttaaataggcatattttaaaaaagcctatttttttgccttttcacaagagaatttattaaaaaaaggcaaaattcgccttaaattaataaggtgaaagtttgaaaatgtttattaaaaaatttcaggatgaaatacaattaaaataatcaaaaagaaaaaaaataaatttatatttctaaataaataaaaaacattgttagaggcagtgcctgccgaaaaaaaagacaaaattttttcggaaaaagccaaaaaaaattgaaaatttaaataaatttaaaagtgaaaaaaatttaagtaatttaaataggcatattttaaaaaagcctatttttttgccttttcacaagagaatttattaaaaaaggcaaaattcgccttaaattaataaggtgaaagtttgaaaatatttattaaaaaatttcaggatgaaatacaattaaaataaatcaaaaagaaaaaaaataaatttatttttctaaataaataaaaaacattgtcagaggcagtgcctgccgaaacaatagacaaaattttttgaaaaaagccaaaaaaaattgaaaatttaaataaatttataagtgaaaaaagtaaaaaagcttccaacaccttcgattcccaagacgtctccgttccaagtacaaagaaggcccaacgttgcttaacttgccagatcggacgggatggcgtactttcaacgtggtatggtcgtaagcgaaaggacagcaattaaagtcatttaaataggcatttttaaaagagcctattttttgccttttctcaagaganatttataaaaaaggca

SEQ ID NO: 35767 - DNA, 1643 bp, Heterodera glycines
  misc_feature (1601)..(1601): n is a, c, g, or t
ggttttagagggttctgattacgaatcttaactcttatttgcctaatttcgaacttcggacccgaattcgaacaaaaagtgaaaacatttttccaaaatatacgttaaaacaggtcaaattttgcgcaaattgcgcctttttaaccaattaacaattgaagcattgatttacatcaaaataaatagttgttaaatgaattagaagctttacttcaaaaaaatccattcttgaaaaaaattctaactttttgttcgagttagggtccggggttcggaattgggcaaatccgagttcacaactcgtgaaaactcctaaaaactagttttagcccaaaatttaaaaaattaaaattagggacacccattcttcaggattgccgtaaattatttgggttttatttttcacgaactctgaaaatgctgattttgttatttaaatttagttatcaaaatgactaaattttgcagaaaaatccgatagcaaaaaacctaccagcctacaaaatttcataaaatttcgtacactcaaaaaacttttttaaataaattcctttgacaaacacacaaattccctgctcagttatgatagcccggaggtgcctgccaccctggcattccgttcggttgcatcggatgttgcggctgcgcctgttgccattgcgcattcgacgcttgcatgggaagttgcgcctgttgcggttccgcactcggtgcgtgttggtgttggagtcgtccctggtttagttgcatcattcttatcgggtcccagtgggccataaatatgctgttgcatcgggtacattggttgcaacggtatcgtactcattggcattggttgcgccacggacaggggctgtacagcgtactgtagtaattattgtgttaccatgacgaacagtaagagccgttgcggaggctcccagaaaatgcgtcggtggaaaatgcatcagtggaaattttaatgtcatcgaaacattttccttgggttttcgagtcatttatcacgaatccggtatccatttcggcaaattccaaaccccggacccgaattcgaatataagtcgtaagtccaaatttttgaatttagcatttttggttcaaaaaactgcgtaaatgatcactcattcaagtatgggtgactttcagtttgtttccgtgtttaaccagcttttgaaccaaagtgtttaagcaggttttgaaccaaaaatgctaaattagaaaatttggacttttgactttttgttcgaaatcgggtccaggattcgggattttatatacaatacttaatgctacagaatttatttttaaaatatttgtttcattgacgcgtttctactgacgcattttccactgacgcattttccggtcacgcttgcggagaggcggggaggcagggatgggccaaattgaaaaataaaaagcgtaatgcgaaaagcaaaatttgcgaaactgaaaaatgcgaaatgaaaaaaaaagcgaaatgcgaaaagccaaaatatgcgaaaatgcgaaaagcgaaattttttctacaactttttaatagttaaaatcataaagcaaaaatcattttttaaaattttattccaactttaaatcaatanaaacgcttttttgaggcgcgctttttccaaaaaaactttttg

SEQ ID NO: 35768 - DNA, 1006 bp, Heterodera glycines
aaatttaaaaattccctcaaaaataaaaggtctattgcttaccgccctccctatcatgctcgagagcatttgtatgtgtataaaatttatcaaaaaaagagatagccatttttctgggataacctctaaatataaaaatcctctgtgaaatacatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattcccctaaaaataaaaggtctattgcgcaccgccctccctatcatggctcgagagcatttgtatgtgtataaaatttatcaaaaaaagagaaagcccttttttctggga

SEQ ID NO: 35769 - DNA, 1138 bp, Heterodera glycines
ttctatctcgtaaccccgatgctaatccgttccggagagcctcttcaaaattttttccattaccctaagagctgcggaaattgtgaattaattctcagaaaaatggttatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggttatctctttttaggacaattttctatctcgtaaccccgatgctaatccgttccggagagcctcttcaaaattttttccattaccctaagagctgcggaaattgtgaattaattctcagaaaaatggttatctctttttaggacaattttctatctcgtaaccccgatgctaatccgttccggagagcctcttcaaaattttttccattaccctaagagctgcggaaattgtgaattaattctcagaaaaatggttatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcagcaagtgtgaattaattctcagaaaagtggctatctctttttagcccaatctccgatctcgtcacccccatgctaatacgccctggagaacattttcgaaatctgtttcaatcccctaagatcggccgagatggcgaatttgatgcccaaaaaggctggatattgtcggaggtcggttgacatagaaaaaagttataaccaaaaacccgttggggcccaagggtgcgggggcccaactgacgggttccgtcccccctccacgctcataaaaatgttatgctccaacaaataagggtactt

SEQ ID NO: 35770 - DNA, 853 bp, Heterodera glycines
  misc_feature (557)..(557): n is a, c, g, or t
  misc_feature (578)..(578): n is a, c, g, or t
  misc_feature (587)..(587): n is a, c, g, or t
  misc_feature (616)..(616): n is a, c, g, or t
  misc_feature (622)..(622): n is a, c, g, or t
  misc_feature (627)..(627): n is a, c, g, or t
  misc_feature (632)..(632): n is a, c, g, or t
  misc_feature (652)..(652): n is a, c, g, or t
  misc_feature (656)..(656): n is a, c, g, or t
  misc_feature (661)..(661): n is a, c, g, or t
  misc_feature (669)..(669): n is a, c, g, or t
  misc_feature (672)..(672): n is a, c, g, or t
  misc_feature (684)..(684): n is a, c, g, or t
  misc_feature (689)..(691): n is a, c, g, or t
  misc_feature (693)..(693): n is a, c, g, or t
  misc_feature (696)..(696): n is a, c, g, or t
  misc_feature (735)..(736): n is a, c, g, or t
  misc_feature (744)..(744): n is a, c, g, or t
  misc_feature (749)..(750): n is a, c, g, or t
  misc_feature (767)..(767): n is a, c, g, or t
  misc_feature (770)..(770): n is a, c, g, or t
  misc_feature (773)..(773): n is a, c, g, or t
  misc_feature (778)..(778): n is a, c, g, or t
  misc_feature (795)..(795): n is a, c, g, or t
  misc_feature (798)..(800): n is a, c, g, or t
  misc_feature (806)..(806): n is a, c, g, or t
  misc_feature (810)..(810): n is a, c, g, or t
aatagcttccttatagcctgtactttaattcagcgtaggatttttgctcctcataattgctagagtaccccaaacgcacactagaaaaaatcaattgtcttgttttcgggacagtccctccgatccgagtgcgcccagatttatggggagtccgaatccttcgggaatagcttccctatatcctgtactataattatgcgttggatttttgctccccataattgtttgagtaccccaatcggcactcttgaaaaaatcgatttttttgttttcggggcagtccccccgagccgatgcgcccagatttatggggagaccgaatccttccggaatagcttccctataacctgtactttaattctacgttgtatttttcctccccataattatttgaataccccaaaccaacactttaaaaaatctattttttttttttctaaacattccccccaaaccaatacacccatatttatccaaattcctaaaaaaaaaaaaatatcttccctatatcctctactttaattctccatttcattttttctccccataattttttnaataccccaaacaaacacttnaaaaaatcnatttttttatttcataaatattttttcanaaaatnctctnaaacncaccaaattttatttacatnttantttanccactctnatnctttttctatcnaaaannnanatnaataaaatttttaaaaatttttaattcctttttaaacannccaaaaantttanncttaacttttttttcanaanctnatcanaacctcaaagaactttncannnatactnaaangaaaagaattacccaggaagatcacattagcttgtcatcagtt

SEQ ID NO: 35771 - DNA, 1025 bp, Heterodera glycines
  misc_feature (922)..(922): n is a, c, g, or t
caaataactttccgtttgcaatttgttgtgagttatctaagttaatttacttaatagcttcaaatgagataagcatggtttgatttagagcttatccattaataatgccacacattttaaatttatttttgtacattagtggaaaaaagtctttttacaaacagacaaaaattcatttgttcgaaattttcaccataaagatgacaatgaaaaattgattgtaagactttttttagcattatttgtcacggactcgctcagttgggccccagcacgtctttggattataacttttttctttgtcaacaaaatccaaattgtcctagcatacggctcgttacatgctttattagccttacaaaagcgaaaagactttctagcctgtaaaaaatttattaagaaaaacttaaaaatttcgactttttaccattttcattaggcccaactgaaagtaaaccgatgtgtcatgcaaaatttagtaaaatttatcgagaaaaaatttgagatattgaaaagggtaagttgttttgaaatttttaagtgctttttcctatcgaaaaatcatttaatcattttggaataaaacaacttttttccaccattgataaaaaataacgcgtgtttaatttttgtttccattatttccccccttttttcccttttctttttgtccaaatggcgccccgtggggccaatgaaaattaatttaattacataattatttatgtttcaatttgactatctcatattttttttattgtcaacaaatgctacatatttaatgaataaattctcacccattacactgcttctgcacattcattctcatgtcattcccatcattatttttttgtatatttttgcccttaggggaaaaagtgacaataaatccaaaattaataattcaattgattgtccttcnaatattgaaagtgatagataattgagtttattaatttctttttcttttttttgtgcagtttttctttttttaattttatattttagtcaaatcaaaattcacg

SEQ ID NO: 35772 - DNA, 1203 bp, Heterodera glycines
ccgggatgtgggaacgctttttcccgcacccaatgaaagcggacaaagtgactgcaattcacaaaacattcaccggattgtatggcttagatgacccggataatgagaacaccaagcgtgtgattcaggtaattatcataagcatcatgatggttttcaaattcagaacaaatgtctgaaattaaatttttatttgaaaaattttgggacgttttttaatatttttacccaaaaattgggtaatattgttgatgcttgggcctgacttttaacagaatttccatttgatttcttaatagattttgaatcaaaataagaaatgtataggcggaattttagaaaattaaaggaatttttggattggacagaatgttcatttaattgctgtgaaatttattatttttcaatgacttacctcctttaaaaacttgggagtctggattaggaatgtgaaagtctcgaaaactaggcaaaatccaacaaaaacccgaaaatcctaaatacgggatctaattttctttaggatgccattgctcatcctgataattacgtgatgaagccaagccgtgagggcggtggaaacaatttttggggcgatgaaattccaaaaaagttgcgcgaaatgagccgtgccgagctcagtggccatattctaatgcaaaaagttcacgcattctctgctccggtaatttttggcataaatcaattggcatgttcaggaattacattttaattgttcgagttttggataggaatacatggatctggagagtaaaaaatcggatccgggtgttgccgggcccagaaaagccgagtccagatacaagtttttaaaccaagccagagtctgggaccacaatggtcatataatgaggagaaaatttaagtaatagctaacaaaaattagaggtgttgctaaaaataacaatttttcctcagaattacatggtccggccaaatgagcgcgtgcagcacggaaatgtcgtcaccgagctgagcactttcggcactctgctgggccatgtgaagacaaaggcggtgctgcacaacgcgcagcagggacattacgcacgctcaaaaccggaaggggcaacggagggcggcgtttacgggggcggaggcgttgtcgactcgccattcttattttaggagaaggggcggggaatgaaatgtagtattattgtatatactattatacaagta

SEQ ID NO: 35773 - DNA, 900 bp, Heterodera glycines
atttgaactaagattttgaaaaattattgattttgtctatgacttttcattgcaattgtcgcgaaatgacatagcaccaatgaaattataaagaaactcaacaatttgtaatcaaatttttgtggtagaagtcataaaatatataatataaattaaaaattgacattttaagactttgaataagacaattattggaaatcccattggattttgcaatactcacaaagacaagattaaattttgattataatagtttgaaataaatcaacgtattttaaagcaaatcaaaataaataaacacaatgacatttttatttttttcaataaaaaaaaatttgtccaacgtttattaataaaaggatcaaaaatatttggtaaaaacaataattttgattagaaattaaaaaattaatttcaaataaatgaattttgcactcttaatcagaacaagagataactggttaaacctgaagaaaacaaaaaaacaaaaataatcgtatatttaatcaaaattattaatttttaaattatattaaattaaaggcattatgactaatgagaaaaaatcgctgtggtagcgaatttataaaattaaaaattaaaacaaaaaatggcatatatttttgaattttgtaattcttttctttcgagaattaaatatttaaatggatattttaaaaatttacccctttaatattaaattctattttttaaagtaaattaagttttaagtattttaatgtggtggctgagtcctctgcagcatccgatgttccatctcattagctcattaaagaggtttccaatccgcattagttaaacacaatgacatttttatttttttcaataaaaaaaaattttgtcaacgtttattataaaaggatcaaaatatttggtaaa

SEQ ID NO: 35774 - DNA, 1166 bp, Heterodera glycines
cgcgaggcattggactgccgtccgcctccacagcaacgacactgacattccggaaatcaacatagctgacgtctaactctacaacgagctcaagctgaaacaacagtcggcccccagctctcaaacgacagccgtcactgcagacatcagagcgacacgaaaatgtgtgaacatctagaaagagagagagagagagcagagagaagagtagagagtgcgagagagtatgagagatgagccacatacccattactatgtggatggtgataatatgtggatgggaccatccacataagagtgtttaaggggatgggatttgtccccataagagcgtttatggtgatgggacccatccccatgagagtttttaagaggatggcattcgtccccattagaatttatctccatccacataaccattactatgtggatggtgatactatgtggatgggaccatccacataagagtgtctaaggggatgggatttgtccccataagagcgtttaaggtgatgggacccatccccatgagagtttttaagaggatggcatccgtccccattagaattaaattttcatgaaattttttgtcacttataccatttagcgtagactcaatagaaccaagcatacttggtgtctttagatcgatcgcaacgacacgcatctaaaaacaccaaaaacgctttgttctgttgagttttcgctaaatggtgtgagtgacaattcggtggtcaccaatttcgtaaaattttttcagtcaattacaccatttagcgtacactcaacagaaccaagcgttcttggtgtctttagatgcgtctcgatgagagcaacctaaagacaccaagttaaaaagtcagatactgttattaataaagtatttgaataaaaaaaatttagttgaaagccaaccaaaaagcaatacttttcattttttcttacttttgagacagatttaccaactttcattaaaaaaaattagataaacaatgatttcagtaaatgatctgattcttaggggtcaaaagccaaatggttgccgctcgaacaaagtatttttggaaaagcttaatgaagcgatataactaacatatggacataatgcaaaatatggacaatttgaaataggacataaaacgcgtttttctctatttttaaggctt

SEQ ID NO: 35775 - DNA, 271 bp, Heterodera glycines
tgaagaattcgaaacgttcccaccatgtcgcccagaacatctctggcaaaaacggtccggggccttttccagcctttattaccgctgccatagttggacttttcttaatttgtcccactcggatcaattcaagatgctgatcaactgtaaattatttttgagactgaaacgagaactcctagccatttctcacacccatacttttacaacctctgcttttattttaaaaatatttttttatttcaactaatccgatagatttaaataattt

SEQ ID NO: 35776 - DNA, 1498 bp, Heterodera glycines
ttagtgaaaaaaaatatggatcgaggaaaacaaatgaaatcaggaacattatacctattcgctttttaaacacaactctaacaaagtcataagtagggagtatttttaggtttttaactattttttctgcggctttatttcgacgagaaatgcttattttggaagttagccactaaaatagttttttgccactattttggcgtttcgtcactatttttgccactattccgacaacttttgaaaaatttctcaacaaaaatacaagaaaatttaattattttgggaaaatccgatctaatttcaataaagaaaaaaaaatcattttcaaagaaaattcaaacaagaaagaatttcaaatcgtgttggctggcctcttttattgggacgggattgacccaagggggggggggggactttattggcttaatttccgcccctcccccgtttctcctttggcaattttatgtaaattttgggatggggaggaaatggagcaatttacatcacttccatcattccatcgaatttatttccagtttatttttttaacaaacggagaaaaatttgtggaaaaattttagcgataaaaattcctctttttaaattttaaattttattatttttgacaagttctgtcagttatttttttttgtattatttcgtacaaccgataaaagaagatcattctacgcttggtaaaaaatttcaggtcgattgcccatgggaattaggtgaggtggagaaaaaaatcataaatttataattttgaaacggagcatattgtttgaacttttgtctcaataaaatagccttgatttttaaaaatcctctcaaatcacaaaaacttaaactatttcccctaataatcaaaataacataaaactttaaatgtattgaaactgaatctcatcaaaaaaatttttgaaaaagaacattgctgaaaaataaggattttaatgcaaaaataaaggacattaaaaataatgatttttttagttccattccggaaaaaaatttgaaatttctttagctttttaaaaaaatagagtttgtcttaaggcaattttgtacagttttaaggctaaaacttattacttcctgtcatattttaaatatttaattattcggtccctctaaaaatggcaatccttttaaaacccacaaaattgcccatgcctttcggtgtgacaatgacgcaattttggccaattgccccgggctttcttgggatttatttggtagcttttaaagaaataaaaaaggaaggcatagaatttgtcatcgctgcattaattaattcatcctcagcttccaaatgcgcatttatttcagtgtcggcactttcgaattgttcgaattgctctcgagactcattagctctttacactctgactaatgagtcttttttttaattttttgtccctcccttttcaataattggcactatttccccggtacatcccccctcagactgccccccccccgcaattgttttgtg

SEQ ID NO: 35777 - DNA, 1012 bp, Heterodera glycines
gtacgttgtttggcttcccgggtcaaagagaactgctactttgattatatttcggctgtcacgatttgacttggccaacaaccgtcgcgtcatcagatacgcgtgcggttttttgcacttgggagccttgttggctctccctttgctggtgtccacggtggacatccccatggattgaacaatctccccctctcttggtggagggtttgactgatcgttctgttgaaatccagccgtgatcaggtgggtttggctttccacctgccgctgagggaactttcgccctcctggctctcttcccgacttgggggaggaagcagaacgattcccatttgaccgtgaatgggatcctccctcttgaagcatatgaggaagtggtgtttgttgccacaatttcggcaacggtatggtgaggttcacctgagttgacgaatcgtcacattttggctgggttgacgaatcgtcacataatggcatcatcaagatgttgttctcagcctgcttcttacagtgcaaacgcacaaataccaataacggcaatggatttagcggatgctagcagtgaaacgtctgaaagtggttccccttctgcgagcagcagcgacgatgaggaacgtgagttgttgaatggggtgggaaggggaatgacacaaattttccataacttttttgggcctgaattctggaaaatttctgagcctccgaaggcattcacagtgtgtggccgaatgaaaacgcaattttccgctcatcaatgtttgtccgttcatttagtcgtccgtctgcggccgtatcatggagcggctggagttgcacggcagtcacaaacgcgtggtgattgttgcgcaggactctttctaccgcgatttgacctcggcggacgaaattgcgaaggcccggcgcggcgactttaactttgaccatccgaacgcatttgagcaccaactgatgctgaacacactgcgacagctgcggcagggcaaatcggtggtcatccccaaatacgacttga

SEQ ID NO: 35778 - DNA, 975 bp, Heterodera glycines
  misc_feature (57)..(57): n is a, c, g, or t
ggggaggggaatggatcggagaaacaaaaaaagacaaagcaatagagagagaaaagngagaaaaaaagtgatcagatcaattgttcattagctttttgcatcggaattccctctcctcggctcgttttgttcacttcttgatcaagtttcaattactttcctccgatcggatacggtgaaaatgtttttcgatctgaaattgatcttctcatttcggaatgccctctcaaaggttcgcaaattgtcgtcatcgttgggccatggaatttttaagacacttttttttgttcaattggccaatcgaattgaaacagcaggcggaaaaagcatttcaaaatttgaaagcatcaaaagatgatcactttacatgactcgattttgaaatgagcagagaacgcttcaaatggccgggcgaatttcaggaaaattcgggaattaacttgacagccgatccgctaacaaatgtgtatttcctaactcaatccgccaaagatttgcttaaaaaatttgggtcaaaatatttttggctttttaccgattggaaaaaagtgcgtcattgagggggacgaagacggaagaagcggaagagggggcacaaagcatggcaaaggaatgccacccgaaaagcaatgtttgttttttgtaccatcccccgcctttccctttccatgctaaaaggggaccaaaagggcgggggaggggggaaaagccttgtaaatgcgaaaggcaatggacaaacattttgtgggggaggagggccaggggaagggccaaaggatggggagggaaggggatagggaaggaaagggagggatagggaaggaaagggagggaaagggaggtaaagggagggaaagggagggaaagggagggaaagggagggaaagggaggaaaagggagggaaagggaggggattggtttggatgagttttgacaagaaatggacggaagcggacaatggggaggaatctgtc

SEQ ID NO: 35779 - DNA, 909 bp, Heterodera glycines
atacgtattctctgcataatgaaaatccatgttcaatttgaacaacgcttgccagacctcatctgcactgtttgcactatttaggactaataaaataaaacaattatgcacattatgaagccattaaaattaatgattatttttatcgtaatttaaaatttgattactgtaaatcgattgattgataaagaatttgcaaccattttttatgaaaaatcactacctacttgtatttagtttatcttgcataggtgccactgctgatttggccaaaattgcttaaaaattaattaaaatactaaatttacttttaattataaaatttctaataaagctttatatatatatatatatatatatatttacagctttttatagatttatatttctccacaagaatgacatcattttgatttagcagcagcaaatgacgctgttcaattttctgaaaaagctcaagaacagcggcatatctttccaactgttcttgtgatggcaattggcatttctctactaggttgtgcttcatgtgctcaaatattattatttatcacttttaaaattcgatcaaatccgcaattttagcatatttttgggcaaaaaaaaatggcataactttacccagattaattaatgaaattttacacattcttggtatcgtctgatagtgtccaggagtgttttgtttattagcctaaaaatttcgtcaaatttcaaaaatttgtatgaaaatatgaccattttttgccatagcttataggccaattagaatacatttagcgctatcgagaactatgcctctaaaatgtaaaatttggtttgcttttgaacacagttagtgccattttttgccgtcaaattagaaaattcaatgctaattgtaagaatttaatactcacaatcagaaca

SEQ ID NO: 35780 - DNA, 1000 bp, Heterodera glycines
  misc_feature (51)..(51): n is a, c, g, or t
  misc_feature (973)..(973): n is a, c, g, or t
ttttctaggcctaatggctaaggtggcgtcattttttacctctgagtaacncggaatacaaattaatattttcaattaatttttggcactatactgctatagtggcttggccttggcttggaatttttttctgtagctcagcttcctgacagtcgttttttgatttgaaggtaccattcgaaagagctcttttttctaggcctaatggctaaggtggcgtcattttttacggaagaataaccggaatacaaatcaatattttcaattaatttttgacactatactgctatagtggcttggccttggcttggaatttttttctgtagctcagctccctgacagtcgttttttgatttgaaggtaccattcgaaagagctctttttctaggcctaatggctaaggtggcgtcattttttacggaagaataaccggaatacaaattaatattttcaattaatttttggcactatactgctatagtggcttggccttggcttggaatttttttctgtagctcagcttcctgacagtcgttttttgatttgaaggtaccattcgaaagagctcttttttctaggcctaatggctaaggtggcgtcattttttacggaagaataaccggaatacaaatcaatattttcaattaatttttgacactatactgctatagtggcttggccttggcttggaatttttttctgcagctcagctccctgacagtcgttttttgatttgaaggtaccattcgaaagagctcttttttctaggcataatggctaaggtggcgtcattttttacggaagaataaccggaatacaaatcaatattttcaattaatttttgtcactatactgctatcgtggcttggccttggcttggatttttttctgtagctcagctccctgacagtcgttttttgatttgaaggtacccattcgaaagagctcttttttctagggctaatggctaaangtggcgtcattttttacggaagaataa

SEQ ID NO: 35781 - DNA, 810 bp, Heterodera glycines
aactaaaaaggattcactggcgttggaaaaaaattggttgttcaaacacgccgccttccactaaaactcccatggggaatgaatgtcaaccaaaaagagaatttgtttaaaaacgagcaaaagaaaacaaagggaccaaaaagtgccaatgagaatcgaaaagtgaagaaaaaaggaattttcattaattttatttgtgagttgattttgttttgaaccacctccctaattattccgcaacagctggaagaaacaatttgcttttctggtggtccgactttggtgaattcattttttaatcaaaaaaattttctttaacctgggttcctaatcatttcattccaatgaaattgatgtaaattgtagccaattattattttgatccattgtaatggtcgttacaaaatatggtgggctttgaaagtttatttccaaattttcacaatttcccaattccaaatttttaaataatttatgcaaaaattttcggaatcattttccgttccaaatattcatctttaattcccttttgctttatttcttgcccgcaggcaaaggtgttaagataatattggagttatttgtttttcactattttaagagaaaaaagtacatatatgagcaaagtaaaagacagaaaatgaaaatgaataactgtgaaaagaatttatggaccgatcagtgagaaaggggcgagacaatgtacacataactagtttaacaaagatagctgatgtaagcataaatggatgcaagagaaaacgtttgagagacaaataaaataagttaataaattgaaatattttaatt

SEQ ID NO: 35782 - DNA, 832 bp, Heterodera glycines
atctgcggcgtaatcacagtaaaggctaaattgtcatattaacaaatgaaaaatatacatttttttaccattcaaattttttcttcgaaccgtgcatcgttaggtgctttgcgtacccgatgaaacgttcaaaattggcaggacatttgtcacagaagtatttttttgcctataattaaattaggtagtaatttttcaagaaaaatttggacatttttttcaaataaaaaatctctaagaaatctttgcaaatttcttcttcttgaaacattattaaaaaaaaattcggggcgtggggggggctatgatgtgatggaaaactgatcgggcggacggagaaatgatgggggggggggggacggcggcgggaacgagctgttgggagcagcagagcagagttgccgtgggtcgggatttcggattgtattccatttttgggtggtcatatgtttatggtggttttgaagatggcaaaaataaccaatatttttggtccaaaaatttgaaaagattcatccaacaaaattttatatgctcatcaaaaaatctttaacagcaacttgacagtgcactccttcatactgatcgggataccataaaatacactgaaaatcaggggaattttcagaaatattttttttaggtggatggaaatatttttgtgaaatttgagtagggccattggaaagaggataatacttacttccgatttggcttttgaatggtgcacctacgacttatagccgttgaggtatgggcacttccatttcggtgttgatcatatctagtgtgaaggtggcctatattcttaaagaaataccggtactttttt

SEQ ID NO: 35783 - DNA, 1005 bp, Heterodera glycines
agaaatgcccaattccttcacaaattctttctgtttgcgttggccatataattctttaaattcatcaattcttttgatgaattctttctttttttgttcataaaaactctttttcattatttttactttatttaaatttaattcgtttttccatttgtatattttatggcgacttgtgcctaataattttccaattttcctctcaatttagttggattttttcttttccattttcccatttctcttaacttttctttaattttatcaaatttttgaattatttcacttttttgttcgtcattttcctccttctcttttggcaatgttttgatcagagttatcagtaaattgatcaattgggtcgctttcgatttcttcaccactctgatcaactgttgaataatcattttgtgcgttttgttcaatttttattaaactttcttctctttcatttttgacccaccagtcgccaaatattttgtcaaaatttggtcggattcaaaatcttttcaatattttcgtagcgcttccataacaattttttaagataatttttatagaaacaacagaaatatagaaagtaaatgttttttagcggcaattttagcaaataaaataattcaaatttttcgtaaccacttttaaggacaaacctaacatttttcccacaaattcaaatccgtacagatccgttcgaccagctcttctaaaaaattttttaattagggtaatgaataatatgttatcaggtaatatcatatttaatgttaaaaaaaactgaaaatatgttatttaaatatatcaggtttgtctcgtgttattagtttatgttctctctcgctctctctatctctctcttttacagagtgaatggcgaacattttaaatccaattggaaaatgaaattgtttgatcaataattgagtgcaaaaggagcgggtgtaaaataatttgtaagtgaaactcatagggcatcggtcagaaaggtaggaattataaaaagcg

SEQ ID NO: 35784 - DNA, 926 bp, Heterodera glycines
ctcgtgcagtgtcttcttcacttcgctttgactcatcaccaaaagttgttgaaaaagggggaaaaggaaaataaaaaataatctaaatttgtgggaaatttaatgagaagcataattcaagagtgacattgaaaaaatgataaatattttaaggaatgcctataacaaatctgacgtccatttcgaattgcgaattcgataaaaggtgtaaatgtgagttaagttaaaaggcaattttcgattttttgttcacggataataacgataattcctttgccaaaagttggtgtttgttgtttattgaaaatgatcggccatcataaacaaataacaagtcaacacaccacacaccatcccaaaaacgagagatgaaccaataaatagagaacatagagaaaaatacgtctctcactttagcgtactatttctttactctgctaacctttttctgataggcctaactaaaattttcaagaaaaattttcctaaccccctaggaatttttttcgaaaatttccccgattacaagccatttttggcttttcaggtcaccatgaaggagtgatttgatcaagttggtgtaagagacttttttgatcagtatcaaaagttagcttagcagaaattttttcagaatattttgcctacttggaattgaaattttggcgattaactattttgttcatttacttttgcacctgactgtatttaattataaaattatattatcaagacattacagtataatttttgtaataaatttgattctttttaaatccaattaaatatattattttaagatttattcagatcttatttcaatatttatttccattaaaattcattatgatttgcatattaatggtcaggaaacgcaatggtttcattgcgtttctcaatgtcgactcttatctttcataattttt

SEQ ID NO: 35785 - DNA, 1267 bp, Heterodera glycines
  misc_feature (17)..(17): n is a, c, g, or t
tatcaaaatttcgttgnactcaataaccctcagacattttcactcggtttttgggaaaaattttcgaattacggattttatgcgatttgtcaatattttgctaaaaatcagaaaaaagcatcttcgctaaacattcaaaaagccacaaaataaaagaaattctcggatatgccggaaaagaagtgaatgcctaccctttggtaaagtctgtgattgaaaatgcgacacttcaattggttcaattgtcggacaacgaaatgcgattggagacaaaaaaggagcagccagtgaaaagtgcccaaggcaaacatgctaaggatgtagtccgatgcctcgtggaggctttcttttcgacaaaccaatctgtacagtccgcgcactggggaaagatgctaattatttaagagaaattggaacaaaattttggacgacagcaaataccgtactctgctccccccccctcccagccttccatttttgtttttatcgttcatgggtaattaaatcaaatttcgagccttttgaaaaaaaacaaattgttacaattgcatttcgttttagtgctgagaaaacatcgttatcattaccataagtggacatggatggtggacagaatttctgttacgaaatacccccaccctctcagaggcataatttttactgaattaaaacacttccaaatattttctgacctctttctttcctttttgggtttttaggccatttctggcctatcgacaaaaccggggaaaaatgagtgcaatctgttaacagtttcatcaaaaagtgcttctatttacgtgaatttacaaaagtgaaatactaatcttggttgacccctcccccattctgatgaatgaccgaggcggaattggcacgttttgaagtggggaaagggaagggggcaaagcacagcaaaaccaatttatgtataggataatcacttcctgaagtcatacggtggaagcagcaaacagaaaataaagttcattttgggcaaccaatgcacaacaggaaataacttttcgaatagcaccacaattgcgataccaacaagactcagaattaagatgaccaaaagtgcccttgtgacggactgcgactttttgaacagaaacgacacgcagcaaagccatggatggtaaatccaaaagaagagggcaaaaaggagcggaagactgaaagaaaaggtaaaagtaattagataattaatattagcagagctgttcaaggcatggaaaaaactcaaaaattgacctttataaga

SEQ ID NO: 35786 - DNA, 838 bp, Heterodera glycines
ttcctcaaacgatgccatcaccgaaatcggacgatgtctccgccgacggcacggccaatggcaataccaacgccgccgccccaatattactcaccgccaatgggcgacatttttcaatttcgaccaaatgcgagtgttagacatcgatcggaatcacaggtagggacaaaatgaaaattaatttgcacggcttttgtaaatgagtgccgattgttcccattgattaaccagggattcaccgaagtcaccgtccaattgcccgcgtcagtttgtcggtaattccaaaaaatgaatgctttccatttaattgcctcccttttcgccctctccacggcacacactctctcaacattcgtccgaccacttctctgacgctccacgaattccacaatcttttgttggcaatgcaaagggaaatgttgacggaacagcggagacattgcgaaaaccaaagtgatcaaaagctaaccaaaaacactaattgactcggtcgctttgcctaattatttgctgtccccaaaaggccttcggttggctccgttcgctgtgtctgccgccgttccgcccgtcgaccctcccccaaattacgagtccgcccttctgctcagttcacctcacccataatgctcaattttcatctgattattgcatttaattttctctttttgcgctggtgaaataaaagtgaatcaaaatcagacaaatgggacaacatttggtcaatgaattgacaggaatacgaaaaccttcgagtgttcgtccctccgcctcattattttatttttttatgtgctaatagtattttaggttttactcacaaatccttccccctccctct

SEQ ID NO: 35787 - DNA, 459 bp, Heterodera glycines
ttttgtcttcgtcattccctttttcatcttgaccaaaaaatctcatcccatcgtcattccctgttgaaaatgggacaaaaaacagaaccctgacagcagaaaaatgatcgaattcatcgtgtcaacaaatagaggataatatccttaaatgacctactcgtagaatgacgattgtcttattatacatctgattataaattactaagatgccgcttgattaccataaacataataaaaatttacttagatcatatagtaatgaaaataaattctgagatatctgccgtgctaccctttgatgataatataaaaccaagatatgttacattgactaaacggagaaaggtcattctatggctataattcttgaaaaatgcataaaacttcgactaaaagattgaactaccacttattgaattatttttccatttgattaataagtattttaaaaaacaaatt

SEQ ID NO: 35788 - DNA, 1397 bp, Heterodera glycines
gatgcgtacaccctgaatttgtcggattgggcttttcaggcgcttgggatcagctgaaagtcacttttcacttcaaacgcctctacggttattatgtgctccaaatgtacctccccacttatttgtccgtctttatcaggtgggccaattcgaatgggtcaatcatgataaattataacattctaaatttaaaaagatatggcaaattactcaaaaaataattattttctggccttgagctatcttaaaatctcaataatttttgattgattgacaacaaaaagttcttttccaaaacacaggcggttttttgggatgacaagcaaaagaagaataataaaatttaataataaagaaaatttataaatttatttactggtagagactaccggtttctcttatattcaacaattaacaattagttatttttgggttaaacctgttttcttttagtttacgggtggcgcgtccgttaaaaaaagccgggggttagccgccccctccccgtaaccaattttgactaatcccttaatccaccttatccaaatgatttaaatgggtttgttttatcccccctgtgtcagctggatcgccttttggctggacagtcgtgcactccccgcccggatcactctcggcgtgtccaggtcgttcgttctccgttcgtttgccgttccgttttccatcattttgtttcacttcagtctcatggcattgactttccaattcggaaatgtcgtgaaaaatttgccccgcgtttcgttcgtcaaagtctctcttatttttgaattcctccaaaaatggccaaatttgcctcaggcaattgatctttggttctttgtctgcgtctctttcattttctcttctctggtcgaacttgctttggtcggttttgtcgagaaaaatcacgagcgcaaattggtcaaatttcatcgggaaaggctaagccgacgcaatccgcacaaacattcgacaaggcatttcccttttttggaattttaaaatttcatttttaagctccaaaccgcgaaattctctcgctctccctaccacaacacttaacaataattcacaaaatgacgatcaaattagaaatggcgaagttgtgagaagcggatcactgctcaaaagggtgtacagtcggcgttacagtttgctaaggcatagggccagaaggtaatcgtactgtaatagacgtactgtcattctttgcggcatactgtatgcaccacttgttcctttaaagaagcttgatctacgacgatgatgaagcgtatatgcactggcgaacgcccaccgagctgagcaaccgcgtggacgcagtcgccgcgcggcttttcccggcgttatttgctttatttaatggtacggtaaatgaatgtgaagataatacgctt

SEQ ID NO: 35789 - DNA, 1009 bp, Heterodera glycines
  misc_feature (85)..(85): n is a, c, g, or t
aaaagcgctttgcgtatgagacggaggggctgtgcacaatcgcccattttatttcacagaggatttttatatttagaggttatcncagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttataccttacaaatgcgcttgagcatgagacggagggcggtgcacaatcgccattttatttcacagaggatttttatatttagaggttatcccagaaaaatggatatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatatctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttttgagaggatttttatatatatacgttatcccagaaaaatggctatctctttttttgagaaattttatac

SEQ ID NO: 35790 - DNA, 881 bp, Heterodera glycines
ctattaaatacatttgtatacgcatttatatgtcacatacgcatatatttttttcatgaattttttttacaaaattcccattaatttatttgccccttccttcataattgtacaatgttttattcaagcaaaattcccatcttacttacacacagtgtgtggtatctgtcctgatttgtcagaaatgtcctgctgattgtagggagtgacccgatttgttctgatttcttaaaatttttcagaaaatttgtaattttatggcgtaatatgtcactcaaatttcaaaattttatacggcggtgactaaaaactacgttcaagaaaaaaccactcttgtcatgtcctcggtcatattccatgttagatctgttcctgcattttccacaaaaaacccagaaaatccagttccaaattttttttttgataaatcataaaaattgcaattaattttaaagaaataattcaataaattgctaacgaaccaaatatgacatttttaaatttatgaaaaattaattatttttactgatatacaccttataattattactataatacaatatcacaaattataattcctttatataaagggacattctctcaacaatcaaacaaattaaaatttttatttaaatataaaatttttaattattttaaaaatttacctacgaaatgcacgaatttcgccgtaagtgctcaacatatctgcccttttcactccattccttcacaatgcacgggaaatgctcatttcgtacaaattcctctgtaactgcaatttaaatttaatttttgtgcacctttccctatataaaatgtcgaaaaagcttttgatgacattggcatgatcaacggctacaacaacgtttgaagtccacctc

SEQ ID NO: 35791 - DNA, 972 bp, Heterodera glycines
tagtgatgtcgatatgtcaaaggatcgtctgggcattgcacaatcgaatggcgcatgtccaatatatacagaatggctccgttggacaaatggatgaaaacccgttaaagtataaatcacaattaagtcaatattttgccatttattttatctagaaaaatggagattatgacatccaaaacattaaacgagccaacctcatttaatgttaacggacgagttcatcgaccggaagacggagcagagcaaaaccaccaaacgatgcacggagcagcggatgcgtctaagtgagtcccgacaatacggtggcattggcgcttcgctcatttagacaggagaaaatgcacaaactgcaggagattgagaaggccctgctgccttttgcggacacttccccttcctatccaaacgctgcgccctttcccgattcgaccaataatttccggccacatttctttgcacctcacggccaaatgatgtgttttcatcgtctgctttgttttcttactttatgaatattaagtcaaactcctcacgcccacttttgcgcaattcgtcctttgatgggttcttttcctcaaaaccatcctcttaaaatggcacagacgaatacgaaccagcaaatgtacaactcaataggggagcaaacgacagtgatgcagggcagtgagtcatcaccaagactaaagctgtacttttctcaacaattcagtgactgatggggttgtgatgacggctgatgaaactgaaatttcgcaacagacttggcgcccacagtagaaaagaatgattgacaaatgtgcaataattttaacatccataagttaatagtttccggattatgaactatggactgtctcgtaattattgtcgttttttgataaagtgaaaaattcaaaaagttgggcttgagaaaaactgctttatgtaattttaggggacgggacgaaatctcgccgccgaaatctcgcc

SEQ ID NO: 35792 - DNA, 1019 bp, Heterodera glycines
ctcaaaaacaatgtccgtctcatatctttgagggatgaccgaccctccatcatcatattagctttgcctccaaagtgttgcacaagtctgaaaatttgtttgaaattgaccggcaaacccaaaatgcttcaccccgccccccgtcctcccatctcccgccggctgtccgttaagtggttttgtggtctgctaatgagtgtaaacacaaaacgggtggttgaccccacacacacaaagtcattattgttgcgctgaagtttgacactgatcagcagccaaaattagtgtacttgtacattccaaacgcatttacgtatatttgaaccccaaaagttgtcaaaatattaacattttataaaaattataaatttcatttttaaatcagaaatatatccttcggtatcattaaaataataaattaccaccactttttccctgaaaaaagtggtaattaacaaaaaattgccttttattgtgcctaacaatataagtacaaattaataagtcatgacttaacttctgctgaaaagtctgtccataaaacccttcactcatcggcatttgccgtcgtctggaaattacaatattttcatttttctcttcattcacattctctcgaaacacaaataagagcaattcctgttttatcgagctttcgctcaaatgatcagataaagccaaaaaagaagcgccatcgtcgagacggacggatggaaatgtcccctgccctccgctccccccggggggcaggggaatcgcggccattgccattgcgttgtaatgcttttccgggacggatccgttctatctgtgagcccaacaacgccaaactcagcaaaggacagcagcaggcacaaaagcattcattcattcattcatttggtctcttttttcattttccattattctcacattttgccacttccaccatcaatcagcataatattctcagttctttcagcatttttgtatccaatatttatataatttcttttttttttttgttctccctttttttg

SEQ ID NO: 35793 - DNA, 1053 bp, Heterodera glycines
  misc_feature (18)..(18): n is a, c, g, or t
  misc_feature (1005)..(1005): n is a, c, g, or t
ttacgcatcggcaacacncaacggcccttaatggcgcgagtcgatgtcacgaggggaatcacttacgaccttttgaaggccatttcctcttcatgcaacaacaacaaacggggcgatagtaataaataattgtttttgctcaatttccatttgcctttttgtgttttaaaattttacttaatatcgttttgccaattttctcattcatttttcggttgtttttgtttcaatgccattgttctccaatggttacctgcatagttttgatttgagcatttccatatttccattcaattttttgctttttacgaatttattgaaaaatgactgaagccaaaaaattgccggaagtgccggagacgctgctgaagcgacgcaaaatcagagccgcacaacgggctgccagggcgaagaacagcttgaacaccatcaaagtatttcttacacaatcaaatattggttttccatggtttactgacttcaaaaataagacctcagttaatgattcgataaattagaaaacaaaatgcaaagtcacaaaacgcacattattattttggatacaaatgcgcataatttggtaacatcatcaaattgatttgctcgagaaaatgagttgtgtcgattttcgcaatttttgttaattttaaaaatggtgtttgactcaaaaacagaaaagtaccaataattgtcttgtctagtaatttggttgatctccgttgcacacgcaaatttttgtgtcgaattggtacttgcacatggacaatatcattaactgaaattcaaatctcaaatcatttctcaattgcagaaagcgaaggccaaaaagacggaaatcttcaaacgggcggaacattacttggttgagtaccgccagaagcagcgccaattggtcgcgttgaaacgggaagcgaagaaagtgggcaattactacgtgccggatgagcccaaactcgcatttgttgtccggatcaagggaatcaacaaggtgcattctaactttanattgcttttttggtacaaatcttggcctgtttcgagcactttgccatc

SEQ ID NO: 35794 - DNA, 912 bp, Heterodera glycines
atttctccacaagtccgacaaaaacagcgaagattttgtcatggtaactaacaaatacatttttgttccttttaaattaccatttttttcctgtacagcttgaaaattttctgtacaacaccaacccgctcattttgcatggcaatgggccgtccaagtcgcaactgaacgtgctggagaattacttgactcgtggcaaaatttatcaggtttttttcaacagttttatgtctctttattttggcaccgctgaaaaaaacattaaaaattcgtacattgatagtccataatacaataatttaagaaaaacccaaaaaacattctttaagaactttcattaataaaattttcaaattttttgaaaaacaaaaaaaatttttttatttttctgatattatatgaattgtcgtgacactttctcatccacctgtttattgttaatgccttacatctttgaaaaatttttttgttatagtcctcttgacaattttccccctattttgcacccacaaaatttatttttttccctcccttttttcgaatttgccggccatcggaatgccgttatcttcgcccgccgatgccattgcaattgtcgcatttgtgttgaagccgacgccatacattgaagaatttttgcaccgtttgtctttgttggaatatccggacaaaaacagtcgtgtcaatctgcgcatttacaacaaccaaatgtacaaaaaacgacactttgaaacttgggcaaaacggcgaagcggaaaaaaaaagacgatttgggattgtgcaaattttgaatggcacggcaaggggcaaaccaaaattccagcggaagcaggggcagtgaaatttgaaatataaataattttgaaaggaaaaaggcccaaatttttggggggaaatccttttaattggata

SEQ ID NO: 35795 - DNA, 923 bp, Heterodera glycines
ggccattttttggtaagcagaactggcgatgtgggatgaccaaacgtggagttaaggtgccaaagtgcccgctcattagaccccataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtggtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtgggtcagccgatcctaaggcaccggctaacgccgtaacacactacggatgacgacttttctgtgcttgcgcagttggtccatccggttgccgaaagggaagtgggttaacattcccacgccaggctagggaaatgacggttcgcaagagctgttttgcgcggtaacgcaaatgaactcgcagacgtcgtgtggagtccgagccagagttctcttttctggtttagggtgtgcgtgcctggaagtggctcagcctgagatagggatgttgcgcccgtaaagcaccgcggttcctgtggtgtctcgtgcgctccacacggcccttgaaaatgcgagggaagctatttgaatctcctgcctgatcgtaccgatatccgcagcaggtctccaaggtgaacagcctctagtcgatagaataatgtaggtaagggaagtcggcaaattagattcgtaacttcgggaaaagaatggctctaaaggtcgggtcagccgggctgttgcg

SEQ ID NO: 35796 - DNA, 504 bp, Heterodera glycines
aaaggggaaaaaattactgcaagaagtgggattcgaacccacgcgggcagatgcccactagaaaacccagtgaaacgggcaagtgtttgcgtcacttgagtctagcgccttagaccactcggccatccttgcacataaggccagctcacattagtctattcatttagatttttattatctataatttttcgtttctttttgctggatattttataagttatgactgcttaaacgaaagagtttcaatatgaaaaacggaaacctcaatcaatttattcagcattttttcatgtaaaaatgcttataaaagacaaattttatacaaaattcccaaaaattacttaacaatgtttattaagtgcactttcttccttctcaaaaacaatctcctgcaaaaaaaaaaactttttaagcggttacatacacatttagcatattttttgacgagaaaagggaaaataaattatggctgaatgtgcatgtaaccgcttaaaaagttttttt

SEQ ID NO: 35797 - DNA, 930 bp, Heterodera glycines
atgaattccaaccacatatttcggaatagtagcgccttcataaatttttctggattttctttctgggcgagtttggctctgaaaattttgaaaaaacgtctatctctttttctgctcaacactcaaatgaattccaaccacattttcggaatagtagcgacgaccctaatttttctggattttctttcttggcgagtttggctctgaaaattttgaaaaaacgtctatctctttttctgctcaacactcacatgaattccaaccacattttcggaatagtagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggattttctttctgggcgagtttggctctgaaaattttgaaaaaacgtctatctctttttctgctcaacactcacatgaattccaaccacattttcggaatagtagcgacgaccctaatttttctggattttctttctgggcgagtttggctctgaaaattttgaaaaaacgtctatctctttttctgctcaacactcacatgaattccaaccacattttcggaatagtagcgacgaccctaatttttctggattttctttctgggcgagtttggctctgaaaattttgaaaaaacgtctatctctttttctgctcaacactcacatgaattccaaccacattttcggaatagtagcgacgaccctaatttttctggattttctttctgggcgagtttggctctgcaaattttgaaaaaacgtctatctctttttctgctcaacactcacatgaactcaaccacattttcggaatagtagcgacgaccctaatttttctggatt

SEQ ID NO: 35798 - DNA, 1031 bp, Heterodera glycines
  misc_feature (26)..(26): n is a, c, g, or t
cctttgaaattgaacccttcgactantgggaagcaaaccgtttataaattgcttataatttcagcagaagacactccaacgaagagctcgagaaaaaactgatggaacaaattgtgaatttgcagacgaaagttgacaaaatggaaatggaacagaaaaagcaagagggtaagggaaaagagtgaacaacggttactgtacctaccataatatacctaataattattactatattaaatattattttcgcttaagaaattcaaaagattaaatacattaaaattaattaataatttttagttagtacagacaaaatcgaacatttgcaaaatgaacagaaaagaaatattaatgcattggaaaaggagctgaaaaagaatcagatggaaatagttagttgaattttaattttaggcacttttaaatattatatttgaaatatccaaaatttaatttagataaatatagttgaattttaatttaggcacttttaaagttccgacaaaattgttgggatgccaacaatagtcataataacatcgacataattgatgacaaatgtttggcggtcaatcataaggaaaatgaatgtaacttttataaattttaatttataaattattattttttttaattaagccgagttttgcaaaatcttcgctacccatccaattttatttgacaaggatttctccaagattttttactttgaaattgaaatcaaaaagatgcaaaagtaacagtaatataatacataataaaaatgtttatttttttcttatttttaaaattatttagttcctttgacaatttcctctccttcggattcagcaccaaacaacagaaaaacgttgacgaaataaacacttattcatattgtaatcacggcttttttatcattaacgccgaatatcattatcaagaagctcaacaagatgattccttcaaagaaaatgatgttgtcggatgtggcattaattcggccacccgacaggttttcttcaccaaaaatggacggcgtcagggtttgt

SEQ ID NO: 35799 - DNA, 999 bp, Heterodera glycines
aatatcaaaaaggaaaggaacggtccctttttggagccctgacggacgaatgaatgaaagaatgaattagtaaatcgcccggggggagggaatggctaacgaaggccacctgctgagaaagggtgtggaagaatgaattaatgaagtgatgagtgaagagaatgaagcgaatagagagcatcgaatcggatcagcggaagaagcggcgaagggcaacggagaagggcacgacgcactcgccacccaatcattgtgaaggtcaaatggacaaactaacgataggacgaattggagaagggtcaatacaaacagaacagaggcgaaaggtagaaaatggaaagaaagaaacgaacgaacgaacgctgtacaaatttaaaataataaaattaaaaaaaattattgacacaaaggctcatttttcaccgagggacggcatttctccccccccccccccctctccacaatcccatcttttgaggacaaaacgacatttagggacccgaaccgagtctttttttgttggagacggatagccaaaaacaatttaaattctctcaaatcataattcggtaaaattaatgcctgaataaatttatgcaagtattctttcttttaaaagtcaaaaatgaacgataaatggaatgtaattcatttgctcatcatcggtttcatttcacactgctcgacgcccacaaatcactcaaaaagtgatcaattgtcagacgacgctcttgttggaggggcggttaaatagcgacggcattcgtccaaaaaagggcaaaaaggcaaagggcggcggtgccgaactgttggacgacgagggaccaaaaaatggccgaaatttgaatgggttgaactgctgctcctcacttcccgactcttcccaattgctctcctccgatgccatttccgacgaatagttcggcgcctcactttgtccattgacaaaaatggcaataaagaaaataaaagcagcaattaaaaatttgttggccatta

SEQ ID NO: 35800 - DNA, 947 bp, Heterodera glycines
tgtccttaggaataaaagccaaagcgtggctgcgtcccgtccaacaatttcctaatgcttagtgatggactagcgagtgatgtccgtaggaataaaagccaaagcgtggctgcgtcccgtccaacaatttcctaatgcttagtgatggactagcgagtggtgtccttaggaataaaagccaaagcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtggtgtccttaggaataaaagccaaagcgtggctgcgtcccgtccaacaatttcctaatgcttagtgatggactagcgagtggtgtccttaggaataaaagccaaagcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtgatgtccgtaggaataaaagccaaggcgtggctgcgtcccatccaacaatttcctaatgcttagtgatggactagcgagtggtgtccgtaggaataaaagccaaagcgtggctgcgtcccgtccaactattccctaatgcttagtgatggactagcgagtggtgtccgtaggaataaaagccaaagcgtggctgcgtcccgtccaacaatttcctaatgcttagtgatggactagcgagtgatgtccgtaggaataaaagccaaagcgtggctgcgtcccgtccaacaatttcctatgcttagtgatggactagcgagtggtgtccgtaagaataaaaccaaagcgtggctgcgtcccgtccaacaatttcctaatgcttaatgatgga

SEQ ID NO: 35801 - DNA, 653 bp, Heterodera glycines
cttaatttgcatttctatgtttttcaggcagaaattactttgcaaaagcaaagtctcagagaatttaagcaaaaattgcaaaaactacgagaatatttgaccatggtcagaagaattgtgacagaagaaaactttcgtttgtctgttaaatactccgaagtttttgaacaaataaaagaggtaaaatgttttaattgactttaaaatttaaataattattttaggaggccccggaattggctgaaaaattggaagaattgcagaaaatgcagcgaagattggcctacctaaagttttcgaaaaatttcactgttctgctcgctgaagtgcgaaaatacttgcgaaaagggaattacttacatttgttggacaattacaggaaactactccaaataccacggaacagtcctgaggttttttggataataatgtgtttttttgaaatattctgccaagggcagccccgtagccggggggaaggggttgaatccctcctcccccccccctcgaaatgaaaagccaaaaaatgtcattttttggtgaaaaccaactcaaattcctgttctttgctcttgggcgcttaaattttttaaataacactggagaattggtccgaagagcaaaaagaaaaaaaagttcgggttccccccccc

SEQ ID NO: 35802 - DNA, 859 bp, Heterodera glycines
  misc_feature (68)..(70): n is a, c, g, or t
aatcactgatatttatcataaggggcataatacaaatctattagaggcaatccaaaaaagaaaacatnnnggatgagcactttaataattccataattcaaattggtcgatcatttctcaacagttcattcattcacttctgctgatcactcgggccgggagttgtgtcgagaagcctaaaaaaagaaaaaacaaaaaacatttgaatttgtgatcaagcattcgcttacccgtcgccgatctgatcctcgccataaatatcaatgtgaatttgattccactggttataaatttgccaatcaatcgcttcttcttcccatttggtccatttgctttcgtctcgcccaattggacaacggacgaacagaaaacgatggctattgaaagttcttttcaacgccaattgttcccgagtcaattcattggtcagcgcaaatggcacaacggaggaagcaaaagatgatctttgaaaccaaacggaaatgatgaaattgacgggggaacaagccgaggcaaaagcctgaatgtggaaatgatttaagcataacaaatgacaatgaatgacacttttcggttggggaggggcacgaaaagccaacgataggtacttccttttactgtttagatggtccattgtgtccaatgaaaaatcaaatgggtaggaggaaccttctggttttttaattaggcaaataataatgatttgtcaacgcattccaaaaactgtaaatgccaattcatcaaataataatcaccgctttgagtgctgcaatcttcgacgccaaatgcccgtcatccctattcaaccagcattggaacacctttggcacatcgtctggacgtggagtgaaaagccatt

SEQ ID NO: 35803 - DNA, 1132 bp, Heterodera glycines
aaaaaataaaataagtttgaaaattattgcgtaaaagggttggatttcatttaaatttgacatttcatttaaattcaaaaatgttaggcgtgtccaatttaggtaattggccaccaattaacacaataaattaattttgaaacgattgcgtgaaagatttggattatctttgaaattttaaatttaaatttggcatttatattaattccaaaaatttgtttggccaatccatatttacgataattggccaccaattattattattattattatttcaaagcgaatgcgcattatttaggcgaccaaaagccgacccattgacatacaaacaatgcctgtacaaataataaattatttaaaaatgcaaaatgttgttgtctggaagcaccaacagcaggacaaatagtggtgtgcgaacaaaaattaatttgggaatttttgcattttcaaattaaattttttgtttttcgatttccaaagttttagatttattttaaatttttagttctattaaaattcatttttttactctattttacacttctctttcgaagaaaatcattccacaattatgcagacagtagagatttcttaaaacggatttgtgtggataaaaaaaccaaaaattaaaaaaggggtttgccaaatttggtgacaggctaatactttttcgcaaacctatcagggatatgtgccgacccaattcaaaaaattcaggcaatcggaaatcggcattccgacacatccctgatacctattattttttgtttgtttttaatggcaaattatttaaacataaaatttattggggcctctaaaaatgggtgaacaaaggaaaacatacatacataagtcaatttttcatcatctttttctatccccggcggggagggcacacaaaagattttttgggacaaaaaaatgatgaattaggggtgccgccggcagtaaatacgaagccaactcgccaggggggtgacacagaaggatttaggcaaaatgatgttgtcacgcgagtaaatattagcagaagggattttctagcggcagaagcaggcagcatgaaagcaaaatttaaatggcggggggggacagtaagaatgccgaatataattttaatttcgagatgaaa

SEQ ID NO: 35804 - DNA, 1082 bp, Heterodera glycines
ttgtgtataaatggtcaatttctctgttcactttctctattattttacattaattaacaaaataattttatcaacataaagcaaaaaatacatttatttttaaattaaaaaatattttagaaaatttttaatatttttaattattttttaccaatttcaaatgaatggaatttagcggtggaaaacaaaagaaagacgacagcgaactcagaacaaatgacaaacgacatcatttatcaacgaaaaaggcaaatttaatattaatttaaaaaataaaaatattaaaaaaattacattgtcagagtattgatgaaatttaaaaaagagatttagcagagagataatgtttattcgtagatctattgattataattgtgcaattagtcttcgaagacaaatttatggacataatatgaaaaacgaaaaatcaattaatattttataaaaaaaacaattcatcattgatgagtctactgaaattttttgatgattttcccggtttttggcaaaatttaaaaaaggccttacaacgtcaaaatggtaattctatgcagatttgtgaagaattttgatttttgactttttgtttgaattcgggtgcgaaattcaaaattggctaaaatgaatgtcagatttgtggtcagcgaccccaaaaacctccgacaatagtcaaagttatttttatgccttttatcggaatttttaaagaaaaaaaatgtcgggtccactaaactgtaaaagcgccaattgaatctaattaaaagattaaaataattattaatttattaaaagcatttttttttgtacatttacaatcaaaattgttagcatttgcgaatttgttgttttttctggtgttatacaaagaaaaaagaaacgagagatagtactaggcttttctgtgcacagtggagttgacccattgtgcacttttgttacttcggctcaccacgaacagcagaacaatcacatccctaattttgcacgatatgtacataaaaattgaaaaatttttaaattaaatttaaaatggcgtttgttttcaacgaacaaaatgattaggtaattagaatatttgccca

SEQ ID NO: 35805 - DNA, 1736 bp, Heterodera glycines
  misc_feature (77)..(77): n is a, c, g, or t
tgagcaacaaaacatacattgatgggcaagtgagacaaaaaattcagtctgatttgggcaaaaccactttttttttntgaggcactctttcttcaaaaaacttttgtcataaatctgattcaaattggcgcttttgaaccaaattaagtaattttttaagaaattaaggtacttggtaaaattccaatctttgggtaaaatttaaaaaattctagattaaatttaaccaatgccaaaaatttcaaaatttattagtaatttcaataaatcagaaccaaactgtgtcactaccctccaaaatcagagcatttcttacagataagaacagatagaacccctgatataattaattacatttttatatcattatttttgtaaaaataaaatcatttaataatttatttaataatttgtcttactataaaatttccaattgacaaatttttttttattattttcgatgattggcgtcattttcggctccatgctgttcggctatttgtcagactcatacggacgtcgcaaaatcatgttgattgcgctgattttgtgcattttgtcgatggttgccacttcgttcaccttcgatttgctttcatttaccattgtccgattttttgtcaattttttcaacgctggaactatggtaaacccaaaaaaaaagaattttttctggagaaatcatgcaaatttcccatttttcaaggtcaccttggtcgtttttacatcggaacattacccaaaaaagcatcgcttctgcttggccaacttgatcacttggtaggagaaattttttaagaaattttatgacaaaatgtctctggatggattgtccattttattcaatcagacaattgatcatttgtctatggttatggttactaatttctataattcaacattcaacacaacaaagtgttaactgatcaattagtccagtaatgtgagcaattgggtacccgtcaggccgcgatagtccgaaaaaattttttatgatcaaaaatatggtaaaattgggtcggtgccgtttgttgccgccaggaaaatcttttattggaaattttaacgcactttttatgaaaaatgcttacaattttaaaaaaaaatttgcccagtttttcttaaaaatttgttacgtgcctggttggttggtacccatggcaaatgtcaatttgatcaattgtccgtgtccatccaatacagacaaatgggcaaaaccaattgatgaattcatcaaatttgcacacaggtcacccaattttgtgctgttcgccatcatggcttactttgcgcacgactggcgcacattgcaacgcgtttccgccgcttttgccaccccatgcgtgccaattctgtacttcctcagcgagtcgccccgcttcttggtccaatgccgacggatggccgaggcaaaggcggccattctccgaatgcatcgcattgacggtaaacaaaaaaattggcggaaaatgcaaaaatagagtacggtacccgaatactgtaattttttttttttttgaaattccctttctgtacacaccaagcgcagtatacaaaagaagaaatttttggcactttttgattttgtgtccaaaatttgccatttatgccagggacggtcccaggattttggcttggggggggcacctcccccgggcgacgaccttttttttttttttgcttttcacacccgttgtttatgtggcgcggtttttccaaaaaaaaatttttggggg

SEQ ID NO: 35806 - DNA, 994 bp, Heterodera glycines
  misc_feature (5)..(5): n is a, c, g, or t
tttcnggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagtctgtacctaattctgcggtggattttgctcccataattgttgagtaccccaacgacacttgaaaaatcgatttttttgttttcggggcagtcccc

SEQ ID NO: 35807 - DNA, 1687 bp, Heterodera glycines
  misc_feature (27)..(27): n is a, c, g, or t
tcagtatcaaacgcaattcgatgacgncactgaagcgactgtcgtgggtggcggagaacggaggcgacgagtatctgatgaattttgtggtgaacgagcagaaaaaaggtggggaaaggcacaaaaaaaagaaacgcgcgacatttgaggacgaactcacatttcatttggagaaatggtgccaaaaccgccggagggagtggcggaaaaagagcgaattggcacgaacgaagagaggggggaaacggaatcaacggacaatggaaataacggacaaatgcatctgaatgcatttaaagggcagagaaaagtgatcggagaaggggcgggtggaagtgatcagctggacattccgacattgagcgaaagaacggacgaattgagagaagagaagcagacggaagcggagagtcagacgacagaagagagacagacgcgtgcagagaaacatacaaaagtgccatttgaggaagagggaaagacacaaccgaaaacagcggaagaagcaaagtcgagaactgatcaaagagacacgggagtccaattagtcgacgaaggggcgagaagcagagatttggaaaagcctaaagaaacggcatcgaaagtgtcatccccaatgaaaagaatggccgtgcaagaaaatagttgggaattccataaaaagtttgcggaaagacttgtgaataaaacggcaaaagatgaggaggaaatgggcacagatgaaaagagaaaggaggaggaggaagaagagaaaagaagtgagagggaggaggaaaaggaggaagagagtgtaacaacggaagagagccaacagagagagaggagggagagacaatcgaatttaaacacaacgccagcatttggggaagtgtttaaggggagaaacgatcaacaacaattggaagaggaagaagagaaagagggagaggaggaagaaggagtatgggaagacaaacagaaagagaaatgggtgggacggagagacgaggagtcagagccgaaatgcgaggaaaggccaaaagagggacacatggcacaaatgccggcggagattgaagtggaggaggagaaccccgccgaaatgttcgattctccaccgctcgacgaaatgacaacggacgaatcgagcagttcggcgggcgaagaaacgccgattgtggtgagacgagaacggatatgagaaggggggggcatttgtttgtgagcatactgtaactgactagtcattccaaatttgcccaagttcgaagagtctctcctcggaatgccacggaatgtcaaaggcattctccgacggtctgacacggtccgggaggaaaagaagcgcagagtgatgttcgatctgatcgtcctttttctcgacgtcgcgtacgaaggacagtacgacactctcgtggaattggccgcaaaggtcggccaaaaagcgaagaaagccaaagccaacggagggcattttcacagattgaggacatttcgattgcaaacagcgaagggacgacggcacttcattacgcaatctgtgccggcaacttcgacattgtgaagtttctgatcgaaaatggggccgatgtcaatgctttggtcggtgttcgcctgcttttttgccctttccgtcgcaatgttttgctttttaggacgttgacggatggtccccgttgcattgcggtgcctttttcaattaaacatt

SEQ ID NO: 35808 - DNA, 1064 bp, Heterodera glycines
  misc_feature (908)..(908): n is a, c, g, or t
atttttcgcaccgtgaatgttatttttattgaattctgaaccggtttgagtagattagactagaaaaaattgaaaattttgaaatcatgtttcccactcccttctcccaggggtattattttgtagtctttttttccccaataaacttttcaaaccccatttttcgcaccgtgaatgttatttttatcgaattctgaaccgttttgagtagattagactagaaaaaattaaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccagggntattatttttgtaagtctttttttccccataaacttttcataccccatttttcgcaccgtgaatgttatttttattgaattctgaacccgttttgagtagattagactaagaaaaaattgaaaattttgaaatcatgtttcccactcccttctccc

SEQ ID NO: 35809 - DNA, 1301 bp, Heterodera glycines
  misc_feature (30)..(30): n is a, c, g, or t
  misc_feature (37)..(37): n is a, c, g, or t
  misc_feature (93)..(93): n is a, c, g, or t
  misc_feature (105)..(105): n is a, c, g, or t
  misc_feature (174)..(174): n is a, c, g, or t
  misc_feature (183)..(183): n is a, c, g, or t
aaaagtttaggcttatatttaaaaaagttncatcgancctagcgcactaaaatcgataaaatctctccaaatgtgcaggcccttctcccatgntaaaggactacnttaacttgaaaaaatgccaacgcttgttgttttaaaattttcgaaattctgactttttcattaattatntatttttgncaaaattaattcttaaatattttttcagaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttctttgggttttcggggcagtccccctgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggcagtacccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatttaggctgatactttaaaaagttgcatcgaacctagcgcactaaaatcgataaaatctctccaaatgttgcaggccttctccattgtaaaggactaacttaacttgaaaaaatgccaacgcttgttgtttttaaaatttttcgaaattctgactttttcattaattatttattttttgcaaaattaattcttaaatattttttcagaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctat

SEQ ID NO: 35810 - DNA, 1511 bp, Heterodera glycines
agaaaaatggtataatggaagtccggcggtgccattaggcgccgctgcgggaaattttttataattttaatgcattatgttaattgggtactagtgcatttggcacccacaaaaaacaaaaaatttgttttaaagtcgtatgtttccagggttttcttggtaaaaaagttttttgagaattgacttttcgacctagtgttcgaatttgttagttttttttgttgtctgcaggtgtcgtcctccaccaacccttccaccacccctttgtctatcggagtcccttcgtccgctcacttcggaagccttcttaattctgcacaccatcagcgcctctgcagtcctcactcccgaaaggacagagaagggcacggggcaccgactacgagcagcagcacaaacaacagcgaaaggaccacaatgtcacgatgctcttcagttcagtcaagcgggcccgagttcagctcgaatgtgtccgttgaatcagcgatttttgacgacaatgagaagatggagcaggatcagaacgagggaaaagcatcggatgacaaagacagaacgatggttgcaaacggcgaagggatggacacggcaatagtcaaggaggagggggcgacgacgagcaatgggtgagtgggacgggagacaaccaaaccggcggaataagtgcgtttaatttcagcttcaaattggagttgagacaacaacggcagaacgctcacagccaacagcagctgaacgtgccgctccacctgaattccagcgacccctctctcagtgacatggccaagccattggcaaatttgcagcatcagtccgcttttcagacgagccccgccttcccatttccgttcggccagaactcttttattcagccgcccttcaatcgcttcttttgaaggacgaaaatgagcctttttggaatactcacttctatcaattgactaaacgacacccaatttgcttttgcctatttattattctccatttcactttctttgtcaaaatattgcgggcctttcttttgagtctctttttaatttatatttccatttatcaaaagcctcagacactcacgggaacccatttctctttgtaccttctttctccatttgacctcccatttttgccagcaggtcttttcgttgttcagcttttactcatataatcaaatttgtttttatttatttattttctctatttcacttcataggcattccaaaatcttacctttaaggttgctcataacggttttttcacccgtattttttcaaaattagacgaagaacgaacataactgaatataaaactaaaaaacacaatatctttggaattcttaatccagtatgaatccaattttgggaccataatcaaattttgtacttcagttaattataaaattctcataaaatcccaccactctgctcgaaatatgcgtttgcgcttccctcaaatctaaataaatacaaatatgtggcgaaaattcacttttttcatttactattcttctactg

SEQ ID NO: 35811 - DNA, 1026 bp, Heterodera glycines
gagcaggcccaaaataggggaaaataccaagaggttaaaaaatttttgttaagcccccactgggcttcggctggccatacctcgccagagagtggagatagcccctttgtgtgatccatttggaaatgtgcgagcccgcatagcgcattggaattacacaaaatttgtttgtatttgccaccaaacaatccgcttatgacgcgccgaataaaaattcacaaaaatttggcaccggaaaaactgcattttttcatgggccagcataataaagtaaacccaaaatgtaaggaaatttaaattggtcatgagagatgtttagttttttatttgtcccatcctttttctgggaaaaaacttttcgagaaaagctgaaaaattttccacttgcatcagaagcagactcaaattcttcaacacacaatataaaaatattacgcaagaacttatttttacatcctttttagaaatgctacataaatttttattgtaaatagttacaaacaaactttttttcactgccaatttctaccagttgccaaacaaaaaggcgatagttaagcattgagatataaaaaaatcgtctagaataattatctcaacaatttgtcgggaaagctgaataaatttctgttgcaataggcatattggcacaagacataaatgtagagcaggcacaaaatagaggaaataccaaagattaaaaaattcttgtttatgccccactctgctttggctggccatacctcgccagagagtggagatagaccctttgttgatacatttggaaatgtcgaacccgccgagcgcattcgaataacacaaaatttgtttgcatttgccaccaaacaatccgcttatgacgcgccgaatgaaaattcacaaaaatttggcaccggaaaaactgcattttttcatgggccagcataataaagtaaacccaaaatgtaaggaaatttaaattggtcatgagagatgtttagttttatatttgtcccatcctttttctgggaaaaaacttttcgagaa

SEQ ID NO: 35812 - DNA, 992 bp, Heterodera glycines
  misc_feature (941)..(941): n is a, c, g, or t
  misc_feature (943)..(944): n is a, c, g, or t
  misc_feature (969)..(970): n is a, c, g, or t
atatttcaacaaaaatttttaaaaattgactagagcaatcgaacgctaacggacgacctaatgggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattattanannaattttagatttttattcatctccnncttttgatagtgaaagcatctg

SEQ ID NO: 35813 - DNA, 675 bp, Heterodera glycines
aggacgctttttgccacctccttcaaaaagaggaattttttcgatgcgctcgcctacgccaagccctattggttcaatacaaatgagtttgacaaacgcgcacacaccaccggtggtcgcacggcgtcggcaacacttaatgctggaggctcgcaggcaattggtaagaaactgcaaacggaacggaccccaatacaaatgtatcattggtgtacagaaatcacccccggcggtcgcccatcaacgccgtcatttaatgtcggagacccgcatgaaattggtgaggaaatgtacattagacgggcccaaatataaatgcttcatttgtgtacagaaattgcgacgcaatccctttcgggtgtgccgcggtctgagcgcacggtgcgcgttttgttgaggaaaggaggcatacgaggaagcgcacagtactgaggagcgattgatcagaagaaatgatgttagaatattgattgtgaggaacaattagtaaaaattttggtttttaaaaatttaaaaaatcgacagggcagaacttattaatctaatatcgcacaatgtcaataaaatagagatggcatatataattcatttaattttctgtttgcccgtcaaatccaataaatagatcatactattaagcgacacactcattctctgtaacaccatcctttttgt

SEQ ID NO: 35814 - DNA, 973 bp, Heterodera glycines
tgatgaaacggaaggacgggaaatgcgaatgaaagacaaatggaatttgtcagaatgccaaaaaaagttgggagagacttcggcagcgaattgttcggtttgccacaaccttcgaacggcggacaaagcccaatggaaatgtttttcaatttgtttggacgaaaaaaaagggaaacggtgcaggaaggaagaaagaaacggagcatcgaaaatttagccaatttggggaagccgggctcagagtttgtgacaaaaatggccgaacaagcaaaaaacgatgacaaacaggacgagaaggcggagatcaagcagtacctggagaagggagtggccactgcggaaggaaacaaaaaggcggagaaattggcctatgtttggtactcggaactgctgtattggacaaacaaatggatcgaggtggacactcccgccgaaccccaaaaatttagcacctttttaaggcattagaaaatcgggtgatgggagtcaaacccgaactggcacaacagttcgtattctcaaaaacgggaatggccgcttacagggagctgaaggaagaggtggacaaatgcgaggcgaagttggccaaactgaaggaatggatcggcgactatttcaagtgaaaatggagatgaccaaccatcccatccacacagccgattcagcaccacccattccattttagttgtatttcggggtttagttgtttttcattttcttttcctgtatatcaatgcatttattctttttattccatttatcatttttatattgtagtgatttttgtacataaatttgactgtcgcaaacatctatttacatataacgaatcatatgttcaatgggacgttaacagcttgggagacagaaatagaaaactttttaattcagtgacggtttttgaaacgggtcaatggcaactcacacaataattttttttttaaaagtctaaagcttaggccaagccaaaaac

SEQ ID NO: 35815 - DNA, 975 bp, Heterodera glycines
tctgctcacactcaaatgaactccaaccacattttcggaataatagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggattttctttctgggcgagtttggctctgaaaattttgaaaaaacgtctctctttttctgctcaacactcaaatgaactccaaccacattttcggaataatagcgacgaccctaatttttctggattttctttctgggcgagtttgtttctgaaaattttgaaaaaacgtctatctctttttctgctcaacactcaaatgaactccaaccacattttcggaataatagcgacgaccctaatttttctggattttctttctgggcgagtttggctctgaaaattttgaaaaaacgtctctctttttctgctcaacactcaaatgaactccaaccacattttcggaataatagcgacgaccctaatttttctggattttctttctgggcgagtttgtttctgaaaattttgaaaaaacgtctatctctttttctgctcaacactcaaatgaactccaaccacattttcggaataatagcgacgaccctaatttttctggattttctttctgggcgagtttggctctgaaaattttgaaaaaacgtctatctctttttctgcgtcacactcaaatgaactccaaccacattttcggaatatagcgacgaccctatttttctggatttcttttctggcgagttggctctgaaaatttgaaaaa

SEQ ID NO: 35816 - DNA, 1159 bp, Heterodera glycines
  misc_feature (6)..(6): n is a, c, g, or t
tgtatnttgccaataaaataaaagctgcaggaaaatattacatatgtaatccgatcgatcataattaattaaattaaaaaataataataaattaatttttctcaaatgttttgaatgttcccttcctctttctgctgcttaatgcttttcccaatatctttttttccattttccgttaccgtatctctttcttctcttcactctttttccgattggctgctcatcgtccgtcattcagtcatcagtccgccgttgacactgtgcaaattaatccgctcgccaaatgatgcgcaaattgtgggatttttgtgacgggggggggggagaaatacgcccaaatgacactgttcaaacattggacggacaaaaagccaatgaatggctttgcttatgcttttccgatgtgtttactgcttgtctgggcggacggcttacaagcttaccacgggataatcatcaaatcagtggattaattgggaaattcacaatattaaatgaatcttataatttattttcattaaaaaattattaatattttttgtatctttaaatcgttaaaagctttttatccgctagaagtttataaaaatatattataattttaaaaaatatttgtacaaatttctgttgagatttccaatccgctggattaccgtaataaattctgatatctttaaaaaaaaattcccttttagtgcttttacataactttttagcaattttcgatataagccaacatcatttttgtttgtttcgaaattaaaacattcattcactcttttttgattgattttctttgctttccccccccccaaattttccccctttttccccgttcagttagcccttatatttttcaaattgatttatgcgttggaaagtgcggatgtgatgatatccgacaaaatccgattgacaaccattgccttttccatgcgcaaattgcgcgccattcattcgcttattcgttcgttttatttatttattttccaatgcgcggccaacacaaaaaaacataaaataaaattttgttttttttaaattaattcgttaaaagccattggacccgccttttcctctcccctctcttaagaagcttcactttaaaaggttaactcttttttatagttgaagcatttgagagcatttggcgccagta

SEQ ID NO: 35817 - DNA, 1150 bp, Heterodera glycines
  misc_feature (1115)..(1115): n is a, c, g, or t
atcaaagccatctgtcgctaaattagaatgattatttttatatttgggttaaaccaagtaaataatgggaaaatttagtgaacttcaagtacgcacttcacattttaaattttattaataacctccagttttatattttaaataatccctttttcatttaggttatttctgtggcaattttttttaattaaatttgcttaccctcgggttcattttgagaagtcgaagcagttggattggctgattgaaattgtaagtgaccaggggcagtgattttgcagtggaaataaataccattgtggtgaaaagcagcagaattgaagagttagaaaaggtggaagacattttcttaataaaatcatattttaagcgtttataatttaaaaatattataaatttgaaaatgaaaaaggagggcattttcaaaaatatttcatttgataaatggataataatggttaaatgaagtcatttaaatggtaatttaattagagtaagacgtgtgttatttctgtaataatttccattttcgtttaatgccacaatgacacctccgggaaaaaaatattttcaaatggcacacgcaataatcaatccaaaaaatcactaataatttaaatttgtacctatttaatgaaaatctttaaggcaatattatttgtaaaattttattaattaaatttttttaaaagttttatattgaaatttttttcaacatctgtatttctttattgtttaacttttattttgtgccaaaaattgactgtgattttttttattgttaattttctgccgaaaaatacctaagaaaaactaaaaacgcgtaattctttttttataaatttcaaaaatcatttaagtgaaagtgtcatatttgtttttgcactactctttttaaaataatcaaaataggacggaaatttatttgtttttattttcagcatttgtatcttaacgaatgaatggggcaattagcaaatgccattcaacaagtgcgcacatttaaatgaactagaaaaaagtaatggcgtaagaaaggaagctgcaaaagaaagagcaaattgttatttgaaaatgataattttttattattattcaattatttaaaaaacaanaaaatatttatttattcataaaaattattttatta

SEQ ID NO: 35818 - DNA, 385 bp, Heterodera glycines
ttttttgcttatttttgacataatttattaatttttaagaaaatttaaatttattcaatattctcgagaaattttggcgaaaaaatgattttttgaaaattttttcgggttttgggctcaaaaaggctaatttagctgctgggggccgttctaatagaggtttttttgaaaaatgccaaaatatggacataaaatatggacaaaatgccaaaatatggaaatatggacataaatcgcgaaatatggaaaaatatggaaaatatggatatagaaatccttcctagaagcttcaaaccaagctaaaaacatgtttttcgtgcgtttcaggcctccaataatccaggaaaaaaatatggatttccatataattacacgccctagttat

SEQ ID NO: 35819 - DNA, 1007 bp, Heterodera glycines
agctgctctttccatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaatagggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccagacttaaactgggagaagcaggggctgtggctgggggctaaatttgggcacattggagaattaatctgatttctgaaaa

SEQ ID NO: 35820 - DNA, 339 bp, Heterodera glycines
agaaaaataaggggaaaaatggcatattccttcctgtggtagaaaattctcaaatttttttcattaattttctttgatatcacccatttagaagcccttttaaaacaaaattaaaagtattgtcctggtttggcggtgccgaaaggcaaataaattataatttttgacgtaaaatttcattctttttgaatttttagggttcattttgggaatgatttgtgaagaggtcccgactatgtaaattgacgaccttttttaatttttaaaacagcttttttcgcggcgtgctttttccataaaactgggaaacatgggggggggggtcaggcggcgccgaaa

SEQ ID NO: 35821 - DNA, 1135 bp, Heterodera glycines
tttttgagcgatattttgagcgaaaagtggggtaagaagtcagcatttttcaacatcagcgggctaacattcatagtatgtttatctgttagtctttttcttcttttgacatgcttcattttgcaacataaaccaatgggggaagaccaccctgctctccatatataccaatgggggaagaccaccctgctctccatatatattcgttttcaggcgcaacaattccggactctcggggtgcatgtcgattagtaggtagccaaattgcttttcagttgcatcccggtatgcttccgtgaaatagttgcttttcgttggaaatagctgagaggcgagcgtccgcacttggagcgcgcccgccgggttacgcatcagcaccaaatagtgggagttgttgcgcgcaacccgcagttcttttgcgaacaaatgttgagtgactaacacaacgctgaccccccaattgtgcgatccccgggtgaacacagtgtcaagaaattgttggcccaatccaaccatgagatcatccaacaccatcaacagttttccatcacactcttttgcgcgccgattaacctgctcttcggttgggcttccagcatgtacaataaccctacacccgccgatgtgtccacttttctgaagctgtattatatttggattcaactccccataacagtagaaaatctccgagatgggttccgaaactagcgcattcacattcctcagcattcgtagcacccattccgattttccactccccgtgctccctgagattgtcagcgtaaacgggtgtctgagttgtaagtgtttttcatcaaatttttgaaaattgtctgccatttttttttttttgcaaaacggtttatcttatattatccatgtttaaaaaatattatatatacacaataaagctttaaagaaataataataatctcttaactattaaacaaatggacgcgattcttgcgaccgattggctccacaatgcgtacccggaacaaaagatgacaacaggaaatgaagaagaagataaagcaacacaggtattttttttatgaaaaaagtttataaataaaactatattagtaattaaataaaataaaatttcaggaaggacaaatgagtggcttaaaat

SEQ ID NO: 35822 - DNA, 898 bp, Heterodera glycines
aaatagttaaaaatcactattttggcgttttgtcactattttttcactatttcaacattttttggaaaattccttaacaaaaacgcaataaaaccaaaaaatacacccctaagaatcgacctaaaattttttttcaaaaaatacacccctaagaatcgacataaaaattttcagaaatcactcctaagaaatgaaaaatttttcacaaaattcactttctttgcaaaaatttttaattctaaaaattattttttaggaacctattttgtattttttgccctcaaaaatcccagtcctactcatttgcaactgcaaatagtgaataaaaattatttttgctcaatttttggctgaaaatttgtcactattcgtcactatttcggactttttggcactattttctcactattttggcatttttactcactattttagttaactattttgggatttttcgtcactaaaagtcgcatccctactaattagcgtcagccctgtgccggctctgcttcattctcttcctcctctgctgccgctgatccgcgccattcgtcggctgcacattttggcaccgcctctctgcaacacacttcttcccaaggtaattaagccgcctgacaaattgaatcgatttaaattggtaaaaaagatggcttttttattatcatcattaagctagaagaattgagcctgattataaagcaaacaccgagaaacttagtttgggaaatcaaaactacagcaaaaaattccgaaactcgaaaataaccctaaaatttctaatcagcctgggtcgaatatattgatttttcgcatttgaattcatcgaatcattttataatttcaaaaaattcaattacattaggacgataatcaccggtttttacaccccctacta

SEQ ID NO: 35823 - DNA, 666 bp, Heterodera glycines
agtaaaaaatttgcctttccctcatcatttgtcaccaattttatattctccgacccaaacatttattcatttatattaccaattggtggtaggcccacccagcaactgctaatgcttccatgcgtcctttttttacgagacgcatcgcttcgttcaagttggtgcagaaatcttccatcagttgtaaaacgtgcgatggtggtggcggctggtaaatggtggctttttatacatatttggtacatattttagatttttttagcatttctccctacattaaaaaatttttgtaaaaaatttaattttttgaaaatgtacctctaaaaatttaaaaaagtgataccaaaaactcgtttttataaattaaaaaacggcatgttgttgttctctgttaaaatatagaaaaatttgcttaaaaagttgttgccaaagtcgaccctcgggaacggtcccagcgagggggggggggttggggtggggagcagggatggcattccgaggcccccaaaaattctgaactccggggatcaaaaaggaactccgagggtcaaaaaattttaggaaatcggaattacgaggcccaaaaattctattgcaatttttaagattttatccaaaaaatgaccaaatttagatatcttgaccaaatatttcaagataattata

SEQ ID NO: 35824 - DNA, 1429 bp, Heterodera glycines
ataaaaaatatgtgccaaaaaatcattaaaatgctcaaaattcagagaatttttacctcatcgaggggctgctattatttatatatgttgaaaatttctttttgaattgtaattttttgaatatataaaaataaaatagcatttgtgaagttttttttttgttgcattatttaggacattattaaaaataaattatttttattttattttaaaataattcttattttatttattcatacaattaattttcaaaatacgtcatttatatggttgattaatttttgcatgagcttaatgttctagataaggaatctgccttattttaggtgagataaaatttctaatttaacgcctcaccaaaaattgtttaattgacatcattttcaacttcgtataattcgttgattcagtccatttggtttttaattgggtccaaaatattttatacccaattaattacgtaaatgttagaaatttatttaaaactattttttcaccattttaattaatagaatctattttttacatataatacaaatattttactataaatattcaaataattgaatgcaatattcataaatattttatttaaataattaatttcactaattttttttaatttttcatctaccgataactatttatgacagataatataaaatattttctcgataaatattcaaatattttaaagaattttgtttaaattttgtatttcacacaaaaaaatgaatgaatttaatttaatttaaatgtttttttattgaactaaaaatatataatgcaaattagtccaatgtaataattaaattaaattaatatgctaaacaatgggtgggagatgacattcagcataaatatgcttccgtatcaattttttttctgaattaaatgatataatgagtcggcggaagatggtcgtgtcctccaactgtttgtgccatttctttttaataaatttttattaatgccaactaaatgccaatgccaaaaaagctaaacattttttgtttgttataaattcaaactactttttaaaatattaataattatttatttatttttaaatttatagaataattgaaatccaaccaaaaaaaacagcaatttcaattaaatatatatgagtcaatgaagaaaattttgcaaaaatggcactgtttataggcggtgccgtaaaaattgaggattttatccagaaatgatgacaattttttgaatttttttttattggaattgccttcagccatcctgctgttacatggagtttaaaaaaaataaaacaaataagaattagtctcagatcaccattgaattagtaaggcacagaaaaaattttctcagattttgaccgcccttaaattcgaaattttcttaaatttgaattttaaatttttttacggtaactatctcagccacccaaata

SEQ ID NO: 35825 - DNA, 775 bp, Heterodera glycines
aaaaattaaataaataaaaaacaaaaatattaataatattgtgtgtttgctttaaatataatattatttatataaattattattaatttaaattcgtaattcaataaaattattatttttatatagattaatacttttataattatttttttgcttttaaaaaaaagaagaaataattcttttcactttgaaaagctctttgccccactgtgcaccggtcgcctttccatcgtgtttatgatcaccgccatttgagctccgtgttcgatttccggcatcattctatcaaaaattagcactttcgattgtattttaaggtaatttttttctattttttaaaaattaatttgactttttaaagtataagatttctgggaaaaatctaaaaaaagggctaaaaaaagggctaaaaatttactactctaatgaatgcccccctttcattaggatcaaaaagtcataagcataacgctattatttcataaattaaaacttttcccctcattttagacttttctcctccctgacaaaaaaaaataaaaacgaaaaataaatacctatgaagcaaaaaaaaaaaatttctaagctatgaaattgtaggacaaaacttattaaattttttaattttatgcttccataaattttagaccagcatttttgtgtctagagatttccggattttaatattaatttttttcgtttttcagggcctaataaaatgtgacaaattttatctgagaattcggaccccgaaaaattggtctcgcagcacgcg

SEQ ID NO: 35826 - DNA, 999 bp, Heterodera glycines
  misc_feature (912)..(912): n is a, c, g, or t
agaaaatccgacaccactggaaaacccgacactagcggtaaattcgacactggaaaacccgacacgacaccaactttaaatttaaaaaatattttttgattattgagttaataatatctggctatgtttatcaagttttcgaattgaatttaaaaaaaaacggttgcgccattcgatgggatattgctggcaaataataaaagggttgtcgattgttgcgagtcgcataaatctctgagattcatgtcttgcaccacgtacactttcttatgcttcatgccctttcctctgattcgatttgccgcattttttacaatttttttgagatgatcaaaaaagggcattgaaataaatataattattatatgcctaccttaaatagattttatagcaataaaatatttattttaaagaaatagtttttatagcaataaaaatattaattttaaagaacttaactttgtaacttttattacatgtattttaaatattcactgactcaaacaatcaaaaattatttttaaaatttaaagttggtgtcgggttttccaatgtcggatttactgcttgtgtcggattttccaccggtgtcggattttccgcttgtgtcggattttccagtgtcggattttccggtgtcggattttccagtgtcggattttccggctcccttcctcccccccccccaaatgagtttgatttatcgcaaatgttcattttcctccagcggcggggctacagcttccccccccccctgcggcgtttttgcattcttttggccagagggctgggaaaaataaaaatttaaaaacaaattttattttagagagacgtttttatattaatttaaaccaaaaaatttatctttttaattgaagaaagttttatgttttatagtttaaaattccgacntgaaaatttaaaaaaaaaatcattctgaatccgaacttaaaacttgaaaaatgaatttgacttgctaaattattctcatttctattg

SEQ ID NO: 35827 - DNA, 1134 bp, Heterodera glycines
ttatataaaaaacgtttaataaaaattttaaaatcaattttcttagtgacccctgtacttttgttacaatttttggcgctatattcaaatttgaattttcgcgtcaatactcggtgggtggagggacgcttgctgggggtatgggggggggggttggaaagttcttttcctaatttgaggtccccaactcaaaaaagttaaccgaaaacgacgagaaaatgcgattgtaggaattttttttcattgcctttttcatattcattttccgtcgttttaattcgattcaaaccgtttgtgagcggaagggacttcaaattaattttatatcaaataaaattaattgtagcgagaaaaaattggaagaagcgcctaaattggcgcaaataaagaatgatcacattcgccacccgagatttcgccatccaagccaaaatttccttgaaaaattttttggaattgggataggtacacaaataaactttttttaaatattttttttttcttgaaaaatgaatattttcgaatttttgttcgaatccgggtttgcgattcgaattggatgtcagaatcgagttttccaatcctgaaaaaccctaaaatcattggtaatttgattaaaaaaaccaatactacatatatattaccggtcatttgtataaaagcggctgctcctccgccacttttcttattattattcattccccattattttcgtctctttcttcgactttctctcttctggcaatgtcttccaaaatgattctgtacgttttgcgcattccttctctattttgcccctatccttctcatttttttagtctgtacggtgtgccaatgttggttggatgttgcgccattctttggatgttttgggaccgattcaaaaaaccaaaaaagaaaatgtaaaaataatgaaaaatcttaaaaaattgaaaatttaattttcagtttcatttctgccgacgcttggctttccgtgttcgaattgcttaagcgttctcaactgggccttggaatcgcacttgtcagccaccgttttgatgccatggtcgacgaacatttcaagacgcggcgctgggcgctgaaatcctttgaaatttggtgcgacgatggcgaggatggcacgacgaaaat

SEQ ID NO: 35828 - DNA, 634 bp, Heterodera glycines
cgcccgtcctaaggccacgaagctgccgaaaattccgaacaatccacaatatttagaagcgcaaagcgcccgtctgaggccgcgaagcggccgaatgtacaaaagggcgcggagcaccctttgaggccgcgaagcggccgaaagtcctccacaaaattatgaatgcgtcctcgcgatgcctgtagaccaaaatcccttatcacatccataaattcatttcaaaatcgcgcatgcactagcaacgaagtcctttgcgcgaagcgctcatgtaatgcatattcttttcagctctcacaagccaactgtctacaccgagcaactactgcgccacaacacgctagtttatattaccatagagaaaagtcgggtttcgtcttaaaaactaatttgagtcgaacggctgtcgggaggggtctgaaagtggtggaagggtcttacaactttttgaggcgcattcaggaaaactataggttttccgctccggtggccagttgagcgccggcggcgctgaaacggcgtgaaattttttttgtccgtctttggtggcctgtaactttgcgggaagaagcgggagcggaaaatgcttgctggtagaatgttaagttggaatgtttgggaaaacttggcgcttatt

SEQ ID NO: 35829 - DNA, 1178 bp, Heterodera glycines
tttttttaataaattttatccccatacaaatgcttctcgaagcatgataggggagggcgggtgcgcaatagaccttttttttttgagggaatttttaaatttatactctatcccagaaaaaatgtctatctctttttttgagaaattttatacctcacaaaagcgcttgcgtatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttaaatttatactctatcccagaaaaatggctatctctttttttgagaaattttatacctcacaaaagcgctcgcgtatgagacggagggcggtgcgcaatcgccattttatttcagagggaatttttatatttagaggctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagagtatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgataggggaggggcggtgcgcaatagaccttttatctttgaggggttttttaaatttatactctatcccagaaaaatggctatctctttttttgagaaatttatacctcacaaaagcgc

SEQ ID NO: 35830 - DNA, 1206 bp, Heterodera glycines
tttagagttttaccatgtcctttatctcacgttctcccacacttcgcttccttctcaaaaagcattagcatgattatgcatcgtgaatattttaattcatgtttcattgaatatttgaatggaatggaaaaaagatttaaatttaaaatcttttttctcccttttttatcaaaaagacctgttaaaatattttattttatcaaaaaataatttaaaaaaataaaaatataataaaattaactcggttttaaatttttcattctttataaattcaatacattaataagtttaattaattaagatgatgagaattttatagtcgatttgtgcaatttagaggttttgcgcgtagaaaggattcaagattgagtgagcttaagctttaagaacatgaacgaacagaatgcaaaaaatttggaaatccctaaaaaggccctaaaaacccgtcttgggcttggagaaagggcactccttcacactttagcgcttctaataagctattaatcatgttcctagcttaaatttatattgagttatgctccggagtggttcaaaaatttcaaaaaatatttgccttcacaattaggggggatacgcagggattctgaggggttgttgagtaattataaagaattttttacactggaaatacttaaaatatgttgttattacgccctgcgttcattttggcattacttgtcaaatactgaccaagatacttgatgtaaaatcgtatccagaatccgaaaaaaaattttttagaaagaataaaaataatacatcagaaattcataaaacaatgtaaaacgatgtttgacgtttaaattactgatataactttaatactcaccaagatactacatgtgtatgtgaaacagtcaacttttgaataactcaggaacaactaatgaacgacttctggacaactcctatacaactcctgcactcttcttgctcaaattaaaaaatttataaataatttgggtggatacgaagggaaaagggaattttattgtaataaattaaaaaaaaattttacattggaaatactttaaataaggtattattaagccctatgttcattgcgacattacatgtccattactgaccaagagacttgatgcggaatcgtacccagaattcgaagaaattctgtttttaaaaattatgctgaggaataaaagtaatacaccagaaattcttaaa

SEQ ID NO: 35831 - DNA, 1201 bp, Heterodera glycines
  misc_feature (187)..(187): n is a, c, g, or t
ggggaatccctgcacggcacgggacgcatccgtgtggagcagtacgtcaagcgcttgcgaggtccaatgcgcttcttcctacaaaaagtaatcagtgcatcaatttgtactgtaaataagtgggtgtttgtgctccccccccccccccgatttttaaaattaaatgatcttgattggtcttccaccnccctccccctcctcgggttccgatgcggaacagacaaaacgtcgtcgacgggtcaaagcgtcgccgcaaaaaaagagaaaaatcacataatcttttgtttttttctaggagttcagcaattttcttttcagtagcagataggtttcagaaaaactctttaaaacaaaagaaatttaaaaaaaaatttaaatttttcttgaaaatttgaagtttattttttttttgcggcgacattttgtccaggtccaggcgatttgggcggtgatgtttgggagtacatcgattccgacgacccaccggtcaacaaatcggctacaacagcgcgtcgcccggcggcaatttgggcacgtgcgcgtgacgcgtcgcgaatcgctgcacaccgttgttggctgcgagcaaacattcgccacactcgctcgtcacggagcagttcggcggagtcattgttactgctgttgcctcttgtgttgttggcgtctcgttctaatgccacaaaatacctgaataattaaaaacatacttcaacttttaaaagggttttggacaagcgaccaaaaaagtttcaacttttaaaagggttttttggacaagcgaccctctgtataattcgaattctgaaacgaaaaaagcccgctttacgtgccagtttgggtgatgatgttggttcagtgccgccggctgttccgttataatttgtttgtgttgattgttcaccaccggcgccgttattgacggtgtcacagccgctgccgtagctgtcggtgccatggccaatgccgtttctgcttctgatgacaacgggacagacgcaccattgacgctcgacggtgatgactggcattgttgcagttgttccgacagtccgccccctccgttggccacaaccacgcgccggaagtccaccaaatggttgaactgctccaacagctgtctgtacgcgttggtagtgaacatacggcgctcgcgttcctttgcgcacgcgcgcctcaacagctcgttctcgtgacgcatctg

SEQ ID NO: 35832 - DNA, 578 bp, Heterodera glycines
cgccgggggattggacaggagcggatattgttgagtcttttgtcccctccgttttcaccatgttcttcagtttcagcttatgtcgaattgggtttcaccagcaatcggggaccccctactgtttcattgtcttccaattcatttactctctccgttttgctaaatctctcccccactattccattgtctgtcaatttggcaaatctctctcccctgtcactgtttctctgtcattctctttaatcgctggccgcacactctttttcagtcaaaatatctttctttttttttctatgtctccaaatgtttcagtcgccactgatcaatgtcacgcactgatcagaatgaaattcgaatcgcaatgatacaaaataaaaagaaaatttatgccgctgctaaaaaattttaattttacatgcaacataattctcggatttttaataatttttatattttttatttatgatgcaaacaaataaaataattggcataaaaacaatgatgtattgtataaaacttgcaagcaataaaatccaagagcgtaggcagcgggcagcgggggggggggggatgtaccc

SEQ ID NO: 35833 - DNA, 1220 bp, Heterodera glycines
  misc_feature (45)..(45): n is a, c, g, or t
  misc_feature (106)..(106): n is a, c, g, or t
gagagattttatcgattttagtgcgctaggttcgatgaaactttntaaaatataagcctaaactttttggcctgtttaaaaaggaattaaaaatttttaaaatatntattcatctcccttttgatagaaaaagcatcagagagccttaattaacctgtaaataaagttttgtgtgtttcagagcactttctgaaaaaatacttatgaattaattttgcaaaaaataaataattaatgaaaaagtcagaatttcgaaaaattttaaaagcaacaagcgttggcattttttcaagttaagttagtcctttacaatggagaaggcctgcaacatttggagagattttatcgattttagtgcgctaggttcgatgaaactttttaaaatataagcctaaatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtattaaaaatttttagattttttattcatctccctttttgatattgaaagcatctgagtgcctaaaataacttgtaaataaaatttgatgcgttttagagcagtttctgaaaaaatatttatgaattaattttgctaaaaaaataaaatagtgaagctttaaaaattaataaaaaattttaaattcagaattactggagttagcatcatagcagttaaaaattttttgatttttattcatctccctttttgatagtgaaagcatctgagtgcctaaaataacttgcaaataaaatttggtgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaaataaaatttggtgcgtttcagagcagtttctgaaaaaaatatttatgaattaattatgcaaaaaa

SEQ ID NO: 35834 - DNA, 775 bp, Heterodera glycines
tttaaaagaattaaatttaataaaaaatggtatttttctttattatttttgctttgatctatcattgggtcgaaatgttttttttggggcattgaattatcttcaattcgttccatcattactcatccatcagcttcgttcttcaccagcagcagattaatgccataaaatcaacatcgtcactaaacattttaattaaaataataaatttattttgtttaaaaatttatttttatgtaagaattgttggcatttaatgcaaaaatgatttttcgcctgtcctaattattattttatttttttataattttttttcatttaattcttcaaattctatccttttttgccgaaatattttttagtttttttccccattaccaaaaagcagcaacaaattgctgctgatccaggtgaaggcggaaacagggccaagcttctcggctttgctgctgctgctgttactgtgatgactgtgcgacttgtaaatgctgttcatctgctcctcagactgatcaaggttgatcaactgatcaaagctgttgcacactttgccgtcgaccaactcgtcacaatggcgacagttaaacaaattcccacccgattcccggcagaatgtgtagaacactgtcgggcactttttctcattatctcgtgcgcatccattaacgcggaaaatgtctttaccatttccttaaaataagatgaaaacttaattaattacatttgtttttcagcaccatcctcgaaattattggaaatttaaaatttaaatatt

SEQ ID NO: 35835 - DNA, 1258 bp, Heterodera glycines
agcgactgttgaagtcaccgctgaaaatgaccgtttttcctccgaagaggagatccttgtgctggcgaattgccatctctttgcacactcggtcgatgacctcaatcaccgtgttgtgaagcatggtgatctcatcaatgatgatgagttgggcctcacgaatccgacgggcaaagaagctctccagcggaatgcttgggagtttgtctaatgacacttctctacccagacgaaacgtggaatgggctgttttcccatatggcagcaaaatggctgcacacccagtggatgccgtagcaagcactttgtaggtgtatggggcctttcgcaagcgcctaataatttggccaaacaggaatgtctttcctgtgcctccatcgccgtatatgaagaaacggcgggggacagtcgaatccctagggttcgactgtattgccaacaaaacagcatcaaagaccttctgttggtcgctgttaagtggcggaggggtatttggctgtggacgaggatttggttgccctggaggcaaattcaaatcatcatcgccaaagaaaaactcttcaattgccgcgtcagtatttttggcaattgaagttggcgggtctggcaggctaaaatgcacacagcttaagttaaagcagctgtgcagccgccaatcaatgtcggctagggcttcaagctctgctactttatgctgtgccagagtaataatgccttgcggattgtacatttggtctttgtacttgttccacaattctatggcattactcggctggccatagaccaggatgctcacaaaaagccatctcatctgatctggccagcgcgacagagctgcctccgccagagttttgtcccaaattttgtcgtcttcaagaagaccatgcattattgcagcctcagtgaatgaggtacaaagcaacccattaaccatcttaagatggtctgggtctccaggaaagtgacgcataagtgaatagagcgcgaacctttccgggtccgatgggggtacaggaacaattcgaccgattggtggtctctttgttaggttatatttccttttgttccatttgtcctttgcccatataaaatgctcagggactttttcaaaaagcatgtccttgagcttcggatcatgcttccattcattttgccattgtttccaataggcagaacattgcgtctctggcagttcgccttgctgaatttgttgagctttgctcaccagatggaaagccctgtacacaatcggttgttg

SEQ ID NO: 35836 - DNA, 843 bp, Heterodera glycines
attgacaaagacttcgtccgcaacttgctggtaagacctttttttcgttcagatagttcttccagtaagtgctttgcaccatattctccagcacgagagtgttcagattcatcgtttgcacattaccccaaaccggcaaaatgttgttcttcttcgttattttctgaaaggcattgtttctttcgtaagtcctaatccaacaacttggatgtcgggaatgctcgtatctgttgcatcgtcctcgtagaagacttcgcttcccgcattaaatcccattacatctttgaacgtactcgcttcttgaatgtccattgagaacgtttatcttatttctaaaccactttaactaatttaaatattctatgcttattattagttttaaggtcataaacacacgactcccgggattttggaatggttaatcagcgatcacgaatcaaaggccgagctcaatcaattccgaacaaggaatgggcgaaaccctcttcatactgattcacgttccttattgaacaaaacattatatttttatgacttttaaatattatttttattttaaaaacaaagccaaaatatttaatttggaattaaattacggactaaaattttttgaaaacaaaacggcccctcctttggttttcggggggccataactttaaaattcgggaaggatttcggaatttggttgagagtgaagtcagaatcgttatccgcaattatgaaaatctctgtaaacgaataaaaaaaatgttgcaaaccaaaaaatgggttaataaaattaatgtttttgggatatttaaatgtaaaagtgccaaaattttgctaatagacgaattgtttcat

SEQ ID NO: 35837 - DNA, 76 bp, Heterodera glycines
ttcctacacgaatgttatgttgattaattatttgttgacctgctgaaaaatgggaatatttcgttggcacataaaa

SEQ ID NO: 35838 - DNA, 1189 bp, Heterodera glycines
  misc_feature (319)..(321): n is a, c, g, or t
  misc_feature (357)..(358): n is a, c, g, or t
  misc_feature (378)..(379): n is a, c, g, or t
  misc_feature (442)..(444): n is a, c, g, or t
  misc_feature (457)..(457): n is a, c, g, or t
  misc_feature (459)..(461): n is a, c, g, or t
  misc_feature (473)..(473): n is a, c, g, or t
ccgcttggtcgagtaaaaagaatatatatttaaattaacctcctcataaaaattaattttgattaaacaaaatattaattactttgactttgaaaatttaatgttgatttagtataatattaattaatttttataatttaattttgatttaccaaactattaattaattattaataattttttgatttacaaaaaattaactaatttatttagcatctgtttcataccaattgcatccaaatatggtaagatctaaagaatatacggtatgttcatcccattttaaggttgaagggctacaataattcttgtccatttnnngcgtacaaaatattcactgaatatgaagacggaaannggtagagaatttcaaaatannaatatatattttaacatttaaatataatattaataaaatagaaaattttcattttacaaattnnnaaaatcttccttnannntgactgataccngacagcatgattatgccacttttgtccaactgaaatggttaaaaataaatgcaatcagaaaaagtttggcattacttgttagaaaacctttgaaaaaaactcctgtgattttacacttatttttaaaaaccggttttttgtaatccaaaccaaaaaatttcttttgaattttttccgaaaaggggcggggaaaaaaataaaaaattctggattttttatcgggttttttttaaacgcgggtttcccccgaaaaaacaaaaaaaaccagcccccccccccgggggccctaaaaaaaataaaaattttgggccttttggaaaaaaaaataaaaaaaatttttttttttttttttttgagaaaatttttaaaaaaaaaatatttcccggggaaaaaaaataaaaaaaaaaaaaaaaaaacattttttgtggtgaaaaaaaaaaaaatcttttttttttttttttaggggggggggggaaaaaaaaaattttttataaaaaaaaacggggggggggggggggggggggggttttttttttttttttttttttttttttttttttttttttggggaaagaaaaaaaaaaaaaaaaaacagggggggggggggggggggtttttttgttttaaaaaaaaaaaaaaatactttaacccgggcggggggggggggaagggggggggggaatttttttttttttttttttttttttttttttttt

SEQ ID NO: 35839 - DNA, 1062 bp, Heterodera glycines
  misc_feature (984)..(984): n is a, c, g, or t
  misc_feature (1039)..(1039): n is a, c, g, or t
tattaaacttaatttgtacgggtttatttttgttgtctttttagtttttgtaactcatgcgagcgattggtgagcaacatgtgggcagtataaaaggccataggagaaaattcattgttcacttcctcactcattggttttgatcaggtttcactttctcaatcattggacatcatttttctgatcagcgtttagccccatttctactgaccagggttcactctcaatcatttggtcccatttcttctgatcagtgtttatttcctcactcattgggtcccattaaaaaggcagttcaattgatcgctttctttccatttcttctgatcagtgctcatttcctcactcattttgaccaattttttctgttcaatcttcacttcagtcagatcactcactttcaattctttgttttctcttctttcccgctgatcactttcaattcctctgattttatcattttccaattatttggcccaatttcagtccgttccttccgctcactttcaatttcaaaatgttctccgtccgcttcttcgctttccttctgctgctggccgtcctttgtttttccctcgtcgagtgcggtctcatcggtatttcgactgtttttgcggattaataatatccaaaattcgtccaaatccgtttaggcattggtgccactcccattgaagccgcttggtgcggcgtcgtcggccaagagtccacccattgcccgggaggtgcccttcacggcggatttcccgccgtcggcggaacatacggatttggccgatagaaagcggcgcatttggatacggtaaatcatttagtaaatcgtttaaatgtattgaaatataaatttaaggattcttttggactactgacaaatcgctgatgagagtgaaataaataagttgaaataattgaataaatttggatagaatatcaagcttttcactcaaaattgttcatttatttgtggtttcattacttaaaatnatataattgtcagtaattcccagtgaaagttgaaaagaaaagagatttgtatgangtgatcggtcagcaatcaatttt

SEQ ID NO: 35840 - DNA, 721 bp, Heterodera glycines
  misc_feature (72)..(72): n is a, c, g, or t
ttttttttttcaaatttaggggcggggaacgtaatgcactcgtaaaaccattggtactacaatttgtttacncaattaaaaaaaaataaggacaatgagtggtggctacgccgttagtttcctgcttgacagagacataaatacgtcccaaaaaattatctgtcaaattttttcccttttttggtataggcaaaaatgttcgaatcacaattttgcatgggcatagtaaaataatttaaacaatttaaatttttgaaaaacgaaccgaacattgacatccgactcaattagcgcggaacagacttcctgaaaaaatggaggtaatatactttcagtttcaacaaaaaaaaacgtttaaattttttatattgtctccctgtccatggaacggagtgttttttatgaaaaactaaagaatttacgctaaatttatacaaattttgttgatttgaaagaaaaaacaggagaatgaagcgattaaaagagaaattttttgactcggctaaccccaaaggggtaaattttcaaaaaatccaccaaaattggatgaaattaattttgatttccagcggttagcaagcccaaggcctggaatgtgcaggtctcttaaactttggccagtccatccaaccttaagcatagcgttgagttcgtcctcattgatgaccgtcgcttggccaagtttgccaatggcattccgaattcgcctgcccaagtcggc

SEQ ID NO: 35841 - DNA, 926 bp, Heterodera glycines
atttttccaaaacaacggcgcagagaaacaaatttccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcagttggaattcctattactgttgagcagaaaaagagatagccaattttccaaatttttcacaaacaaacgcgcagagaaacaaattccagaacaattagtatcggcgtaattattctgagaatgcggttggaattcctattactgttgagcagaaaaagagatagccaattttccaaatttttccaaaacaaacgcgcagagaaacaaattccagaacaattagtatcggcgtaattattctgagaatgcggttggaattcctataactgttgagcagaaaatgagatatccaattttccaaatttttccaaaacaaacgcgcagagaaacaaattccagaacaattagtatcggcgtaattattctgagaatgcggttggaattcctattactgttgagcagaaaaagagatagccaattttctaaatttttcccaaacaaacgcgccgagaaacaaattccagaacaattagtatcggcgtaattattctgagaatgcggttggaattcctattactgttgagcagaaaaagagatagccaattttctaaatttttcccaaacaaacgcgcagagaaacaaattccagaacaattagtatcggcgtaattattctgagaatgcagttggaattcctattactgttgagcagaaaaagagatagccaattttccaaatttttcccaaacaaacgcgcagagaaacaaattccagaacaattagtat

SEQ ID NO: 35842 - DNA, 1093 bp, Heterodera glycines
gaactttttggtgatggattgcgtctctctgatgaaggaaaaggccatgaaagggatagggtggggaaaggttggaaggtgcaaattttggggtccgaaattccctccccgcggcggaaaattacctaattcattacgctcaattgacctgctgcacatttaaatcaattaattggtaatgaggaaaaactgaagttatgagaggaattgggctgaattttaattgggaaaagtggaaaaattctttattaaaaaggagagaattcgctccgtttgccccccccacgaattttccatttgtttgcttttcgatttgaattgtctgtttggtttgtgacagatttgcataattataatgtgtttgccaatttttcgatgatctgtcccttccggcgcaaagagtgcaaacgaatggcacaaatcatttgacagaaaaagccaaatgagtcccgggtttaatggtaccaaaatttctaaaaggcaatatattcgtttcttttttatgttgcaaaatgatcgataattgatgaaagatgcgttatgtaagagatgaatgaatatgataaaaatttatggggttcatcgcaaaatgaattttacagcgaaagaaccgctgagatttattaaataaatcgaaaaaaagaaaagtgactaaaacagttaaaagggacgaacattaaaacatggaagaaaaagcagaaaataggaggaggagaaggagcatcaacaaagaccagcaagaaagggaagaaaaggttggattatgacagacagaactttggatgaataatcacgacgaatgctgatgatgggaggatgaatatgaatgggatggaggatgatggatgggatggaaaaaggaggaagatgaacgaactgatggatggaagagagggagggaatcagaagaaaaacacggactaatggggagaagagaaagcaccaagaagagggaggaaaagggaaaaggagaaaaggaagagggaggaaaagaaaagagggaagaaggaaaggaaagggaggaaggagaggaggaggagaagcactgaacagagaaaaagagaagaaaaagaagcattcgatgattcccccc

SEQ ID NO: 35843 - DNA, 857 bp, Heterodera glycines
cgcgcgtacaatcgcacgcacttcctcacaataatccccttcactttcaattcgcgcgtaatccttcccgtgcaactgcctattgcccgatcgtatgatgatcatcgccatttacaaccgaccatttcccttcccttccctttcccttttcacttcattaatccgtccatttcatcccaatttgtattaaataacaataactcttttcttccattgccaatttagtgcctttgtcttcctttgcgttctttcattctctgctttttcttttgccaatgccatcgttacgtcgttttttgctccgttcgctgatcatttggccctcctttggccccatcccttcgcttttcctcctctcctccatttgcccctttcctttcccctcacttatttctttttcggcatcttcgccaaacgaacatcgcttacggccaataattttgggtcagttctttcgaccataaattgaccaaatgctcaaattatgcaatttgaaagaggcggcaaattggaaaagaaataatgcgagtcggggaaaatggcaaaaaaagaggggggattaaagaacagcacagagaacagtatcagaagaagaagcagaagaagaagcagagatatgcttatgatatggccaacgcgagggtaaaagccaaaattggctatttccgccatacgaaaacgacaaatgttgagaattggcgaaatatccaacattcaaacagagatggaaaggtcgagagtacacagaagtgacagaagacagacagctgacttaatgaattaattaatgattgaatgaccagcagatgaacgaagggcgggggaggggaaaaagggaaagaagggggggggggggg

SEQ ID NO: 35844 - DNA, 1065 bp, Heterodera glycines
ggggaagaaaattggaaatttcgatcatttatagacagtttttctctgaaaattagccaatttataggtaaaattttgaaaaattttatgggaatctaatccaattcttaggggtgtaaaagtcgcttttcgcgccaaaaagcgaaatgcgaaaagcgaaatgcgaaacgccaaaaaatgcgaataatgcgaaaggcgaaatgcgaaaagcgaaacctcggcccatccctggtgtgtatgtcacattttgaatggattattttttgaagcgaaaacattttccaaaataaaaaaaaaagaaaatgcttgctgaaaacttaaacaaaccgacataataatgtttaagaaattgtttatttctttttgatttgttttaaaagcaaataaaatttttgcttatttttaatattaaatgaatttatattaattcatttttaatacgaattctataaaatatgcttttaaggaaaaagagcgagagcgatacaaagagagaaagctagcgaagagagtgagagagaaagtgaaacgagtaagagagagaaaagaaagagagaaaataatagagagagaagagaagagagagataatagagaagagcaaagagaagagagagaaaagagaagaggaaagagagagagagaaagagagagaaaataatagagctagaaaagagagagagagataaaagaagagcaaagagaagaaagagaaaatggaagaggaaagagagagagagggagagaaagagatgtaaagaaagggagagagagaaagaaagaaagaggaaagtgagagagaaagaaagagaagagagggagaggaagggaggaagaaagagaagagagagggagagagaaaagaggaaagagatagagagggagagaaagagatgtaaagaaagagagagagaaagaaagaggaaagtgagagagaaagaaagagaagagagggagaggaagggaagacgaaagagaagagagagggagatagaaaagagaagggaaaaaagagagagagaaaaaaagagagaaagagagagagaaaaaaagagaaagagagaga

SEQ ID NO: 35845 - DNA, 446 bp, Heterodera glycines
tgttcttctccccccccccccggcgatcgtcatttccagcagccatccgttgatcgcaatcgccaaccaaagcaacgaatgagcggtcaattccaatgaaacggcggcgggagataatcagtcgatctaaatcgcttatgtcccaaaaatttgcaaaataggaacaaaagtggaaggaatgtgcggaggaaagaagagaagaaggtggagcagtacaacagcactgaagcatccatttcaaagtccggtgagaatttggtgaaaaaactgagtgggggtaaatgttattgtaaaccctaattagagaaaatgaaccattgatcacttcaccaacagacggctaacaccctattgcccattgggtcgagtttaagcaagttcgggaattgaccacccccccccccgttagctcatcctcccaactcccccccatccttccctttccg

SEQ ID NO: 35846 - DNA, 364 bp, Heterodera glycines
ttatcccctctttcctctccctccgcctttctctttttatttccccccctctctctctctctcattcattgcctcgggctgagtgggaatgagatttgagaggagtttgagattttatttgaggtgcctctgctcgggtgttggtggtcggtggatgggtttgagcggttggccataacttcttccgctctccgtcccatcattccgtcgacagcggtgccattccctccccccctttccccctcccccttttcccccgtctcttccctccctcacatataaaccttgtcgaccctctggttttgactggcgtatccgcccgccgccgttgttatccttttcattcatattctaaatagttttt

SEQ ID NO: 35847 - DNA, 838 bp, Heterodera glycines
ttatgagtgaaggtccaagtgcatgttgataaacaatctcaaagccaaatgaaaactttttgtagttttcgtcagtgtcaatcatcgtgtttctgtcacttatattttgatatctttttgtaacccttaacaattataattggcaccaagtcattaagacatattttcatttagttgcattttggcgaacaaaagaaatctagaaaaatatttttaacagaggaaattagagttccgaaaaaataaaataaattatattttattgacagaaatgttcgaaattatcttgtctctttttatttattggtctctactttttttccaacaaatcccggatgaaagtaattaatttaaaattattataaaataatttaataatattttaacattattaagacattgattaccctgatcagttggaccttcgtttcacaaaaacgggacagctccgaataccaactaccaaagaccaaggtaaataataaaattatgtaataaataaagagaaatattcactttaagattaattttaaaaaacaattaatataaattggcaaattttctttgcttttccgaataaaaaattaaattatagacaattgcgggtgctgctgggccatctcgtcgactacagttttttcgacggcggtattcgatgcacggattgggcaaaaagatcgattgttgaatttctccgagcaatacttggtcgattgtataagtgagaaaaaaaagcatttgagtggttgccaaggagtgcccattgccgactcttttgagtaaatctttgtttttttaataaaaaaattttaaacaaattttatcggtgctaaggacg

SEQ ID NO: 35848 - DNA, 985 bp, Heterodera glycines
tttttcagaaactgctctgaaacgcaccaaatgttaatcccccgttaaataaggctctccgatgctttttctatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattttttgcaaaattaattcataagtattttttcagaaagtgctctgaaacacacaaaactttatttacaggttagtttaggcactctgatgctttttctatcaaaaagggagatgaataaaatttttaattcctttttaaacaggccaaaaagtttaggcttaacttttttttcagaaactgatcagaagcgcaccaaactttgcagggatactgaaaggaagagtaataacctattttaaatattatctagtcagttcatttaaataatttttatccaaaaaaatttttttttgggttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcgtccccccgaaccgatgcgcccagatttatggggagaccgaatccttcgggaatagcttccctatagcctgtactttaattctgcgttggatttttgctccccataattgtttgagtaccccaacggacacttgaaaaatcgattttttggttcttaaatatttttttcagaagcgctctaaagcgcaccaaatttattttacactt

SEQ ID NO: 35849 - DNA, 73 bp, Heterodera glycines
aaaaaacgggagtcccggtcccgggtttagcccattccttaaccatgatatttggaacaaaaattatattaag

SEQ ID NO: 35850 - DNA, 1143 bp, Heterodera glycines
  misc_feature (42)..(42): n is a, c, g, or t
  misc_feature (72)..(72): n is a, c, g, or t
atttcgaaaattttcaaaatttttcgagctaggcctaaaaancgttttcgggtttttgaatttaggaatttntaacgaatttcccagagaaacggagaccacttccaaaacatagtttttcgagctctatcgactggtatttttttcggaaaaatttcgattttttcccggaaatagaaaaaatttttggcctgagcgggacatttgagtcccgggcccataactcgtcaggggttggttttatcaaaaaaacgccttagggcaaaattgtagagctttttaagctctatcgaatggtgtgccatatggccggaaattttcaaaatttttcgagctaggccccctagaaattttcggaaattttttttcggacgaaaatgggggtgaaaaatatttttctggggtaaaataaggtgctgagtacgaatatgatgtctattttaagtttcataatttttggaattttttaaaaattctttattttttggcaattttttggcctcgggattttggcctaatatttgaaaattcataacaaatcgaagggttgatcaattttacaggaataaagccttaaaaatagagaaaaatcaggagaattttatgggatttatttgggatttctatcttaaaaagaaaacaagttattccagaatttctgaaaattttcgatttttcagaaaaaaattcatgcattttacgttatttttaatgattttaataatttaaaatattttattgagttaataaataaaaaattatatttaaattaatttttttttgatgaataaattttataagtttaaattaatttttttttaattgatagaatttcatgtatttttttaattaaatttgttaaaaaatattttcattttaatttaatgaatttactaatcactgttgtatcaatttatatttaaagatttgttgtaaattaataataaaagaatttatgtaaaaaataataattatcttttaataaagaatttcatattttttttaattgtttataaaaattaatttcatattaatttaaatattcaattattgtacatttcaaaattctctttttaattaataaaaggaataattaatttattttttaaaatttataataaattgcattcaatttttgtacct

SEQ ID NO: 35851 - DNA, 825 bp, Heterodera glycines
tattttaattttattttctaaaaattccttcccaacatccctccttttggtgctcattaaatgatagtgcagccaaatcggcatttatgccgaactttgcaaatgattattttacctttttggtacttattttaattttattttctaaaaattccttcccaacatctcttttttggtgctcattaaatgatagtgcagccaaatcggcatttatgccgaactttgcaaatgattattttacctttttggcacttattttaattttattttctaaaaattccttcccaacatctcttttttggtgctcattaaatgatagtgcagccaaatcggcatttatgccgaactttgcaaatgattattttaccttttggcacttattttaatttttcgagggtaaaataggtctttttctgataaaattagttttataaatttaagattcagttgagaactcgaaatccaataacgaattttttccaatttgtttactttcggcatttgaagaaataaaaaattttgtaatgttgtaagcaatggaaaaaaagtgatttttatggggtgtatttttcaattttttgtatcttcctagatttttctctaaaatgccaaactttggagaggaaatagatgagaggaccaactaaaagaattttttaatcctttttctgtaaatagaccaaattttattctatcatataaaatattaaaaaatattaacaaaattattaatgttaaaaatgtttaaaaatattttggataggaaaaagaacaaagcaattattttgcagggtgggggaattgactttagaaaagaaaaaagga

SEQ ID NO: 35852 - DNA, 837 bp, Heterodera glycines
ttttatttttgagggaatttttaaatttatactctatcccagaaaaatggctatctctttttttgagaaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcgggcgcaatagaccttttatttttgagggaatttttaaatttatactctatcccagaaaaatgtctatctctttttttgagaaattttatac

SEQ ID NO: 35853 - DNA, 941 bp, Heterodera glycines
  misc_feature (18)..(18): n is a, c, g, or t
  misc_feature (873)..(873): n is a, c, g, or t
tatgatcaataatttttntgtttgaaaattttattatttcttcacatttttttgtgatcaaatgatcgggtacagtcacttttaatcgcttatttaaagctatttatgcgatcagtgattgaaaaaacttagttttgaaccagattttggacaaaggcgcaaatgtcgggccgcaaatgtcgggacacggtttcaaagaggaataaatttaaaaaatacaaaggaatgcaaattttcaatttgaaaattgctaaaaatgttttttcctttatattaattttggtatatatttttttgttgaataagtgccaaacatggagggcactaatcactttccgtcaaaatgatttaaaatttgagaaaccatccaaatctgcttatgttcttggccgtttggctaattttccgtgtttttctttgtttttttgtccccattctttttctatcattctcatcttttccgtgcaggtcaaatgcgtttatggttgttgtgccgactgctgacaaaataaaaaggctgagactcatccgtgccaatgcgactggtcctcccccactcagtgtttacatgctttcatttgattccctctcccaaatgtcctttcgtcggaatttgccaaaaacgatggcgtttctcgagaatgaaatgaaatctgttgtttttaatggtattttttaaaatagtccaatcaagctacagtttttcttccaggttataatattgtcggcgatggcacaccacaggcatttattccaattttgacggcacaaacggaggaggaattggttagggcattttgtcttcttttaataatttgatcattcaaaagcatttagccgttgacgaggaaacgttatcgaagtgccagtttngttgacgaagttaccctttcgcgtggcgtatttttcccgcgccgctatgccacatgtatggcgagacg

SEQ ID NO: 35854 - DNA, 876 bp, Heterodera glycines
agtggggccgaaggcccccgtacggttgagtcttagtcattgaaatgctggtgggttgagtcccagtgattgaaatgttggtgggttgagtgccagtgattgaaatgcaggagaattgagtcccagtgattggaatgctggtgggttgagtgccagtgattgaaatgcaggagaattgagtcccagtgattggaatgctggtgggttgagtcccagtgattggaatgctggtgggttgagtccgagtgattggaatgctggtggattgagtgccagtgattgaaatgcaggagaattgagtcccagtgattggaatgctggtgggttgagtcccagtgattgaaatgttggtgggttgagtgccagtgattgaaatgcaggagaattgagtcccagtaattggaatgctggtgggttgagtcccagtgattgaaatgctggtggtttgagtgccagtgattgaaatgcaggagaattgagtcccagtgattgaaatgctggtgggttcagtcctggtgattggaatgcagtcccagtgattggaatgttggtggattgagtgccagtgattgaaatgctggtagttcagtcctggtcattcgaatgctggtgggttgagtgccagtgattggaatgctggtgggttgagtcccagtgattgaaatgcaggagaattgagtcccagtgattggaatgctggtgggttgagtcccagtgattgaaatgctggtgggttgagtcccggcgattggagaaaaaaccaagaaaaggatgcgaggccgcgaagcggccgagccagtcgattttatcattcataatcctataatacaatcgtactacctagacggggggatgcgcccgagggcgctgaacccg

SEQ ID NO: 35855 - DNA, 1330 bp, Heterodera glycines
  misc_feature (1296)..(1296): n is a, c, g, or t
agtgacatcaaattcagatttttttattttcttcgcctccccccgatggtttttatataacgactcagcaccgtatgaaggggtacctaattgtaccagtggtacccccttcgccctttttgaaaaaaaaaaaattaaaaaatcgcgagatacacgcattttaattgattggtaaaaagcctcataattcaaatccagcattttttgacataacaatggctttatctatatacacggaaacgttgaaaagcataatgcttcaaaaaaaaatgtctaaagccgagttcgggatcagcaaccacgaaaaccatcgtaagcatgtattcatgatttttgaaaagaaaaaaaattttttttcgaaagatgtcgaggtggacaaagtctagaaaatcaaacttttcgaaaaatgaattccgacccgaattggattttcgaattttaatcggaaaatcgggtccgatattcggaattggatcgaaatggatatcagtgaattttccatccctgcaaaaccccgaaattgactttgttacccaacctgcgcgtttggctccaacgcggtggccaagttggccaattgggcagcgaccgctgcggagtgcgccgccacccgcccgtccgtgtcgtccgccggccccgccagtgagccacgcgcgcacagcaacgccccgttgctgtccgtgcacagcacgccgcgcactgcccgttcctgctgcatactgtaactgtgggggcggaatttcaaatttaaaagaagggttgggtgaacaaatttttgtaaaattttcagaaagcaaaattgaaattttgatgaaggcctttttgaaaaaagcaaggcctggatttacgatggaactggatacctaagtcggggttgcgggcattattttggttatacaaccttttgcgaatttcattttattggttttaaccgggcttatacaatgtacataaaacccctgagttttcaaatttgtatggggggggggggtcggcattggttgaaattgatgtcggttttgcaatggcaacttctaaaagcccagggaaatggcaacattagaccaatctaatttttaaaaattcaaatgagcgtaaaaatcaaaaagtgctctcacatttcgtctgcatattcgtccatccgtttttccatgctatattataattaataacaaataatcagctaaaaaataaataaaataaattacgtaaaaaatgaaaaatgcatttaaaaaaaaagaaaagcgtaaaatgtgaacgaacaatttgctctcttcaattgataaacggacaaanatattttatattttgtaaataaaaatgcataaga

SEQ ID NO: 35856 - DNA, 1240 bp, Heterodera glycines
catctgtcggtgtttaacattatccgtatcccaccccgtcaaataattttttagtattctgtccgttattcgccgttccaatgtttccaattttggaattgccacgaataaaatgtcgaaatcgaagccagcaaaagtgaatttaagcatcattaattatccgtgactaatttttagcatttttattaaattatttcagggctcgaatttaatatttttaaggattcttatggatcttcgagcttaatagaaaatttttagcaaagaagtgtacaaaaataaattttcaaattgtgttttaaaaattttttggtaatactttggtttttacccccccccccccctccttttttgagaaaatatatttgaccagcagaaaacgaccgtaaaccaaataaatttagtttttttcgagatcgttttaatttaaacactcaaaaattccaaaaatatgtatatattcaatatttgcctaaacaaacttaaaaaattttggtaaataaatgtcccgcgtatttttgggaaatcgtttttctaattttttaaatttaaatttttgtcccttattttagtgttccacagaccgagaaataaaaaattttttgattatgaattttttttaataaattctatttatattaataaatacttagaaaatatatgtacttttcaaataatgttgtaaagattattattttttgcaaaatttaaaaattcaaaaggcgggcaaattatgtgtcattaggagtccaacaacaatggcacaaaaaatgacggcgttttcatcgcggcaaaatggcggcgggcggacgggtgatccatgccaatgcaaatgtcagttatcagagccaaatacatcatgggaatttcttttttctttgccttcattatcattatcatttgtagagattaataaagattctcttcctcttccactcctgttcctcttccccttcctttttccctctttcttttgtttgggagtgaccgttgtgaaaacagagatggacattggcattgccattggcattttctctcattttttgttccccgtcaggaggcgtcatttttggaagtaggtgtaatgcaaaatcattgcctcaacaattaggaaagtcttgtaggatcaggttttgagatatatgcaaatagaaaacaatatttttatgcaaaacaattcccaattctgtttaccatttttttgagaatgaacatgcctgctgacggttggctacatatt

SEQ ID NO: 35857 - DNA, 1595 bp, Heterodera glycines
tctgaaacgcaccaaattttatttacatgttagtttaggcactctgatgcttttactatcaaaaagggcgatgaatacaaattctaaaaatttttaattgctttttaaacgagcgaaaaactttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaattgctttttaaatatgcgaaaaattttaggcttaactttttttttataaactgatcagaagcgaaccacattttgcgagagcatcaaaaagacaaggaaaagcactgctatgatgctaactccaggaattctgaatttaaaattttttattaatttttaaagcttcactattttattttttagcaaaattaattcataaatattttttcagaaactgctctgaaacgcaccaaattttatgtacaagttattttaggcactcagatgctttcactatcaaaaagggagatgaataaaaatctaaaaatttttaataattgtttgagtaccccaaacggacacttgaaaaaatcgatttttttgttttcggggcagtccccccgaaccgatgcgcccagatttatggggaggccgaatccttcgggaatagcttccctatagcctgtactttaattctgctttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttgttttcggggcattccccccgaaccgatgcgcccagatttatggggagaccgaatccctcgggaatagcttccctatagcctgtactttaattctgcgttggatttttgctccccataaatgtttgagtaccccaaacggacacttgaaaaaatcgatttttttgtttcataaatatttttttcagaaagtgctctaaagtgcaccaaaattttatttacaacttaattttagcactctgatgctttagtatcaaaaaggaagatggagaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttt

SEQ ID NO: 35858 - DNA, 895 bp, Heterodera glycines
tccatgctgtgtagtttactataaagcaaatattcatcttccacttagttactcacctattctagcccattaaatgccatcactctttaaagatacttcgcaagaaaagcttaaataacaaaaattcgaatctgttatacaattccatgctgtgtagtttactataaagcaaatattcatccactcttaattactcacctattctagcccattaaatgccatcaccctttaaagatacttcgcaagaaaagcttaaataacaaaaaattcgaatctgttatacaattccatgctgtgtagttttctataaaacacatattcatccactcttaattactcacctattctagcccattaaatgccatcaccctttaaagatacttcgcaagaaaagcttaaataacaaaaattcgaatctgttatacaattccatgctgtgtagttttctataaagcaaatattcatccactcttaattactcacctattctagcccattaaatgccatcaccctttaaagatacttcgcaagaaaagcttaaataacaaaaaattcgaatctgttatacaattccatgctgtgtagtttactataaagcaaatattcatccactcttaattactcacctattctagcccattaaatgccatcaccctttaaagatacttcgcaagaaaagcttaaataacacaaaattcaaatctgttatacaattccatgctgtgtagttttctataaaacacatattcatccactcttaattactcacctattctagcccattaaatgccatcaccctttaaagatacttcgccagaaaagcttaaataacaaaaattcaaatctgttatacaaattccatgctgtggagtttttctataaaacaaatattcat

SEQ ID NO: 35859 - DNA, 1104 bp, Heterodera glycines
  misc_feature (9)..(10): n is a, c, g, or t
  misc_feature (36)..(37): n is a, c, g, or t
  misc_feature (82)..(82): n is a, c, g, or t
  misc_feature (938)..(938): n is a, c, g, or t
  misc_feature (949)..(949): n is a, c, g, or t
tctagagtnnctttcaggaaccattttccccatttnncttttctgttttactcaaaccgccccgtatctgataatatatttntggtggaatggaggcccccaatataattacttgtttatatctgttttttaataacaaattcaattttaacaggcatatggcattgaactacttctttttcaacgatttgaacgaattttccaatggctaatgagcaaataaaattcattaatttaatgcatgatgaatatattaataataataaataatttgagaataaagtgtttggtggcaaaattaattgattcatattctgttacgcactcataataataataataataatgttttttttatatttgccctttatattttattctgatataaaatattgcgtatttttcttttttataaagctaaaataaattccgactttcaagtattcattaaatatagagaaaaattttttagcgcaattagtgtccatatcccgtgaaatcccatgtttttagcccgtacattacagatttgtgaactgcgaatttcagctccctaatcttttaattttttaaatattgactaaaaaattctaaagaaatcgtttaaaaaacttctttacctacaatctttaaaacttgagtatttgcttccccggtatcgcattgcatactttttaagaatacttatttcgccagtgcatgttattactagggcttatatttctagttgcaaaaaactgcaaaatagttagtttttagtttctaaaagacccaaaaaagtagttgctaaaaatgggtaaatagttgctaaaaactttcaaatttagggatgtaaaatgacaaaatttattcaaaaagtaaaaaaaattaggccaaatcagtattgagctaaatatttttaaaatcataaattcttgtcaagaaataattaataaatnaataaatattnggagattgatttttcatttgttaggggtgcatttttgaaaaatttcgggtcgattcttaaggggggggaatttttcgctttttattgcatttttcataacaaatttttattcactagtaaaaaatagttgaaaaatagttttttttcaaaaattt

SEQ ID NO: 35860 - DNA, 1017 bp, Heterodera glycines
  misc_feature (521)..(521): n is a, c, g, or t
taatggtcgagttatccaatcaaaacaaattagcaaaaaataagcaattaatggccgataatattaaagggagagaaaagaaaagtggaggaaatgaaagtgtggtcagagaactgatcagaaagaaacgcaaagacagagaaagccaacgacactcgaagctgataaaaaggctaaatgggcagcgagcaaaaaagaaaagaaaataaagaaaaggaatgaaattgaatattgaattggcttctgttcgtcgtcctatttctttttctcttcctctttttctccttttcgccccttcttcctcttaagcttcattttcttcttcctctccttttttgtttcttttctgcctgtttctcttcctcttcttcttctgtctctttctctttttctccctcttcctcttgctcttcttcactttgctattttctttctttttcccctcccccatctcctcctcctcctcctgataatcttttcctccatctctccccctcttccatcttccattgtcttcttcncctcccttccccccccccttttcgtcatcttccagttttgcgcatcccctccatctttttaggaatttgaatttcacacaatgccaccctatggcgaggcgccggtttgagaaggcagttttataagagaaagtgatggaaggcaatgcaatggcggggggggggggagaagtgatcaaacccttcgctcattggcgccgtcggcaaaagggaaaatgacgggcaaagatccgatcagtcagaggggcgatgtgatcaatccatcgcaaattctccgactgatattccgctgaattcgtatcggagagtttggattaattggggaggcaaagtgtaggaattttgtgcaccactcggcgcataaaatcacttttcgatcgccgggaaaacgccccgccgttgggtcagaaaatcattttccgctttttcactttcatttaatttttattccattaattgtgaatttttaataaattatttataatttaaacaatta

SEQ ID NO: 35861 - DNA, 931 bp, Heterodera glycines
cctcttctttagcaaaggtatagaattccctaaatgtttctccccctgtaccgagtgaggaacggaagggagggtgcagggatggtcccaggattttgcttgaaaagggtaccaagggcgtagccaaggcggcggaggtggggctaacccctccccccccccccccccctaaagcgacaaagaaaaatacttataaatcttgctcatctttaacatttttgcttaactaattacattaatgaaaattgaaacatctctttgatatccattctcacaattcgctaagtgatctctctcattactcttatctataaatattgaaaaaatttttgcggtcctatccaatgattttttgaagaaaaaaattattgtatgtctaatgaaaaaatttattgctcacatttgtattttcttgatattatttgatagctctaatggcatttcttctggtctgcaaaattgcaaaaatttggctaagtttcataaaattatggtcaatatattctgataacctggcttcctgagtactgttgctcaaactttgtccaaacatgatcaaattttctgaaaattaccctgaagtaatagagagaacccttaggggtatcgaatgatatctagaatgtttaatttggttacttagacgaaagttatgggaagtttccgcttaccgcctttccattaaccaaacgaaaaaggcgcccacccttacactaattagcagttaaggaactcccgacaaatcccacccacaaatcataccttcctcgagcaataattcattcttctcatttctcgtcgaatttcccccgttcagcaacagtttttcacccaatacaaaaagctcccttcaccacattaattgtaaattatttttctgtgcaataaacaaaatccccaatttcttcttgctcaccctaccaagtcgaag

SEQ ID NO: 35862 - DNA, 401 bp, Heterodera glycines
cgggaccgggccgggaattcccggtcatccgaggtcccggtcccgggttttgaaaagctcaggtcccggtcccggtcccggtagggcaaccgggaaccgggaaaaacaagcactggtaagaatggggtctgagtgaaaaattagtgaagaaaattggaaaaattgaaaaaacccaattctgacaggttggttttaattttatttataatttaatatagttatgtgtatttaagtttaatagctagtgcaatatcacgcatatgtacaatattttgtttacattggcggatttaagcgattggcggttttataaaacgcgaattgttaagtggcggatttataaaacgcgactggcggttttataaaacgcgactgggtggcggtttttataaaacgctcca

SEQ ID NO: 35863 - DNA, 640 bp, Heterodera glycines
gtttgaaaacatttttttttattataaactgttcaatcttttttttttaattcaaaaaataattcattaattagatatgattaactttttattctgagatcaccaacaccaagtatgacaataggaaaatgtttcttttattggtcatgcttttatattagtcgataagttatttttaatcagacaacgtgaaaatattaaatttatttatttaattctgctagaataaaatttaatttttggattattatttaaatactaaaaaaccatataatttttagctttcctaaaattttatttacatttatttatgattttttgttatggttttttgttattactttattgaatcgataattcatacatatatataagaaaatttgtattaattataaatgcaattaattttccatgtctgcattttctcgagatattgattcatccatattgctctctttttatcgagtcaatttttatcacttaagaagaagaaacaattaaaacaattctatgaacacataagttattatattttgaatcgtatcccattactctatgatattatagagaaatttaattccatatttgttatcttggtaaatataattgaagtatgcttaggttgttataatttataaac

SEQ ID NO: 35864 - DNA, 683 bp, Heterodera glycines
  misc_feature (32)..(32): n is a, c, g, or t
atccttttttattcaattgggttattgtaaanttgtacgtcccaccacaggaaaaaaagcatgcacataatgcaaaaacatgtgacctagatgaaaagtttgtaagtcgaaaataattttcgagtttttattttttttcaaattccgttaaggaactcggaattggtcgaaatagagttaaaaccccgcaaaagtttacagacaaaaacttgtaaaaaggggtccccatttggtttttgaaaaaattaaaaatgtgttgaatactttacaaatggcgccttttgactttttgttcagttagaactagggattagaaataaattcacgataaaggaccccaaaaactaccagggatgagtttaacaaaatattatcacaaaaaaactcgcaaacaaaagggaaccgcccactttggcgcggccattttggcgcgggtattttggcgcaaggtttttttagcgcgagcttttttggcgcgggccattttggcgcggccattttggcgccctatataaaatggcttttttggcgccagagttgaaaaatctccaaaaattttcagagaatttttagcttgcttttctttttgaataattataagtcattttctttacaataagcatgctcctacaattgttagcactggtgtacaattggggaacctaacttgacttttatatttt

SEQ ID NO: 35865 - DNA, 645 bp, Heterodera glycines
taataagtagggctgggattcttaagtttttacttatttttctgcggctttaactcgacgagaaatgcacgaaaaacacattttttgttcggaaactttcgttttaacgcccctatccgaccctagaaatccctattttggatgttcgccactaaaaatccctattttgagtgttcgcccctaaaaaagtttttatccctattttggcgtttcgcccttattttcgcccctatttcgcgatttttgggaaatttattaacaaaaatgcaataaaaacgaaaaatacacccctaaaaatcgacaaaaaaatttcggaaaaatatacccctaagaatcgacctgtaaattttcaaaaaaatacactcctaagaatcgacccaaaaaatttcggaaaaatacacccctgagaatcgacccttaaatcctgaaaatttctaaatgtacttcatttctaactgtaatcagtaaataaaattgtttgacttaattttaactaatttacatagagaaaacagtaattttaataaactcacccctacatttgaaattttttcgcccctattttcgctcctatttcgcgaattttttgcccctatttaggtccctaaattggaatttttcgcccctaaaaatcccagccctagt

SEQ ID NO: 35866 - DNA, 764 bp, Heterodera glycines
tttttctcatttttttaccgcaaacttggtaccaacagttgccttctcttgtctggccctatcaaacaatcttacgatatttgaaacgcaaacaaaaaaaattcttgaccaaaaaatagctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcattttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccatatcaaacaatcttacgatatttgaaacgcaaacaaaaaaaattcttgaccaaaaaatggctatctcttttttctcatttttttaccgcaaacttggtaccaacagttgccttctcttgtctggccctatcatacaatcttacgatatttgaaacgcaaacaaaaaaaattcttgaccaacaaatagctatctctt

SEQ ID NO: 35867 - DNA, 1126 bp, Heterodera glycines
  misc_feature (518)..(518): n is a, c, g, or t
ggcattcccttcgccaagttccaaaagatgagcagcccattcgcagttcaaaagtagttagcccacaaatgataagcattaaggcgaacggaagtaaacccccggcactgaaaaaaaaacaaataaaggaagaaaaaaagggggtcaaacgcagcggaacattcgatggccacgcaaatgagcagaaggccgagcagtagcagacctccgatcagaaagagcagaaagccaagcacaacgatgaacttacgaacggaccaaacgcccaaataaacgggcacacaaacgccacaaaaaatgggcggtgagcgtttgtaataccacggcacatattgtgccattccgaatcgaccctaatctgacgtgtttatttgttgatctgtttggcttttgcctttgtttagggggaggggaatggcagcattgagtcagtcggtctcttctcgtcgatccgtccgttggtgaaatgattgaatgagagaggcgagagcaccgttgtctgagtcaccccccccccncccccactttctctgtttcggatattcgttcatcttctgctcctctctccttcctctccaatttggcctctttctcatttcatttcacattcttttttctttattttgttgtttccctctctctccccctctttttcttttttctcttatctctcttccattctttttcctctttcttttcctttaccctcatttcccctttctctctctctcccccatttttctagttctgatcgctttctctgcctttgccgctccctttggcttcttccgatcatttggacagggaaaggcgggctttcccctttctgaggatggtcagctgtttctttttggtccattcgattatttgactcattttaccaacaaattattattattattaaatatattttcatcaatatgtcgtattattaattatttattcacgaaaaacaacaaaaattatatgaatcaaaagaaataaaaatgggaaagggcaaagatccaaaaatgctttcaatagaaataaagtcaagaagagaacaacaaatcgtatagcaaaagtgagccggattagggagagagagagggagagagagagagagagagaagagagagagagagag

SEQ ID NO: 35868 - DNA, 968 bp, Heterodera glycines
  misc_feature (249)..(249): n is a, c, g, or t
tgggtcgatgtaccctctccgtctgctgttgtctcggcttcggtctgctttagcgctgaaaaatgcagtgttttaaaataaaattaattttggtcaattttcgtcactttttggcgtcgagccgactctgcgaccatgctcctggcgccattccttccgctttcgtcttgcttctgcagataagctgttcatttgctttgccaactcagatttgtctccggaaaagaccatttttttgtgtaaataatntaaaatatttggtatgctgaacaattttaacctatgcacagattttcttgaaattttgtataggcctatattttgaccccctttatcgaattctcttttgttttttgaaagtttcttttctaactcgagatcggctcttgcatttttacaagggaaaatctccaataaattttaagttttgcaaagttttggcgttctgattactaaataaataataaacttatttgtacttggagcccaaaattgactcgccgtgtacatcggcaccacaaacatcagatgaacaaatttcaactgctctcaaagcttattgatggaaatcatagaaaatgtcacatttttgtttttgcacttttgaatcgcccaaattttacatttttttggtgaatcgaccaaacactaaatgatcattggtattaatttgattatgggcatggctggcggcaatgagcaaattggtacattcaaattcaaaggaattggtgctgcaacaataattatttcagagaaattgtcattcttaaatgagcacggcgggaagggggttcctgcgggaaaacccgggaatttcgttcccgtcttttttacctgacgggatttttatgggaacgggtaaatgacttgagaaaacgcttggcgcccgaaaatgctgaaatgttattgtttttgctagagcccggcgggaacgggactcccgcgggatttttacgggattcccg

SEQ ID NO: 35869 - DNA, 797 bp, Heterodera glycines
  misc_feature (782)..(782): n is a, c, g, or t
ttggatttatatgtgtccaccttcttcgcatataatattttacaaaaatatatgaatataaataatgtaagagaatatcagagaaattgtgaatatttaaaagtgcaattcattgtgtttcaaaaaagatgcgctctccctattccccaaatggcatataattagaaatcattaatcagtaaaatgcctaagaatttataaagccgtattaaattataattttatttagaattaatttaaaatggataatttgctagatgttgttggacgacaaattttggaaagaatccaactaaatttatttgaacaagatgtacagtaaactcaaaaattttatatatttttaaatttttattccttcattaggttgaagcacttatcccggtctcggtagggacacctcccgcctcttttgcactgctgcgagaccgttgtctcgagcaaatgcaaaatgatgtaaattctaaaaataaaaaaataataaacaattattattattgttgttgatcttataggagacgcggctttttgaagatgccgaattcccagttgagagaattcgcctgcatttcacatgaggcgtggtgcccgtccgctggctgcggccacaccaaatttcccggcagccccagttcatcaatcagcatccgatgtctggcgatgtacgcaggggagcatgggaaattgctgggcgctggacgcggcgcggtcttggcacaatttgggcccctgttctacagggtggtgcccccgaatcagggcgtcggggaaaattatgccgntaaatttaaaattga

SEQ ID NO: 35870 - DNA, 968 bp, Heterodera glycines
agttcttagtacactccacctattattccctttcaccccaccccggattttcaaagttatgcttttgaacaaaagtgcaccccggacagtatggataggcaaaaaagctggggaaatttcaaatataaaaagaaaattatttaaaaattgttaaataacaatggaaaattgcaaaagaataaggacactgtgggtacctctgctgataatatggccaaatgagcatttattaatgtgaatttggagtgtactttttgctgccaacccaaagaaaaattgacggaacatttgggctgatgaggcgaggggatgagggcgaatcgtcgtgtgaatcgatgggcaacaaaatcgggtgacggggggggggaagaatggaagaatgaatgagtggtggtggtgttgagggatggggcgatgtattgatggaaagaatgaacaaatgggggagggacccaaaaacggggtcaaatacagctgaggaagtgttggggggggcacagaaaaggcattggacagacaaatgccaggaaaacaagcaaacaatttgaaggtaaaaatgccaaaaatagctaaaattgccaattttcagtgcaatctgttaaaaaatggtcaaaaattccaatttccccccagcggcgcttatcggtaccgccagactccaaaactttttttccttaataataactggctcaaaatcgcaaaaattagtcatttttgatgaaaatcattgcacccaaattttttaaaaatattgccggcggcgcctacgctgctatgacgttagtcaaaaaccatgaaattaaaaatattttttggtataacttttctcaaaagcaaccaaatttttatttcttgatatctttcggtagccctacaaaatttcaaaaaatttagttaagtttcaagaaagttagaccaaaaatatttcaaaaaaaacttggttttttttttgtgtttctccaggacct

SEQ ID NO: 35871 - DNA, 861 bp, Heterodera glycines
cttgaaaattcgatttttttgttttcggggccttcagcgggaaccgatgctcccagatttatggggagaccgacttcttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctggactttaattctgcgttggatttttgctccccataattgtttgagaaccccaacggacacttgaaaaaatcgattttttttttttcgggggaagccccccc

SEQ ID NO: 35872 - DNA, 878 bp, Heterodera glycines
ttcagccgaagcgattcaatgctgcgatcgattgcatccttctacgagaaaaatgttaaatccctcgacatttcagtggtatacgaaagcgttcaacaggtattttcggttgtttaatattgctaacttttctttgccctttcagtcgagattaaacgaaatcgatgactcacatttgtcaagtgatattcaaaatcccccctcgcgactcgagtttcagcgtacccccgaaaagtcgacgcgtagcgaaccttcggcgacttcggcagaaattagcactcacaatcagagccctttatccgaaattgtgccaactcaacagatggtacgataatttgtttactcattatctttccattgacttcagcaaccccaacctcatccaccctcgaaggaataccgtgtcaaattaatccgccccgaatattattgtaaaccatcggccgaagagttggaggagtgtttccgtgaggatggaagccttcgaattgagtgtggcctcacagttgggcgtgtggggtatggaagtgtgttttggaagggcccaattcaattggatggaccgatcgactttgatgagattgttcatttccgcaacaaagaagtggtggtttaccccgacgagaccaaacggcctgaagtcggcacgggtctgaacacagcagcggaagtgagcctggagcgagtttggcctatcgacccgaaaacaaagcagccgatcaaagtgagagttatgtgggaatctgcccactcccccccccccatttgttcattggcatgttaaaattctgcgaactaaaccttaggacgtggaagaattgcggcggctcagttttcgtgagaagttggaacgtttgtgtcaacggttggacgccgag

SEQ ID NO: 35873 - DNA, 499 bp, Heterodera glycines
aaataaggacatttaaaatttgtaagatttggaccctcaaaataaggacaaatcttacaaataaggacaaagggtaaccctgcacaagaatcagtttaaatcatttttatcctgtcctgattcaacttgaaaacccttttttcgtccagttttttttcaaaattccggcatttatatctaatgatgattaagttaatcattagccgatctctcgaattgttactgtttttttgacatttggcttgtgaaaaacaattttatttggtgtcactgtatttttttaaaacataattagctattaatgttgttgttttgttaattaatagaattcaaactgatgaaaatttaagatcatccgcaagtgttcgaacggttagcaaattggttttaattaggttcaattcatcaattaattactcacattcaaatagtcgacggaccaggacggcaaaagatgcgtaaagttggcagccaatgctccataaacgtaaatgtagaa

SEQ ID NO: 35874 - DNA, 841 bp, Heterodera glycines
gtctttttcgaatattaacaaaatgaaatattaataaattaaccttcctaggaagattatatcaatctaaaaattttgattttcactttagaaagtaattttaaaattgagctaaactattatctacatttttaaaaatacgaaaaagaatatttacgaaataaattattaatttattttatataaaaaattctataaacaataaaacctgcaattgaacaagttaaaatgatgaaattatcaattcaagtttaagttgtgtatcttaagatttttatttaccctcgaatacgatttaataattttaaatatcaaatttttaaatttttacaatcaacaatttaaaatcttgataaatattaaattaacaatataaaaaaattttgagaagcaaattaaaaatcaataatttgtaatggctgcaaaaaagtaatttcaattatctataagttttaaaatcaattgacaactcttttattagagacgcagaattcactctctaccgctcaagaagatgtgtattcaattaatgagcttttcaatagagcagctaatcatgataaaaaatcattttatggttttccatacatgctattttttaagaaaaagttaataaaaccttaaaatttaatggaaagcttccaactttgtatgcgaaacttgcactggaatactggaatatttaaatggtatggaaaaaattgtttcaaaaacttctaaaactcaattattatattttaaaagcacaaaaattcataagcaaaatcatgaaaaaattatttagttaacaaacaaaacaattattcgattgtacaaggatacttactacctttgttatcat

SEQ ID NO: 35875 - DNA, 1225 bp, Heterodera glycines
agcactaaatttattaagaaagacaaaattaatcaaattacccccctagacaaataactacaaaataaaaattggtaaattctattcgaaattgattaccaaaaatattaaaaagtataggttacttaaacaaaatttattaacagatcctaaattaaaaaataattgaaaagattatcaaaaaacaataattcattcattaattacaagctgttatcagaaatatgaggcaatcaataagtgctgcaacgagaggtaataaataatttacaaaattataatttattgaaagaaataataatttagggcatataggccaaaacttgatagtcttttagctttaattaaagacataaaaacaataaaattaaaaaatatattaattaaattctataaagaaataattaaaaactaaacattgataaaagtatgcaatgataaaaaaatcattttctaagtaaatttaacgagttttgaaggaaacagttacatatttaaaaaataattgcttaaattggagtaaaatttaaatggaaacaaaattaaatgcatatacaaaaaatataacaaatattttttaattaaacatttactatttttactattcgcattaaagggagaaagttttattttaaaacaaataaaagcaacatttaaataaaaaaaaaataaattactaaattgaacggttataaaatgtgaaatattttaaaaaattttggatatttggttggttgtaaaaatcaaacttcaattttttccgcccttcggtatgagagcattgagataccaaattaaaggattctgagctggtcatgattaaattttaaaaaaagaaaataacttttgtacaagttaagtcataataaatagatattaaccatgaataccacaataccgccgaattaaaataaaaataaatatgagaaaagtacattcattatcaaaataattttgtaataaaaatatttttatttttttaaaaaatagaattaaactttttaattgaaataaaatgttaaaattttacatttgatgcttgaaataaaaatgaaaaataatcatagaatatatacaggatgcggaaaaaattcccgtacctttttaaagttcgtttttcataaccatttataattacaaacaaattccttgaatttatgcttttttaaccatgactattttaccaaagataacattttttgattaactaaaagctgcagaaggg

SEQ ID NO: 35876 - DNA, 1038 bp, Heterodera glycines
  misc_feature (30)..(30): n is a, c, g, or t
  misc_feature (45)..(45): n is a, c, g, or t
  misc_feature (56)..(56): n is a, c, g, or t
  misc_feature (65)..(65): n is a, c, g, or t
  misc_feature (67)..(67): n is a, c, g, or t
  misc_feature (107)..(107): n is a, c, g, or t
  misc_feature (144)..(144): n is a, c, g, or t
  misc_feature (151)..(151): n is a, c, g, or t
  misc_feature (169)..(169): n is a, c, g, or t
  misc_feature (180)..(181): n is a, c, g, or t
  misc_feature (238)..(238): n is a, c, g, or t
  misc_feature (1026)..(1026): n is a, c, g, or t
gcgcccagatttatggggagaccgaatccnttcccggaaatagcnttccctatagncctgtactntnaattctgcgttgggatttttgctccccataattttgttgnagtaccccaaacgggacacttgaaaaaatcgattttnttgtttncggggcagtccccccgancccgacgcgcnncagatttatggggagaccgaatcccttcgggagtagcttccctatagcctgtacttnaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctattgcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatnccttcgggagta

SEQ ID NO: 35877 - DNA, 1268 bp, Heterodera glycines
  misc_feature (50)..(50): n is a, c, g, or t
tctggcgcatttttcgttttttttaatggcaaattaacatttttgcacantttttcagcataccagcgagcgcgatctcaaacagttgtttggccgttggggtgaggtggaatctgtgcagattgtttatgatcgctattcgggccgttcccgtgggtttggcttcgtctacttcaccaacaccaaggaggccgcacgtgtaagaaaatttaaatatcaaaatttatttaatacaaatttatttatccctctaattgagcccccccccccctccttttcaaatgaattacgttaatttttcaaaaagtagggaaggacctttatttacatatttccggattttcttcatattttggtccggaagccgctctgcgatttctattttttgaccttccccaaattttccgttttatattaggccaaaaattcaaaaaaatttattttttcccgaattaggaataaatattttaaaacaaatttgttcctcgagttatttgaaaatgaacaatttgatcatcaattttccaggccaaagataacatggccgatgtggtgattgatggaatgaaggtccgtatagattattcggtcacgcgaggcggcggcccatagtaagtttttatatttttcataagaatttggtgaaaaaatgaattgctggaaaatagagattcttcaacaatgttctttgaaattttatttgaaaaattttgcaataaatattttttttaaagatttatgatcataaaggatattatcagaatacgacctggacctgcattcaggcctggatttttcctggacctggattttcctggatattagttcaagaaatccaaatcaaatttgaaaacaaatccaggtccacgtcctggtaggcacgaaaaacctggatttcctagataattttttagaatttgttatcgcaagtgactattgttttatttcaaattatcaaaaaaatgattaaataccttttaaaatacgatattttttaaattatatacttttgatttttctaagcaattaatttttttaatttgtttgctttttaaaacaattaaaaaatccaagtccaggctccgagaaacctcttgtattaattacatctccaaattgtcataaatttaaatgttttaaacataagaaatttcttaatttatattttatttttttttattcaccacagtcggcacatgccaccaaatggcggcggcagttgtcaaagagaagggccaatacgctatcggagcgcaagccgttctcga

SEQ ID NO: 35878 - DNA, 392 bp, Heterodera glycines
tctctccttctctcccccattctcttctctctccttctctcccccattctcttctctctccttctctcccccattctcttctctctccttctctcccccattctcttctctctccttctctcccccattctcttctctctccttctctcccccattctcttctctctccttctctcccccattctcttctctctctttctctcccccattctcttctctctctttctctcccccattctcttctctctccttctctcccccattctcttctctctccttctctcccccattctcttctctctccttctctcccccattctcttctctctccttctctcccccattctcttctctctccttctctcccgcattcgcttctctctctttctctc

SEQ ID NO: 35879 - DNA, 128 bp, Heterodera glycines
cagtcgatttcgcatcaactccaaatgagcacagcatttttccggcatacggcggctagtaggtggggcgagactacgggctacggaagaaatccgcgcgtgatccgcaggcggctgactgattggcg

SEQ ID NO: 35880 - DNA, 1664 bp, Heterodera glycines
  misc_feature (331)..(331): n is a, c, g, or t
  misc_feature (344)..(344): n is a, c, g, or t
  misc_feature (379)..(379): n is a, c, g, or t
  misc_feature (1242)..(1242): n is a, c, g, or t
  misc_feature (1264)..(1265): n is a, c, g, or t
taagcacgaaaaacacaatttcagcttgatttggattgtctagggatgacttttataatgcatatttttgtgcctattttctggattttcggaaaaatccttaataaaaatttaaaaaaaatgaaaagtacacccctaataaatgacccaaaaaaaattttcagaaaaagattgattccctaaaatataattttttcttgataaaaatttttggtttaaattttttttttattcgaaaaaacctttaaaattttaataacttcatttataattggaatatatgtaaaaattaagttttattgattatatttttatgtgtttggttacatanaaagtgttaattnaaaaaaaattaattttgcctattaattgcaatttncgcgatttttgtggctaaaaatggcagaatgcatttcctaatttatgaaaaaaaaattggaaaaaggaaatgaaacatggcctggaaaaaattttaaaaaaatattggatttttttttcaaaaaaaaaaaaattggaaaagggaaaagggaaaattttttatttaaaaaaggggaaaaaattggaaaaaattccgagaattttttcttttgtaaaaaaaattggaaaaaaaaaaaaaaaacttttcccccgggaaatgtttttttggggtcttttttcaaaaaaaaaatttgggggggtttttcccccccccccccaaaaaaaaaggggaaaaaaaaaaaaggggggtttttttttttttggggttttttaccacgggggggcctattataaaaagtgggggcccttgcggcccccaaaaattttttttgggggggggggggaaaaaaaaatttggggggggaaaaaaaaactttttttttttttttttttttttttttttgggggggggggggggggaaaaatatatcccccccccccccccaaaaaaaaaaaaaaaaaaccccccccccccccttttttttaaaaaaaaaaaaaaaaataaaggcgcccccccccccccccccccccgggggaaaaataaaaaaaaaaaaattttttttttttttaaaaacccccccgcgttaaaaatgggggccccccccaaaaaaggggcccccaaaaaaaattccccccccctttttttttttatttttcccaaccccccgaaaaaaaaaatccgatttgttttttccaaaattgaaccccttttttctttccccttgtcactggggcccgggaaaaggagaaatttttcgtcgcttngatctgcgggaaacagcgcatnnaataagcccaaattaaatttgattagaacattttttgtaagtctggcagaaattttggaaaaaaaaaagttagaccagcactagggtttccgagatagatgtacctttttaaacatgactcctgctggcccttccaaaattctgggaaagtacggtgcagaggatactgtcctttacaaaagtaaggccttctttctgccgctcaccgaaatcccgtgcgggatcccgtcccgcgccggtctctagtgtaaaatggtagccctgaaaaattttcaaaattttttttagaaataaaattcttttattataggtttttagggtcggagaatacgattatgtcatctagttcggttcatttcgaaccccgaactcggattcgaacatttttgaaaaattttt

SEQ ID NO: 35881 - DNA, 1267 bp, Heterodera glycines
accccccccccccccattattcaacaccgactttctccaattctttgattgcgtctcgtgccgtgccttccttttccgtgtccaatttggcacgtcggtccgcctccgcttttgcgtgtttcaccttgaaaagggtaccatttaaaatcccttttttcccatttcgcttttccatcacttcgttcgatttggccaaatcgccgcctccttcgccccttttttgcttcacgtctctgtccaacgcttccttcatcagtttggtgtgcagttggagcgcctgaaaaaattctcaagcaattttgaaagaaattttatttcctcccgctgaacttttattgtccacctgacccacatagacattggtaatactggagaattggtgtcccggcgaaaataaattaattatcacgaatctgacattaattttgagtaattttatcccggacccaaactcgaacaaagtcgaaattgaaaatgctcatacataaaaatcaatttttcgatattttgtccgagttcgggccgagattcggaattggccaaaactaaagtcatattcatgatcagcaactcccaaaaccccagaatgcatgttttcatgtttcttacataaaaatttattaaaaaaatcaagttcttgatgaaaaatcatagacaaatcaatgatttttcgaattctgagctcagatccgtaatcagcatatttttttacaccggaaaactcgaaaagaaaaattttaaatttatttttcgccgtgacaccaattctccagtattacctccaaaaattttctcatgccgccgcatttcgctttgtattctcacaatcaagcaatctccgtttaataaatatatcaaaatatttttttagagagcgaatttggcgcaataccaaaatccgaagtgactttcgacacgtaatgaatgcggtcgaagaggcgaagaagcgaaaggcggcggaagtgcttcgattaccgaaaagcaacagagaagcaattgcagcagtcgtaagcaatgaaagtgaggaaagcaaaatatcagaaaaagctgcattattgtccacggcatttttttcttttttttattttaaaaaatgtccacataatctccaataatattccttgtcagatgcccctttggctatcacagctggcgatggtgctgattttaccggcaatttaatggtcgccactgttccttcaaagcctcaacaagacaatgcgaatttgcgcgctttacttccttcccgtgccaatttgataaccaa

SEQ ID NO: 35882 - DNA, 951 bp, Heterodera glycines
caatcgcctttatacatcccattatgagcgctacaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtataagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgttcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaaatcgcatgtgatctaagcctagaaaaaaatggtcaagtaaaaatcgtaattacgctcaaaaagcttctcaaacaattttaacgcttccaattcctttctacatcgcctttatacttcccattatgagcgctaaa

SEQ ID NO: 35883 - DNA, 937 bp, Heterodera glycines
aaaatgtgtttttcgtgcatttcccttcgagttaaagccgcagaaaaaatatggaaaaacttataaatccgggccctattcatcactcaccaccacagggagttgttctcccttggtctgctacatcagcactgactactaagcaccagggatatggcattccgaaaggagcatgacaaaacgtcgtctaaactgcaaattttcaaaaatttttattcatgcacaaaaaaatctgggcaaaaaaatttaaaaaaactaggtttttgagttccttctggcgccataacttttttgaaacttaacgaaaatttttgaaattttgcaaattaataactaacacacagagctatcgaacaacaccaacaatgcttaatttgattgacaatgaacaaagttatggttcaaaaagtcttccgacgacgtttcggccgacgacgttttggggtgcaccgcattccgaggccccaaaaattttctgaaatcggaattccgagggtcaaaaatttttcggaagtcggaaatcggaatgttgagaaaggtatttgtagaaaaagtgggatttggcattctgttaaatgtcattttgattcatttgattgttcgacacactccaaagcagttgcgcatttacagcaaagtaaatttaaaatttaatttatgtaattttttaatttattaattcttatattaaaaagcagggcccggatttatatttgctaaaatacgccaaatattgaatttttattttctaaaaaagccttaaataattgcatttttaaatttaattgttcttatattattaataagattctattgcaaatatgtgtgactgacattttattattaatgatgacacttctcttctgtccggtataatttatattaaataattagttcaatattcattaatattttagtatgcagtacgacggaaaaa

SEQ ID NO: 35884 - DNA, 934 bp, Heterodera glycines
  misc_feature (24)..(24): n is a, c, g, or t
gctccggcttgaaacgccttaatncgggtttaatcccccaccattaaaaaaaagttcaacatttaatggccatacttcaaagtcacgaaattgtttttccctcgcttggccaattcgtgggcttggtatacaggctcgggcatgctcaccgcaacattgacaatctgacaatgagaatgcaaaatttaacggagaaaatagactaattgcactaaaaacggttactcttttactaataggccacacaaaatttcaatttttctcggagaatcggcatcaacattatttacctgatgcgagtaagacaacgccataatcactccttgcaattcgtccatgctgatgccaatctcatcctccaacatggcgtattctacgggtttgcccgttccctggaaacaaataaaaatttttttgtcggttaaattggatggagtgaaaaaacaaaaaaatttgcctgaatcggtgcgtggggctgaagaaagctgaaaatgcgtggattaaaaaccaaagcacaaaatgcgattaaaatttctcccttacaattccgtgatgtccgcgcgcgtcaccttctcttggattacggagcctggcgttaaattctggttgaacggacggccctcgcgtccctcctcctcgaggaagaactttttgaagtggcgcttagtaccgacaatcatcacaaactgaaaatgagtgtaattgtcataataaatatacatgctgacaatgaacagaaagtcgccccattttttatgaatttttttgttttaaataacccgaaaatttatttattgttcaaaattgctttattacatttgatataaatatatctatttattatttattatccatttattacctttggctgatagcgggagtcgtattcaacacagccctgtttcagtgcacgcaattcttccttgcatgcctg

SEQ ID NO: 35885 - DNA, 884 bp, Heterodera glycines
  misc_feature (58)..(58): n is a, c, g, or t
tatgccctttattcgttcaaaacagcatctttgctctacaagctttggattgacaagnccgatgataaatagctcgctcgcaaaacgcgtgcatgtttggaaagtatcgttcataccaataattgagggtttatttttaaatgaaattttatgataaaccttattatctcagaagctatttaattgattcgaatgtctttatcgcggttaattagagcaacgaaaattggtttgaatcgtgaagtttatcatttctaactcacttctcaaaattgttgataaattgcaaatatatattccaaaagtctgttgacactttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctatttaattgattcgaatgtctttatcgcggttaattagagcaacgaaaattggtttgaatcgtgaagattatcatttctaactcacttctcaaaattgttgataaattgcaaatatatattccaaaagtctgttgacactttctgaaaataaattctatactcatgtattttccacttattagattttgcaggcttattgctgcatgttctttgacacttcttcaaaataacctatgccctttattcgttcaaaacagcatctttgttgtttcgctttggattgacaaagccgatgat

SEQ ID NO: 35886 - DNA, 1341 bp, Heterodera glycines
acctggattttcctggatttttgtcaaggaaattcaggtccaggtccaacatggaatccaggtccaggcttttttcgaaatgtcgagctctaatttttagttttattgcattttgttaataattttgggcaaaacgccaaaatagttgaaaatactttctttattttgttttttaggtgctaaaattaaaaaaactagaaaatagttgctaataacgcgaaaacttgctaatgtaatagttagggctgccaattttatgtaaatacatatttttttcctgacttttccatgctttaaatagcaggaaaacactttcttttttgtgtttgcgaacaaaaactgggactttacatattttggggtttttatacatatttgtacatattttggatttttttcatatatattttcatttttttttacatattttgagtattttttatggaaatttttggaaatcctcaaaaaaaaatccaaaatttcggcaaatatttttgtacatattttcattttttttacatattttgaaaatttataaagaaaaaataagtttgaaaatgttgcctaaaaataccaaaaaaaaaaaagtagtttttatgtcattttgttgctatttcatattttacggggattttctttcccaaaaaataccattaaaaaaaattttatttacatatttggggttttttgtacatattttgggatttttcttacatatttatttacattaaacagcctttgcgacaagattagatagattctataaaacaaatgaatttacaaataatataatttgaagcatttaatgaggctctctctatacgaaactccaattttttgtttttttttgtcttaatgaatgaaaaattaggaaatgctattaaattgaaaatattacttccataagttcagcccattaaaggacattaatttttaaaatttaactaaaaaaaatattgcaataattgaagtgacaaatgatattttttgtaattgatgtctttaattttgccaataaatttgtaaatataaaacaaattaaattgatcattgcttcttttcactcatctcatttatcaaatgtgccgtcgttagcattttggcgttggcgtcgattcacctccgccggcctttgctgctgatgtgcaagccgcattagctgactgaaaatgccaacataaaccatgacgtgagacccgtgagcctcggtttcgattagagaaaatttttgttttttggctattaaatctcaaccgcaaatatcgcaataaatcatttatttgacattattttgataagttgtgccaaaattcttaagataaattgttgaataatttgtga

SEQ ID NO: 35887 - DNA, 587 bp, Heterodera glycines
ttttaagggcgaaaaaagtccaaaataagggcgaaaaaatcgcgaaataagggcgaaagtaaggacgaaaaagttccaaatttaggggtataattttttaaattgctctttttatatgaaaataatttcagattatggcaaacaattttattcactgattgcaggaacaaataagctatattttagaaaatttttcatttcttatgggtctatttttgaaaaatttagtgtcgattcttaggggtatatttttctgaaaattttttggtcgattcttagggggtatattttttcaaaattttttgggtcgattcttagggggtgtatttttcgtttttattgaatttttgttaataaatcttggacaaaacgacaaaataagggcaaaaacttattttaagggcgaacatctaaaatatggatttttaagggcgaacacccaaaataaggatttctaaggtcgaataagggcgataaaatgcaaaattttcgaacaaaaaatgtgtttttcgtgcatttctcgtcgagttaaagcagaaaaaatatgtaaaaacttagaaatcctcgccctattcataagtgattta

SEQ ID NO: 35888 - DNA, 844 bp, Heterodera glycines
catttcattttgtgctctttcacctgctctgcaagtcttgcactttgtagaacattaactgtcagggcaaaaaagttaataattaaatattatataaataattaagcatcatttattagatagataaatttggattttttaacttttattaatttgtatcattaattatgaatttccgtttccatttttgattttgaattaaagtttttttttaatatttttcctttttaatttttattttcaaacaatttgcatttcttttttaatttaaattttctcttttcacctcccaattcggctgcaattgcaattggtccccaaattcgcggctccattgcgaaaagatggcacacgcgcgtgccgagtcgcgtgccatctgcgcacattcgcgcatagtgccgagaaatgcttcgatcgctttggaaattggctgaaaataaaaataaaatatttttttaaatattttttttacataaattttctccttcaaaaattggtcaaattgcaaataaatttcctccttttcagccgaaattaagcccaacgattcgaacacagcagcacatttgctattaatctgaaaaatggggaaaaaaatttaaataattaattaaattggtaaaaattaaaaatttaattgcctccatcaaacggaaactgaacggttcgtgcagcaatttgctgatttcgctgaaaatgtctgaatagtcgcgggccggcaaatgactaagcctaaataaaataatggaaatttaaaatgaaataatttaaaataaaaatggaattaattaaaataattatttaaaggattttatttaaatataattaaaaaataataaataaa

SEQ ID NO: 35889 - DNA, 976 bp, Heterodera glycines
  misc_feature (26)..(26): n is a, c, g, or t
  misc_feature (923)..(923): n is a, c, g, or t
  misc_feature (937)..(937): n is a, c, g, or t
  misc_feature (939)..(939): n is a, c, g, or t
tgaatttagaaaatattatcatgccncggtggtacagttactgcttgaaaacggcgcagacccaaacttaccgggtgaaaaataattttggttgagattttctgtaattaatttgtcagatttcaatgactcgacgccgcttttggccgcgtgtgaaaatggagacgaaaaaattttggccttccttttggaaaaggtaaaaccacagatcattttgaataaataaaatatattttttaatttttttttttttgacgggatgataatgataattaattaatgataagcggatgggaaatatttaatttttgtgtctttcgaatgaattatccatcaaattcaataagcagtagagctcgattgaacgacctggaaatgaagctttttcgctcctaacttgggcctgagttttttcattttcgacctggatttcctagacaaaaatccaggaaaagcccaggctttgatccatggccagcaggtcgtgctctaacaatgactgcttctctcatttgtggtgtttgttctctgttaagaaaggcgacccttcccgttgcaacaaacaaggccaaaacgcattcacaataaatgcggacgaaaaactgcaaattgttctgaaggtgaggtgaaaagcaattgggaaacgtttaaaagggaaggaaaagcatttccattggccagaaatatcggaaaaaggattcggagttggacaaggtgctttgccagttggaaatgcagaaatattggccgaattttgcgagggccggaatttggtaggcaaaaacaaaaatgattatacatatttgttgttttttaaatctagttttattgggaaaagagaaaaatgtgaagaaatgataattacctaaataataattatttaaatgattatttttaaacgaataattattttttttcattanaaacattaattaangncaaatgactttttgttaggactgtcgatgcgctgctg

SEQ ID NO: 35890 - DNA, 665 bp, Heterodera glycines
ctgatattcttacggcacgcaacttggaaaatattttttcgggcatcaatgttataaattaaaaaatgtttatattacactaaaaccatataacatagccaacagaatctgctctttcagatgtgattaactgctattgaaaattatttttatttcacaaaattaaaggcgattttcgaaattggtcaaatttgatagattttgaggactcaaggggtcaaatgcacaaaaaaagttactcagctgaaattctttggcgtggcataaagcctcggttcaagtggtagctcatgtcagataatgaatggcctttttgaggaaatcaggaataatattttggatgattggaatttatgactggttcaggggcaatattttggctttcttctctatgtggcgttagattaaagagcaaaaagagataattaatactttaacaattaaacaataatagacaatctatatttaaaataaaatatttattgcattaaaaatgtaatcaaattagagaataagtttttaataatttttttttggtccaaaatttgacgttccaaaacttagactttcatcagatcactccttaatggtgatatggagtgagtaaattttagcccccaaatgaatgacttgaaaaacgaaaatttctaaaagtttatacgaat

SEQ ID NO: 35891 - DNA, 1111 bp, Heterodera glycines
cccctcttccctgcctctctctctactcccctcttccctgcgtctctctctactcccctcttcccttcctctctctctactcccgtcttccctgcctctctctctactcccctcttccctgcctctctctctactcccctcttccctgcctctctctctactcccctcttccctgcctctctctctactcccctcttccctgcctctctctctactcccctctctctaccccctctctctactcccctctctctacccccccccttttcccgctttgttttgccgtgccttcgccgcataaatgaatttgctcagtcgctttccgctgcccaagtgcaccgattggattcggtcttcggatggcaattggtaaaagaatgactcgtccccctgcgttcctcccactgaatgatccgtccctcggaagggctccggcaaagtgaaaatttgcgacggaaagtccaattgggcttcacttccgtttttttttcgttcgtttttctccaaatggcgtcggtttttggcgctttcagtggattcaccgcctttgtttttcaattcaaattgaaaaacagtgtaacttaagttgaacaaatgtatttagtcataccgtacccatgccaatggccgtaggcaaaaaaaaattatggagagagaattgaattacccctccccccggttatgggcctgtgcttctgccgccagtgctgtacctaccgtacccattatcgtattcggtaaggaaccaacgattgcctctgcgcattgcggttccccgacggtgcattttgcgcgtcacgagacgcggtgcgccaaatgaactgatcggagggcaaactgtggggagggcgggggagaggtggtggtacggtgaccgcttacggtattttgccttttcgcggtttttcttccgccggtgtcccttttctttcgttgtttttctttgtttggttcggttttttttcggtgtcctcggaaaattttgccctttttttcccaattgaaaattcctttgtgaacctttcatttgaaaacttttggaaaggtattttctgctaaacgaaaatttgagttgttttttgttgccaaatttcacctaaaaaaccccacc

SEQ ID NO: 35892 - DNA, 584 bp, Heterodera glycines
caacgaaaagatattcaaaaacttgcttttttgagtttctcaggtcataactttatttaaaattaatgaatttttttgaaattttgcaggataatacaaaacacttagggctatcgaataatatcaagattataaaatttgagtcactttgggcgaagttatgaaaattttctgttaaacattttcattttgatggtttttcgtgtaacgcccattttgatagtttatgagtaacgacgaaccagcaccggcgagactcccggctacggaagaagtccgcgcgtgatccgcaggcggtttatcggttgattgattgattggcgagggcatttcgggccccctcaatcaaccgcctgtggcgttcgttcggagtgattcctccgccctccgtctcgccccacggtgctatggagaattacgaaaagtgcaagtgattaaataatagcaaaatattatttgaaatattttaaaaattacaagcaaactaattatttaaattaaatgaagaattaataaaataatcaaacatatgaaaataaagtctgtgaaacacttgtttagataaaaccaaacatctattaaaa

SEQ ID NO: 35893 - DNA, 845 bp, Heterodera glycines
tgcgattttaaccattttttataaggattttcggggccatctgaaactgtagcttttacaaatcggattttgatcaaaaaatttgtgctcataagaacattataattttattaaagcatgcgccaattgaaatgtgaagggtatgccaaaacgaccaagtccaccttgaaccagggatggagttccgaggcactaaaaattttcggaagtcggaagtcggaattccgatgccccaaaaattttcggaagtcggaagtcggaattccgatgccccaaaaattttcggaagtcggaagtcggaattccaaccccaaaaatgtcggaagtcggaactcggaagtcggaatttttcaaaaaaaaatataataaatttttaaaaatatttaataggctaaatttttaaatttttaaccatgtaaaaggtaatttcaaactgtttttagtttatttctatattttttaaaaagatcaaaatattttaagtaattttacattattttggatttttttttttttgggaaagttacaccctttttttgcggcgcgctttatccaaagagaatttgagaaactgtggggaaggaagggtccggcggtgccgatatgcgccgccgggaaaaattttgtaatttttaatgtaaattgttaacaaattttgtccaaaaaatggaaaatttagcgattttgagcaaattttcaataaaattaagttttttttgagtccggcggtgccgataggtgccgtcggagaaaaaattgaaaatttctatgcaatttattaacataaattgtacaaaaattgctaattttttgaaaaaaaaaactcagagaaattccgacttttc

SEQ ID NO: 35894 - DNA, 1021 bp, Heterodera glycines
  misc_feature (888)..(888): n is a, c, g, or t
  misc_feature (902)..(902): n is a, c, g, or t
aaactcacatcattgacaccaatgccacaaatcctggagaaaaaatgggcaattttaaattttgaaatgccaaataaaaaagggcacccacaaaaatggcatttatctgcatcaaagagtttgttcggtggcccgcaattgtgcagacgccaaaggtggaagtgacggacagcacggggcaaaggcaaatgctggcaaaaaatggggcaattttttaatttattattaaattaatttaaattactattgtcagggaaacatttttttggtatagccgcagagccaattggtcggccggtgataattgaaaatttgtatgtatatttttctgaatttcggcctccattttttgtaactttgctcaacctgacagcgaggcaaagatcagtgagaagatcagaaatgcgatgggataagtgccgacgaaacggccaaaaatgcgggacattgtgctcagtgtgaactgctccaaaaagctgagaaatttggcctcctttggccctaaagaaatgaaatttgagccaaatatttgggaatagaaagagccctcagacttaaatttaaaagaaaaggaaattaaaattttaaggcattttctttagcgaatttttcaattggcggtgccaattttcatgctcagccccaaccattttgccacaacctgctgctccctccgttgtcattaatattgtggttctttttaatcaaatcaaagtgatcggccaatgacagtcagcgattgatcagtcgctgggccaaaaagtgatcagcaatagaagatatggccaaaagtgatcggcaatcgaaaaagagccaaaaagtgatcggtaatgaagacatgatcgataaattggtcgatcgaagtcagctaatgacggcagagccaanaatttgatcgccgntgatttcttccagtttgatcaaatttttattttgttgtctttcgggctgttgtttcgcaaattaccgcaggtgaaccaagccaaaatttggccaaaaagaaaagggggaaatttgtatg

SEQ ID NO: 35895 - DNA, 1149 bp, Heterodera glycines
agtgaaaattcgatcactcatattttttgctcctttagcagaagcgtaccaaactttgcagggatactccccggtaaaggactaacttacactgaaatgagcgccgagctagctggctcaaaaaaattttcgaaaatctgagtctttacgtttttatttgttttttgcataattaattcataaatatttttttcgcaaaatgctcatgaaacgcaccaaattttatttacatgctagtttaggcactctgatgctttttctatcaaaaagggagatgaataaatttttaaaaatttttaattcctttttaaacaggccaaaaagtttaggcttatcttttttttcacaaacttatcagaagcgccccaaactttgcagggatactgaaaggaaaagaattagcctgttttatcacattagcttgtcatcagtttttataaaaaattttcaaaattctgagtctcctattattttatttatttttcgaaattttgaagggcggggggagagggggtgtccaccaacgcatcgaaacgtggcgaaagaagtgccaatttgaggccgagttgaggacggtcaaaggatgggaaaatgtccatccaaacgtcgttgcaaatccaactgaaatgggaaaacagtttagtcaaataaacgacgaatttgtgacttttaatttaattaccgtcggttcatttttggcagcaattagcacaatttggacgagttccgaatgatgtcacacaaatagcagaagaattaattgcgttggaaactttatttttatataattagaaaagcggaaaactaaaaattctaacgaaaatcacattttatccaaacaacttttgaattttgtttgccttaaattgttgcaaatggaccagaggggttggacaatatgccaatgggagacgaaaatcattgacaaaaagcgagcagaaaaagggaatgtcagtgctttggaataagaacgaaaataatcataaaccactaaaataagtgcaaaaacttatcattaaggacgaacctctaaaataaccatttttaatcaccaaacaccaaaataatcttttaagggttcaaataagtgcattaaaacacaaaattttcgaacaaagaatgtgtttttcgtgcatttctcgtcgagtt

SEQ ID NO: 35896 - DNA, 548 bp, Heterodera glycines
  misc_feature (9)..(9): n is a, c, g, or t
agcagaagncagcggggattccagcagtgattttaggcctttgaagggaccataagaaagcgggacggagccaagttgggcggagatgccgaattgagcagtgccaagttgggcggagatgccgaattgagcagtgccaagttgggcggtggtgccgtattggtgcaggagaggagttgtggcggaggggaacagtagctcgttgttggtcgtgggcatgccgttcagcgtcaagttgttggacgagttcagcgcttgttggcacaaaaagaggttggtgggatggtcgaacggtcgacgaactgtgagaaaattcgaagcaaattaagcttcgacagtttaagagacaaatgaaatcattagcgcaaaacttacgcgtcgatgaagcagagcatgccgacgacgacgaagtggccgagtcgcgcatgccctgaaagaaaagtcatcaatcgtagtctgtccgtctccccatttccatccccggcattgatttcgcttttcgtctcaaaatggtcatttgtttcgccactgactgtgtatgtccccgt

SEQ ID NO: 35897 - DNA, 1208 bp, Heterodera glycines
  misc_feature (103)..(103): n is a, c, g, or t
  misc_feature (128)..(128): n is a, c, g, or t
  misc_feature (137)..(137): n is a, c, g, or t
  misc_feature (143)..(143): n is a, c, g, or t
  misc_feature (160)..(160): n is a, c, g, or t
  misc_feature (165)..(165): n is a, c, g, or t
  misc_feature (177)..(177): n is a, c, g, or t
  misc_feature (245)..(245): n is a, c, g, or t
tctttccctcttccactttctactcctcttccactttctcttcctcttccactttctcttccactttcttttcctcttccactttctattcctctcttacccnttttaaaaacttggacccaaacccntctttactncacccnaaaatatccggacccanttttncccaaatacccnaattcttccaatcctaaaattaactcattttatcatttatttattatttaaatttttattaatatttntttatttttaatttttattcaattaattttaatatttaattgttactttattattctattaattaaattttaaacaaattcccaaaatttctttgttcccactcaatcctttttaatttttttttttaaaatttactaataaatataaatctttaattattttaatcaaattggccattttttctttcatttttactaatttattaattgttcctttatttaatttttttgcctgttgtttcgttgccaaattattctcatcactttcgtgtgatgctcgttttaaattctaaaatggattattttaaggcgtatatttaattttaatttttattattttgcgtttaattttacattttatttttattttcatttttgttttaattttacaattttttatttttcatttttgttttaattttacaattttttatttttcatttttgttttaattttacattttctctttactttttaccttattgctttggttggaaggccaatttaaaatgtgtgtgctttctctggggattttttcaccaaattcttttatttcaacttttatattgagatggaattatttcttctacaatacatatacaatatatgttaccatctgtaattaccctcatgtcctgtgtgatgtccgctggaactaaagatgggggtgtgtgctggcccatcgtcaggacgtcagaaggacatgtattgtcaaggagccgtcggatatcagccggtacaagctactcaagtgtcgcccgtctgatgtgagttaaaaaaatgtgtatctcttcttttacgatggacttacgcacttgtcaccagggccctcccggaccaattgtttcggagggagccaccggagcagatggagacaatggacacaacgaaaaggacgggcaccacgggagggacgcacaaaccatcccaggacctcttgaaaagccatgcatcgtatgcatt

SEQ ID NO: 35898 - DNA, 990 bp, Heterodera glycines
tttgcctccgttagatttgtggcatccgtcgcgcttccgcccgcggtgcaaagtcgcaaattctttgccgaccttcgcccgttggaccgaattttggcacgggttgtgcgtccgggtgttgccgtgctccacgtggagttggtgtgcatgttaagccgttttcggcgcactttgctcacctttatgaagggccgattggtgcgcgcttttctcttttttttgcagtttctgcgaatttttggggaattcctgcacattttgttctaactacgaagataattgaaaatctggcaacccatttgattggttgtttttcgctatatttggtttttgtgtcgagaaaataattgaaagaaacttttttttttctaatagaaagccgaagcaattttgaaggaagagaagcaatccattctaaaatagctcattttttggcttttggtcaaaaaatataacaaatacacgagcaaactggtaaaccaaaccaaaaaattgcgaacattagcttttcaaacaaaacaaaatgcccgaatttcgattattttaaaaggaaaaatgggcggcaaatgacgcctttttaagtccgtacttttcacaaatttctttaggtccccgtcccatttgaccggaccaagcgcttttacaacatcagcgactacataagcagtaagtgtttggtggtctctttcctctctcctttctgtgcgccggtgcggttgggccccaaaatttcgtttcccccacccgtttgagccaccgtcgtgtccattgcgcccgccagcgaaccatttagccgttccaaactgttgtttttcttattttatgaatattcaattttatatatttttcatggaggagagatttttccaattttagtgacactttcaagaaatacttggttttctacgtatttaatgactttttgaagccatttttggatctcattgatagtaactaattgatttttttataatataaaataactttctt

SEQ ID NO: 35899 - DNA, 1046 bp, Heterodera glycines
tcggtgagcttaggattttgttgtctcatctgactatatatcgtcgtcttttccatttcgtcagcaatcgtcagaattttgtgctgtaaatataatttcaaatttgaaaacaatggtaaagttctaaaatcgagtgaaattactcaaatttaacctcttttagcattttgtttactgcctaatgtcttggttcataattcaattgtcgtataattcacataaaaagtttgtgtaatttttgcataaaattctttgtattccttctgtgaatgttttccatttagcatgaattctttttttatttttaaatatttctccacaatttctctttttttatcatcaattttttgaaattttataaatgttcctcattgtatttttttctttcaattatgaatacttgtaatagtgatgcgcaaactttcacctactatttttgtcagtttcatccttcctcattccgatccgtcgtctgatctcgtccatacgcattcgcgacctgctcgcttactcacgcaaagtggagaaagacatgttcgaggcggccaacgacaaggaggcgtactatcacatgttggcggagaagatttacaaaatccagaaggaattgcaggtaaacaaatgcgagggaatcaacgcaatgccaaaaatgtttttcaaaagcgatttttgggaggcataaacaaacttttaagaattttatttcataaaaataaatatagaaattttttagacggagaaaaattcttttaaaaagccatccaattttattttggatccaaccttcaaaatgaccgttcgtgttgcattcatgggctgttcctatttttgcaggaaaagaaaaaccggaggctgaacgagcagcaacagttggcacaacaacaacagcttcagggcaaatcgtccgctgaccaacaacagtcgctgttcgatgacaacggcgccggcctttcccaccaactcaacgccatgggaatacccatgtcggggccgggctcatcttcccagcaacaattttggagtagtgcagcagcaaatgccgtttt

SEQ ID NO: 35900 - DNA, 934 bp, Heterodera glycines
  misc_feature (870)..(870): n is a, c, g, or t
ttgaatatttttttccgcgcatctttcgatttggcattgtattataaatcgaattcattcgaaaaatatttggaattttcattaattcataattaaatttgttcaaatgaattctttctgatgtgtttaaacaatgcatggttcttcaccattaacagaggctaatctgtgcatgaaatttgagtcttctttttcatggaaggattgggttaggtaaaagctatttttatataagccgtcaaaatcaaaatttgctcaggttacgtgacacttggaatgccgttgttacgtcgcaatcgcagattcacaggcattctgaacagctcgacaaaattgtttcggaggaaagcagttacagaaattatgtgctgcgttgcgcactgaccccaacttaattattattttaggcatctgacattcaaaatcgacaaattatgatccaaattgtggaaagaaatgtgaacaaagcgagggaattggtacgaacggcgcgatatcagttgaacgctttcaattcggcgctgagtcaaagtgaaaaaccaatttatgtgcaaaggaattgaaattttatcggtttgatttgtaaagtgagtgcaatgtttaaatcgcaggaagagagcgattcccaaactgagcacggaatattggagctgaacaaccaaaacgccgaaatgcggtcggttctgaaaatgtgtgaatgaacagtgaatggtttcggacattttattcgcaaaaatggcgatatttgttagggcaattttaaatgtggtatcattcgcgggcttaatttgaccaaaaagccgttttatcagccgatatgtgccttcggtgaattcttcgcccgttcttattgaaaaagttggaacctanaaagctcttcccgtgcccgtcctgattgtcttttttcccttcatttcagcttggagttgagccg

SEQ ID NO: 35901 - DNA, 1149 bp, Heterodera glycines
  misc_feature (12)..(12): n is a, c, g, or t
  misc_feature (25)..(25): n is a, c, g, or t
  misc_feature (1081)..(1082): n is a, c, g, or t
tcggtgagcttnggatgtgtttttncatctgattatattcgtcgtctttgcattttttcagcaatgtcaaaatttttgctctaaaaataatttcaaatttgaaaaaaattttaaagtttaaaatcgagtgaaattactcaaatttaaccttttttagcattttgtttattgcctaatttcttggttcataattcaattgtcgtataattcacataaaaagtttgtttaatttttgcataaaattctttctattccttctgtgaatgttttccattttgcatgaattctttttttatttttaaatatttttccacaatttctctttttttatcatcaattttttgaaattttataaatgttccactttttatttctttcttccaattataaatacttctaatatttatgcccaaatttttagctattatttttggcattttgtcccttttccttccaatttttcatttaatttcgtttttaatttgccatatatttgatcaaattgctttaacattattcttttttcttcaactgaataatttttgttcttcatcattccaaattctcttttccatttgtaaattttcatttgatttgcacctaattttgtggcaatttttctttcaattttattccattcttttgttgaatatttctttcccatttgcttaattttctcttttattttatggaatttttcaacaatttctctcttttgtttatcatttaaaattggaatttgatcataaatttgtccactattttctgtcatttgttccaattgatcacaatttgtggacatttcttcacttttctcatctttcatttccaaattttcatcaaaaatttgattagattcttctacaaataatctttgcacaaaattttcaatatttgttggtccattttgatcattcatttgtccatttattccattttgatcagtttcattctctccatttttctcctctttttcgtcccatctttggccaaatatttcgtcaaagtttttttcttcttttattccaccagcataaattttatttagatttttcagaattaataagaaaataatattatnnttatatcattttataaaatgaaatgatatataaatccattttataattgcttttatctcattgattt

SEQ ID NO: 35902 - DNA, 974 bp, Heterodera glycines
agttgcagtcggtgtctgtccaggtaaaagtactgtagcctctaattacgataccaattttcaattcaatgaggggattattactatatgattattttctgtcaggaaggcgaacggttggaaatgaccgccattgtcgggggagagcccaagccgaacgttaaatggctgcttaatgagcaggaaatggacgccgtcgacaaaaatgtgcaggtcttttttatgaaaattcaaatgatggcattgaaacggtagaaatccaacgaagatacggtatctgacccaaaattgacctaaagatcacttccggacccggcggtcgccaaagtctgcgaattgggcagacaaacgctgcgcaacactccggccatttgatggtacgtgccgaaaacagcgaaggcgccgccgaatcgtcggccgacgtcaccgtacagccaaagccgggcccaccgtacttcagccgggaaccccaagaccacgaagtgtccgatggagtggagtccgtcaagttcagtgccattgtgcatggcaacccggtgccatcagtttactggcgagtcactctcattatttaattgccttgataatgaatgctaattaattttttgaaaaatgattttcattaatttaaaacaataatcggcaggtatctgaagggcgaatgcctcgtcagcggggacaatttgcgcgtcaaatatgacgcggtcagcggcaaaacgtccattcggctgttccacccgaacacggacgactcgggcgaggtgaaagtgatcgcccaaaatgtgcacggacaggccgaggctagcgcaaaactgaaggcaattgaaaaaacaaaattggaataaatatgggcaattaaaacgcttaattactttttcatctcataataggcacagattcacaagagataataattattaaaaagacttaattgtttattgttaattaattttcttttgaatttaattgataaa

SEQ ID NO: 35903 - DNA, 1285 bp, Heterodera glycines
  misc_feature (27)..(27): n is a, c, g, or t
  misc_feature (93)..(93): n is a, c, g, or t
gtgtgatctttttgaataccatcgctnttcgccgtctgcgccaattggccccgtcacttctcaacgattgtccatcacttcgctttgtctctntaaaggatgccattctgcccgcttttccgcccgatgaaagtgccaatgcgtcggctggccaagcgatgaccaaatggttgttcacgccttgtccgaatggtgtgccgaagtggctccaatgttttgtgaattcaccggttggtcaatggtcgtcaatgatggaacagattaaagcggtgattatccctttttaattgcttttttctatgattttttgtcccattttaggcattttccaatgcttcttcggttacttttcgcattcactttctgctgtcttctccgattgactctgttgttccatttgttgatcggatcaacgaagtgactggggaggaattggcacttcaacaatcaaatggcttttggctcacccgttgtccaattggatgggataaccgaaattgggataatgtgtgggaagaattaagtgctcgacagaacccaattgacattgtgatcaatagggatcggattagcggattcgtgttgagtatcctattgtatatatgcatatgtatttttgtatcatgttttgtgccgcatttatgatcatctccacacatttgatgtacctattgatgtatttgtatgtgctatgtatatttcgttcacatatgtctgaatgaattgtgtttaaagaatgaaagtgttcttgtgactataaataagacgaattttgagtaaaaattgagttaaattattttctatatacagtgtgtaaatttagaatagggacgactgttttttcgggagtttgacttgtcggaaaaccgatttcgaggcccccacaaaaaagaaatgtgaaaaatgaattttcataaaaattctttcagtttttcaactttgtctgcggcgattgttggcttttggtgttcgattttcttgtgccttctcagctcggcctcgaaattgcactgatcaatcgccgttttaactgcatcgtcgacgaacacttcaaaacgcgcaaatggaaattgggcggaatacgaatttggcacaaaattggagagaatggcaccaaacaaatgcaaattgtcaattccgatggaaatccattgccaattccgcaaaatccgttgccaaacaaagtcatcggattagaaggcattacaatcgcgtaatgccaatgtttcgcgactccattgttgtgatgtttttgaataccatcgcttttcgccgtttacgccaa

SEQ ID NO: 35904 - DNA, 1006 bp, Heterodera glycines
  misc_feature (953)..(953): n is a, c, g, or t
  misc_feature (958)..(958): n is a, c, g, or t
tccccaatgggggccccattttgggtccccagccacagccccatgcttctcccaattgtggcgaaaacaatatttcacatttcacttcataactttttgagttcggcagggatcgagaccgggataagaccattggaaagaacagctcgagctttacaagaagatatggaaagaaaaaatagacattccagggactttttcagaaatcatgtttaattccccaatggggccccattttggttcctcagccacagccccatgcttctcccaattttaagtcttggatttgtcaaataaattaacgatttcgaattaataataaaaaattctattataaattttttttgtagaggggaaaattctgaaccaaactactatttgaaaacccaatcaaaactgggaaaaatttgaagtcaaaaaattattcgaatttctccaattttgtttccataatttccgaatgttattcggtatcataatgccaaaccaaaacgaattcgttttaaaatattcttttctggacttgacttggtttctcaatatcgaagcttttttctccgcaatttctaaaacgcttataccaaaccctagatttttggttccgatgggtttcagaaaaaatcccgtgtggtgcaaacatatttcacatttcacttcataactttttgagttctgcacggatcgagaccgggataagaccattgaaaagagcagctcgagctctacaagaagctatggaaagaaaaaatcgacatttcagggactttttcagaaatcatatttaattccccaatggagccccattttgggtccccagccacagccccatgcttctcccaattgtggcgaaaacaatatttcacatttcacttcataactttttgagttcggcagggatcgagaccgggataagaccattgaaagaacagctcgagctttacaagagatatggnaaganaaaatagacattcccagggacttttcagaaatcatggttaattcccca

SEQ ID NO: 35905 - DNA, 1518 bp, Heterodera glycines
ttttttaaaattttctattaaaaaaaattaatacaaatatttgagcagaatattaactgcagccagaacttcaaatgttttagcatttttcctaaaacctttattagaacggccccaacagctaaattggcgtttttgatacagaaacaatcattttttagcagaattatcttgagactattgaatatattaaattttattaaaaattggtaaatttatgtcaaaaataagcaaaaaggcaaaaatttcgcttttggattggtattttttattaaaaattaataaattttagctttacccaatttttttttcttctaaacaaatggcaccaattaaatttttaaaaatgccaaaaaaacaatatttggtaaaaaaaaaatctaaatcagtgagaattaattaaaaatttttcacattttgctggttttcttagaattttctatcaacaaaaaaaattgcatacagtagtaacattctactaatgtacagtatagtatgctgtaacccactcactgtgttccgtatccataaaaaagtgtcttaataggtgcagaggtaccaaatggtattttggtatttctattcattttgcatacagtaacattctactaatttatattattcctattcattttacatacagtaacactacaccatgcatatacagtagtatgctgtctgtaactcactgtgttccggcgggtccggatttttgtactgttttgccacccaaatgctcatttggttacggtcccattcgtacagtttcttcttctcccaatcgtacaacaatttgcccactataccatttttgcgctctacggcattgaaaatgtgattgccaaatgaaaactcagcgcccttttcggtcttatcgaaaatgtcacttaatttggaaattgcatttttaaaattaatttcttccattgaaaatttaatttaaaaaaaaagttttgaattaattaatttaaattaagcaatcatatgtaggcatagaattcaaaaagaaaaagtttcatttagaaaagttagtttattttggccattaattaaaaaattcaaaatttaaataaatataataattagtgcttacttttttgtgtaagaaaaatcgcttattatgtataaaaaatgctaaaatatgtatgaaatatgtacaaaaacccagaaatatatacgaaaatatgtaaataaggaggccctaataaaaataactcaaaaaattttaaatttttttagactttatagttttttcttatttttaaatacttactttttaatttttcgttttatatccttaaatgctttctttttttgtttccattcctccattgcatttttattcttcgtggcccaaatcacttgaaaatattcctgtttggcgtgctcatatattttttccgcctctttctgctcattctttttttttaaatttgacgaattaatttaattaatttcggatgtaatttttctttaataaaattatttttgaattttgaatgaccattagaggatccc

SEQ ID NO: 35906 - DNA, 914 bp, Heterodera glycines
  misc_feature (880)..(880): n is a, c, g, or t
  misc_feature (882)..(882): n is a, c, g, or t
  misc_feature (885)..(885): n is a, c, g, or t
ttatgaccataactaatttcctaaagtaataaaatttttcgatattttctaggttatcactaagaatacttaaattgatataaatatttttatggaagtgcaaatattttatgaaaaaagtaaatagtttttttcattttttacaaaaaaaaattgagcttataaattgagcgaattctagcattcttttttgtctccgtgcttgcattagtccgatgaaaattaaaaactcgaagatatacaaaagctttgttaaaaccaaaaaaatgttttggttattttttaaatatgttatttaaccattgttttggttttatttttgccaaattttttcaccacagttttctcaaaaacaaaaattaattgtcttttttaacaaacagtaaagaaacattttcagcaatagatcatccatctactgagagaaaaagtcaatacgaagattatgtagaataatttaaaagactttaaatttaagaatttccacgctaaaaagatgaaatttcatgcattttccgtgaaaaaacgctatgggaagaacaacttaaaaatattattatatctataaaatccaggccatcttcatctctccttcgatcgcttatcacccatcatcatcctcaccattcatcatcttccacctcatcattcatgtcttaataattaggttgctgtccctactgaggttgctgttcctgattctgttgttgctgcagttgttcctgacggaggcgttccgcttcctcttccttacgcttctgttcttcctttctctcacgctcctcttcctcctctcgttcctttgcatggcgtgccacacgttcctcgtccgattcttcccactcgttctccttctcactcgtgcaaattcggatgtccngncgngtacggatctttgacgccgaatgccttgc

SEQ ID NO: 35907 - DNA, 963 bp, Heterodera glycines
ggaagtgaggcgatcaaaatacataatgatagagaatgtgtggtttacctgtttgaagctaagtcggggatctgacgtctaatatgagaataaagtgcagttctctctttaaacgaactgattttatggccactttctataaaggcgatggtggtcgctgtatgaccgtaaacacagttttttgtatagaaaagggttgtccaaattgcaaatggatacagtatctgatttatttcacaacgccaacacgccgtttaaaataaaaacacaagttgcatgtgatggcaaaagttgtgaaattcaaacgcattttacgcccatgaattgccgggaagtgaggcgatcaaaattcataatgatagagaatgtgtggctttacctgtttcgaagctaagtcgggtctgacggctaatatgagaataaagtgcagttctctctttaaacgaactgattttatggccactttctataaaggcgatggcggtcgctgtatgaccgtaaacccagttttttgtatagaaaagggttgtccaaattgcaaatggatacagtatctgatttatttcacaacgccaacacgccgttgaaaataaaaacacaagttgcatgtgatggcaaaagttgtgaaattcaaacgcattttacggccatgaattgccgggaagtgaggcgatcaaaattcataatgatagagaatgtgtggctttacctgttttgaagctaagtcggggatctgacggctaatatgagaataaagtgcagttctctctttaaacgaactgattttatggccactttctataaaggcgatggcggtcgctgtatgaccgtaaacccagttttttgtatagaaaagggttgtccaaattgcaaatggatacagtatctgatttatttcacaacgccaacacgccgttgaaaataaaaacacaagttgcatgtgatggcaaagagttgtgaaat

SEQ ID NO: 35908 - DNA, 1051 bp, Heterodera glycines
  misc_feature (51)..(51): n is a, c, g, or t
acaacccttaccaaacggtggggcgaacattggcaaaatctcccacaattntggcttaatcaggtgataaaaatcatgggacgcactttggccccattcgctggccatgaccacggcatttccgtgttcggattcggcgactcgaccaccggcgattggacggtcttctcgctgaacgaagagaaagactgtgagaatttggaggaggttctcaggttagtcggcgaattgctgacaaaggaagttcgtcgcgttttcagcgtgtacaatcgcatgactccaaacatcgacctcagcggaccgaccaatttcgcgccgctgatttaccgcgccatggaaatttgccaacagcggagagacgtgacaaaagcatttataatcaaaagtaatcactttgtttttcagtatcacattttggtaattattgcggatggccaagtgaccaatgaaaaggccacggtgaaggccatcgtttccgcgtgtcaatttcctttgtcaattattgttgttggagtcggcgatgggccctgtgaaaatgatgcgggtcgatcaacaggccaattcagtccattttcaataattttttaagatttttgatgagtcattgcccaaaaggccgtgggacaactttcacttcgtggagcttcatgaactgatcaaccaaagggctgatcagccgattgagtcgcgagaattggcatttgccgtccattcacttttggaaattccggaccaagtaaaggcaaaacaacgcattgtccacggcatttttcattattcagtacgcgaccattcggaagatgggtctcttgtcatcgaccgcttttttcactcgtcctccttctcattcgcctcgtcggtcaaaatcgccaaaagcggcgcagaaaatcaatggcacaacagcagacgacgagggggcgcaggagaaggagacgaactgttgagggggaaagagatgagagagacgaactgactgatgacatgcgaggggggaagcccttttttggtgtgcattgcacccccatatccttttccttacttttttctcaat

SEQ ID NO: 35909 - DNA, 897 bp, Heterodera glycines
  misc_feature (831)..(831): n is a, c, g, or t
tgactataattttaccagtaaacttttagatattttcttcttgatggttttcaatagaaaagaacgattacaaatttctaagaaaattggtaagcaaagagacaaagggaagagattgtccaacaaaaatgtgaattggcgccttggtaaacaaaatcaatttgcttaattatctgctaattagttacattttttgtcagtaaatttggagaaacggaagcaacgcgaaaggcaaacaattgaagaatatgaagagaggaaaagcaacactaacaaggaggaagaagaacatgtggaagaggaggagcagcaacatgaaaagcagcaatccgattcgaatggcgtggcaatggaatgccaaagtgaaaaaggtgggaggagggcgacggcacagtgccaatttcagatattggatttaaataagccattaaattgtctcggcgcttgacaatgtttttttttttgggaacgacacgaatgataggatcgttgtaggaaaagagaaaatcgtggttcatcattccattttagaaggttggtattcgctgactgttgcgttgccgggcacaattttggacaatgttcagacgtctgagctcaaaacctatctgagtggagaggtaaaagcacagtttaagcgaaggtgacttaattggccactccgtgttaagctgtccagggcatgcgccattttctgcgtggacgaagtggtcgtttttgacgagacagcgcaaatgagccaaagggacgtcgacacatttcgggaatggaccggcaaagaacaaacggacgcacggagcagcgaaagtaagcgaatcggaggggcattanatggggcggtttacttgcaatccgagacgaaattgaggtgtgtttttcatggcgcgaattttggag

SEQ ID NO: 35910 - DNA, 437 bp, Heterodera glycines
ctttttcaattttttagcaaaaactatttcgaactatcattaaaaaaatttcttatttaatttaaaaatgagtttttccaatctaggtattcgttttttgttaaaaacgaatatttgctgtttattaatttttagcttgggaaaaaataagtaatcaaggacgcttatttcgtacttttgtgaaataataataaaatcaacattttgattttggcacaggaaatggtcatacttctaaaaaattatttatccttatgcgacatatgattatttccagcacaattcttgcttggcatttcttcattcttttttggtcataataactttcttttcgtggttttctgatttcacttatgtttataaataaatgtttggtctaatgatgcgtcatcgctttggctcaatgggagattttttgaaatagcaaattatttgtg

SEQ ID NO: 35911 - DNA, 1128 bp, Heterodera glycines
tgacgcatggaaggcgcgagtaccgtagacgcatgtcatattttgcgcataatactgtaccagatttgtctgctggttttggatggtgatgatcatttcgctggcgcatcggtcggtcagtccgaaaacggcgaaagtcatctgaattcgaagaaagtgaacggcggaaatcgatttcaaatacaagaatgggatatggtaaaaggattaatggcccgtgtcctactgtacagaattcggtggcaagtagacatagaatgtcaacgcgcaaaaatgccaaaaaagacaaataaaagtggcataatccttcattcgacttaatctatttaattttaatcagtgtataacattaaaataaaaaatgtttatataaaaatcgttaattatacaaaaatcagaaaaaatcgatcttttgtaattagctaattgttttgtacagataaccggctggctatggctacagtattatcaaagaaaatagaaaaatcataattacaattttttaattattaagaaattgtcaaaatttttttggtatcgcatataaaaaaaaactttggtgatcaatatgtatataattttacattacctgactttctggcaaatgcacagtttgcacagcaagacctgaaatttttggtaatttagcaattcattttttaaaatgaaaaaaatatatttaatggacatgtaaatttagcacccattcacctttgatctgtttgacgatggtccgcaccttcgcgggctgtgagaaatcattttggatgtaatcagggcgagaattgagaaatcggcaaacaaattcgataagatcaatggccgggaagaaggccgatttctttgctgaaacagaaaacaaaatatttgtggaatcttttatggtaatgttaacaaaactgaaatatcctaattcaaaaacgtcgggacgccaaccgggattagctccttaatccagattttacaagaggaaaattttgccatagattttgtgccaggatccattttgacaaatttagatatcatgggaatgttaccatctaactgaatgatggctttgctctgcaggggactgtcgccgacaaagcgcacgttcttctgcatgccctccttgcaaatgcgcgggtc

SEQ ID NO: 35912 - DNA, 1651 bp, Heterodera glycines
  misc_feature (71)..(71): n is a, c, g, or t
tttgccttttcaattgattcgtatttctaaataaaagtaatttttgtcgaattgggtttaggcataatacnccaaccaaacccaaaaccaaataaagtaacaaatttttgaggtttttaagatcgtaaatcacaaataaaattggtgcttttgacatgacaagttaggaaaattatgtgagtgagtttaaaggaattttgttcccaataaattgttcgtttgtaattatgtcgggggattttggtggatattgacaatgaacaataattagtcgacccttttcatcaagtatgtgtgtccaaatattgctaaaaatccgttttgatttgatttcacctgttgttggactggaaaaacgtaggaagaaaagagcaggccgaggttggactcgtccattttgtttttgtcggaatgagccgacactcttttcaaatggatcagtaaacattccaaacattgcttatgcgtttcgggtatgaaatagacgagaatttgcagtgctttcaaaattcggtcgtcgctttcgcctggcgcaccgtacgaagtgaccattcctaaaatgagaaccggacaattgaactcagtgtaaaaactatgcaacagtcaaaaactgaattggtagatacagaattatcacaaattttttttatacatattctcttcgatccttttcacatctgtcagtggcataccttgtgattcctttgccaatcgaatatttcttttttcgattattaaagatggtttgccttttaaaacaaaaaatttttctgccaagagggtgtgaggaaacttggcaaaattaccgaatttttttcaaaaaaatcctaattcagcaaaaataacatggcgcccaaaccaaatgcaacaaacacaaacccagaaaggtcgagcagagcaacacgttgacagtgtgggaaaagagtgtcgggcattttacgcaaaagagttttaatgcaagacgccttatccgtggcattcaactcgtaaatgaagtaaagtttctgaaatattcggattggagccaggaatgtacgaaattgtgtttcgtccttttttgacattttttctcgctttcgtttaaagtttcgttttccgttacttggtcaattgatttttaaaatcattaaagaccaaagtcaagtattaaacaatctttttttaatctttaaatttagtcatttttgaaaataaatttttaaaatcttgacaatctttttataatgagattttgtgaggatttgagagcatagtcttattgttagctaacataattgtatgtaatttgctgagagctccaaaaataaaaaaacaaaccaattcccgtcccttggcattttcgataatattaagtgcattttgttgcgtagtcaaagacccgctcaatcggtaaagtccttgcgcgaagaattcttaaatttttttagaaaatatatcaatttcagaggaataccattttcttcaaatgaatcgatgatggtaattaaagtacgaacaatattttcagtttcccgttcatcgccaacaatttcaccgcttagtgctgcctcactatccttctttaggagattattctaaattttagaaaatgggaagatgtataaaaaatataggtatgtatttgcattcattatttgtttaccgaataacg

SEQ ID NO: 35913 - DNA, 984 bp, Heterodera glycines
ttaatactccgactacgggctccaccactttgatcactcgatgtttcagtttcatacggtatgttcagcaattgttgatgttgggacgaataagcgtcgtcaatgaacgggctgctgtaataatcggcgctatcggacacgttaagcggactctttcggtttactcgccgtagctgtttaagtatgtatgtgcacagtacaattaggaacagattgaacaggtacgatatcggcatccatgcgtccgacatgcgtagatgggcaaaaacaccgcggctaacattttggtctttgggtttatagattagataattaaagcggacatcatttgaattggttacaaaagttagcgcacgattcccttttgcatagtcgccaatgtgaaatttatagatgcgctggtctctgatcacaaacacatggttgtccgccaaagtaaagtcgcttttatctggcggaagaaaagcgacaaagttgctcttcaagatcgtatgtgcggaagattggttttttcgaagccaccaatgctccaggtattcaagctctatttcgctgatccgcctctgatacttatcgatcagaaacaatcgacccgataggtgatcaaacacaacccgtccatgtttggacagtcgttgcacaatcttatgctggtgaccacggaagatagtagtctcaccagattcgctgtcttcaaaaaaggtaaaactatgcccattgtattcaaaacaggccaatggtgacattttcaccaatgatttcatttcgaaaaacacactctgatagctgtgcaaagtgtacacattttgaagcgaaacggcccattcgctatcacgctcacatttctctattcggcacgctgtattccgactataaccaaagtgttctgctgctgtagcatcttttgaaaaggtacgatatttgccgctgtcaaaatagttttgattgtcaaccgtaaaatctacatttatcagctccgattgc

SEQ ID NO: 35914 - DNA, 875 bp, Heterodera glycines
  misc_feature (150)..(150): n is a, c, g, or t
catgaggtggtgcttcttcagtttgatcatcacgcaaaacaaagtgcctaaatgaatggattttatctggaaattggttaagaatgaaatctttttgatttgataagcggaaaagcatcggaaatgtgaattgtaacaccccccaggctnaatactagcaattattgctagaaaataatgtcccaattgcaaatcataaaattcttatatgactaaaagatataccagtggataaacagagttgtgttatacaatttataggttttgcggtttttggtaaccaaatacctaaccaattagggtactcattcagtttgggtcccggttttaggtcaaaattttcaaaagcttttggtgcctgaaacccccatttcccaatacaatttacagacaaacagtttggggtgttcgttggtaaaaaaaaataaaaaatgataaaccttcatttccgccttctccaaactggccgagtattttgagaccgttgccagaaagtcatctgtcaactgttgccgagtgacacaaaagagcacagcgaacactgacaaattgcttcgtcgttcagctgcacaaattgatttgaaacgcacaaatgagtgacaactgagcagaggaacatcgcatgtgtaatactttgtgtccaagtggagcgtgtggcatggcaaagtttcggaaccaattttcttttgctgggctccaagcccgccactttccaaaagaccaagatggtcaattatctcgcgcaacacgccatccctttggtcattcacaagcacacaataagcaggagaattttgtaaatttgacataataatataccaaatgctaaatgtatatgcatgtaaatcaatattaaacaaggggtccgtatcgtt

SEQ ID NO: 35915 - DNA, 753 bp, Heterodera glycines
gggccagaagttgacactaagttgaaattgtaaagactttgtttatacaatacatataaaaatacaaagcaagtgaaagtttttttttttgtaaaaaagtgaaacagaaagccaaaaagcatcagaaacgaaaatcgaaaaccgaagaaaaaaaatgcaaaaatccgtgcaaatcatgcaacagttacggtttatgatacaaataatgacagcattcttccgtattggtgatccagtgacaagtgtatttaccagcgttctctccttttgaaatttttttctttgctttttcaccttcacatttgtcttttgttgtgaaacccgaacaaaaagttttccaatcttcgattgtaactaaatattttaaattaaattgaacaaaaagaaagaattgatatgttaaaattattaaaaaagtaagaaaatcggatgaattgcgttgaaaattcgcaaatatttttgagtttagttatatccattttattaaatgcctgcaggagtgttaattattaaaaaattatattaaaattcacattttttcgatttaaaataaggaattttttgcaacacattcgacacaaatttttttgttttggtcactgaatttggttggttgattggctgagttcttccaggaaagttgctattaaatgtgttgaacgacgaattgcttgcttcacagaaattggcacacaatgccaaagtattcaatgccaagagcagcgcactggtggaaatttgtttcataatgat

SEQ ID NO: 35916 - DNA, 909 bp, Heterodera glycines
  misc_feature (44)..(44): n is a, c, g, or t
  misc_feature (72)..(72): n is a, c, g, or t
aaaatcgcaaaatatggaccataaaatggcaaaaatcgcaaaantatggacataaaatggcaaaaatcgcgnaaatatggacataaatggcaaaaatcgcgaaatatggacataaatggcaaaatttcgccgtgccaccacttctgtcagttaccatattaaactttatttttgggtggaacaaatgccaattgaatcatttgaattggtgaacgaacggacgaaggaaaagctgacactgaaacagaatatcgatgaattcgacgtaaatgtgtgtaattggttgttgcaacggtgcccaattggagagacggcgacggcgccagcaattaaatggggagacagcttaaatccgagtgccaatttgaaccatatcagatttgttctgtggagtttcgataaatccattgggtgagcagcagcaatagcatttgaattttatcgaaaaataaaatatttaattaattttaggccattgtcgccactagcggaagaagataaagaagaagataaagcggatcaaagcaacaaaaatgtcgtctaaaatgtacggaaatgatttcgataattatatttgagaaatgatcgatctcaatttgttgtgcttaatctcagaaaaatcgattcagaaggcaagataaagtatttcgtgcatttgaaccggttttggtgcatatttagaatttttcgaaaattgaattttcgaatttttgttcgagtccgggtcaggggttcgaaatgggccgaaatagatataagaatcgaattcttcgacccagaaaacccataaaacaactttatttcgaaaaaattttttgaaaattttctttatatcattgaaaacctaataaaaaaataaaaaatttgacagttttttactttagataatccgatgctttttctggcgct

SEQ ID NO: 35917 - DNA, 877 bp, Heterodera glycines
caatgaattttgctgtccttttaggcgcacatttatcctacccccataaacttcagtgattttcgaatccgttcgatccgacgggaacaataacccctaaattaggtttcttttttcgtccgaagtgctgccatcataaagcatgggcggtgagggacaaaagagcgccgaccaacagggtgccgacccgaggcgataactcgtttcattagttgtacaaatcgaaccaatttggtatatccgatagccctaaatgttgttcattttgtaaaactatgaaaggagttaacgcccaaaaaccgggccggcgcggccaatttcgagaattggatacttctcaattgttacctgtaacgttgataattttcgtgtctaagcccatgcttttgttgtgcattttttacaatctcaagaattctaagcacttttggtccattcgattcggttttgtcactgcttttgttctctgtgctcatctttaattaaatgtagaaatccaaaataatcataacaaaaatattaaacaaatacgaacataattatatagaaacataaatagaaaaaagacccaaatttataaaaatatgaatataaaaattaaaggaacctacaaatgtattgttagctgagatcaaaataatcaataaaaaaaattgtgtggaacatttattggtttagataggcccgatggtctaaagtaaattataattaatatattttggaagctttcagaaaatgaaaaattttcaaaagttagaattttcttttaattttttttgttatcttaacaccggaacgcccccgtcaaaatcaagcatatatattttaatctaattaattatttaataatatttttgctcttaaaggggtgggaaaa

SEQ ID NO: 35918 - DNA, 749 bp, Heterodera glycines
atgaagaagaaaacggtaaataatataataaatagggtttaatataatggctatcatccaacaaaaattcaaaaattttcaatcgtgtatattttttttaccaaatactgcatgtttgtaaaacttgaaaatttcaagacgttgatgaatttgatttttcagttttttaacatgcggatacaaaaaaaagaataaagtttggaagcctaacggagcaaaagaatatgaaaaaggctatccacttaaaaatgtcaagtttaattcagttatctctccaagcacctcctccttcatggatcattcggctgttaatgagtaccgaaatgcaacagcggcggcaacagctgatcagccgcccctttcggcacggtctccgtccccgccggtgtctccgccattcgaagatggtgctcatctcccacattccccttctcacactgctcatgatggcactgatggcggcatggacacggaaagcggcgtggccaaacgaataacggaatcgaaacggagactgagggaagtgtacacgacggaagagatcgacactttggtcaggtgagttgggggtgggggttggcacttcgccgccgccctgaaaagggacagccccaatttccaatttgccccgaattaattttgtgatgtttttgcttttgtctttccctttgcctggcattcatttttttcctaattttaattatctttataaaaacggcacaatacttctacattttgcttcttttatg

SEQ ID NO: 35919 - DNA, 1586 bp, Heterodera glycines
  misc_feature (15)..(15): n is a, c, g, or t
  misc_feature (167)..(167): n is a, c, g, or t
gatttcatttgatgnactcataattgttccctctcatcagggcacaatgatgccgagttaagttcggccgctggttttatcgttcaacttttactcgcaattagccatattttggacattccgctcaaacatttgctccttttcaatggttctcgttccgcaatatntagtcgttcttctttggaacggtttgtcctttcatggcttttttcctcatcaaatcccctgttttgcctttagctttgacctcttttccacttcgtctgcaaagagtcaaaggaatcggctggaccaggcgatgtacatgctcaacgaagtcatcgtccaactgagggccgagtctggcgttgtgtctaaggaaaccgaccgacccattcggcttgttcaagagttgttactctcttttatcggttgccatcggttcgtttccgtagtccttcataatttgactgacaaataagcgtgggggggggaggcatttcgcatggaatttgtgttaattttattgaatttttgggaaccgctggtaatttgagaagacttcaccctgtctgatggattttttatttggggaataaaaaatgaaattttcagaaattttttagaacgttggtctttctttgttttttgagtgtttaaattgccaccctttttcttcagattccattactccgatttgctcattccttacgagaaattctcaagtgcctcccaaaatgcgttgccaaattacttaagtgttaaagccgaccaaatcattgacaattccaaactttgtagcattttaatgccatttcctacttaatgtgattaaaacagttttattaccacaaatttctaataattatttaatcggataaatttgttattttttaaatataattttttctttttggtaatttatgccatcactttactttgtatttttctccctttttctgttcctttttgattaataaaatgactgaagcttctaccgcttccaatggcatcattagccctgaggatggttccgcggaggaagaagatgaagttttggttgagccccgcttccgttattctcgggtccttggcaatttggtcagggtacgttcatttgttcgtccagattcgccaatttcactcaatttctacttaattttaggctctcgatgttgattcggcttctgcgtttgctatccatgacaagttcttggctgtcggcttccaatcggggcgcatttgtttctacgatcacatgggccacgaaacattgcattcggtgggaacaatcgtaaaaatacactcattcccattgctttatgtttttagtcgtcccgttaccacaaatgtgccgtctcctccatttccattgatcgacctggcaattattttatcagctgtgccaatgatttcaccgttaacattttcggcattggttcctccgagtttaaccaggtcatcgtgccaacaaacattcaaccattcaaatgttgttatatttcagcgcctttttcttccctattcggccaaagtggtcgaaatcgcctccgatttctctcgacttggttccaatcaccggtttttggtcggttctcgcgatttga

SEQ ID NO: 35920 - DNA, 532 bp, Heterodera glycines
aagtgaatcagtgttttgttcagctgagaaacaaaacaaccggcgagaaacgcgaaaaacggcgagtgaagtgaaaagcgaatttcgaaatttgatagtccaacctgtggatctatctttcagatttgttgtagatcaaaaaatttttagtgctcaatctgtgagtcactaatatccaatttcatttaaccttcacaattcccaattttttttttcccccaaaatccaaaaactccaaatttttcgctgaagcttacccagaactgcaggagcgccaagtgataaaaacttcgattccaccgcttcacacaaattgattctcgaagaccaacgattaagcgaggccaaaacaaacaaatttattaaaattgaagcaaataataaaaagaaaagtcggaggcgatgatgagaaacaaaattatcaaaaccaaaaatcacaaaaaaacaaccagtaccacggacagacaaaatttagaaaagatcaaaaataattaaacagaacgtcaaaattataattagttaaattaataat

SEQ ID NO: 35921 - DNA, 728 bp, Heterodera glycines
  misc_feature (562)..(562): n is a, c, g, or t
  misc_feature (670)..(670): n is a, c, g, or t
  misc_feature (678)..(678): n is a, c, g, or t
ttttgaaagttttactacgcgtatagcgaattaaaagaaattttgaaaaattatactctcaatttgaaaaatttatgtgcatatttttcactttttatgtgaatattttgccatttttggtgcatattttatcgcgcatatttgcgattttatatgcatataattctatgccctagtgatcagcacacaatcctcagtcaattcagtgattttttttgtttttctaatttaatttttttaaatttttttaaatttttgctttttttaattttatttttatttttattttaaaaagaattaccagcccaattctcagccaaatttcaatgatcagcacacatcttcagtcaattcagtgatcacaaattcttttgggtattttggccctaattagcaatcaaaaaaattaatgtccaaaaatcatccgataacgtttcgtctggcacggcattttccatgcagtttcattttgtccgttcgtcgaattaatataaaattttaacgaatgaacaaaaggtctattgaaaaatacaacaccgaccaaaagtggtcaaccaaatgngactcgatcttttaatgattatgcacttttcctttagatggcatttgttgcgtgaataaaatgaaaactataaattaacgaaaaacttttcactttatttattatcgnaacaaatnacatgtcgtgacacgattttttcattttgaaaattttagtttttcttttt

SEQ ID NO: 35922 - DNA, 1060 bp, Heterodera glycines
ttctacacctatcaatggctttttcaaatggcatatttctttctcaaggaaattagatctttgaacattatttaaaactttttgaatcttgaaattttgcaaataaaagccctcttaaaggcacatacatcttcgagaataataaaaaatataatttttttacaaaaattcttaaatcatttatcatttttgcttaaattccattacaaaagtgaaggcttgtgttattcctttatcactttccctttatcaatttgttggcggcggtgcccttcctccgttggcatttccgtctccgtcaccgccaaaagtgccaacacttgcggatgggccgaacccggcttgccttttgccgtaccatccgccgtagggataggcatatgcgtagccaccccacttaacgaaatataaatttaaattattttaaaatttctcacataagcttgggactgttcaacggccaagccaatgcaaaggacaagcagaaaaagggaaaagcttaaaaattaaatttaaaattggaaatgagtgacaaattacattttgatggttgaagaagaagccatttccaatgataagcagcgaatgattgactttttgcagaatgaatattttttgaatgtgccgaaaaaacattttggagctctttaaatactttcactttttggccaaacaaatatttgctttttatgtgccataacaattgacaaaatcagtcccaaattacgtcctattttcgagatttcttgacaataaaaggcaaataaagcgaacggatcactgggatttttagtggtgatgaatgtcatccatcccaccattctcagcacattttgcccaaaatatcagaacaatgaaacgaaaagagttgtcgcgcggtgaaaagagaactcaaaaaaaaaaacattcactcgcgcaaacaaaaaaacataaaaaaatattaatacattaaaataaaatttatttatttatactattactagggctgcaaaaaatatgtacaaaaagtggtccaaatatgtacataaatatgtaagaaaaattcctaaaatatgtacaa

SEQ ID NO: 35923 - DNA, 774 bp, Heterodera glycines
tttttggggcatagagaatatatttaaaaattccctgtagaatataatgcccatttctctccgcgcccctctgcccacactgggaacatttgtatggtaaaaaatttctcgcaaaaaagagagccatttttttggcatagagaataaatttaaaaattccctgtagaatagaatggccatttctctccgcgcccctctgcccatgctgggaacaattgtatggtacaaaatttctcgcaaaaaagagatagccatttttctggcatagagaataaatttaaaaattccctgtagaatagaatggccatttctctccgcgcccctctgcccatgctgggaaaatttgtatggtacaaatttctcgcaaaaaagagatgccatttttctggcatagagaataaatttaaaaattccctgtagaatagaatggccattgctctccgcgcccctctgcccatgctgggaacatttgtatggtgcaaaatttctcgcaaaaaagagatagccatttttctggcatagagaataaatttaaaaattccctgtagaatagaatggccattgctctccgcgcccctctgcccatgctgggtttgtaaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaata

SEQ ID NO: 35924 - DNA, 845 bp, Heterodera glycines
  misc_feature (808)..(808): n is a, c, g, or t
cacccttttttattaatttcccaccccccccctctttttttaccttttccgtgtcccccgaaacggttacggagtcggcaccgttgtgacaagcggcgaccactccgtctgggcagcgtttgactgcctcttcccagctgagtccaaccgcggccattgctcctcgcattcgttctttgtgtgccattatcgtttttccgcgatagtatgccaacatcatcgtctgcgcgcgtgtcagtgctccgtccgcataaccgcagcccatttctccggtggaatggccaacgattccgtcgggagtcactcccaaagcgaacagcaaatcagtcaaagcaatctatgaaaaacggcattttagagagtttgtgaatggcactctcctcgctcaattatattgctaatgccttccaatttgaaatgcaattaaatccatgcttttcccgggcgctcacctgaatggacgtgattgccaacatgcagttcagcgtgttattctcgtactgcttcggctccgcgttcgtcaacattccataaacgtcctcgccaaactcggccaatgtctgcgacgactcgcgcagcgattgatcaaacagcggaatgcgcatcagctgccgtcccatgccgacccattggctgcccatgcccgagtagacgaaccacaccggacgcggctccaaaatggccattttctgcacatcactgaccacagggacggactcggcgggcacttctccgccccgcgtttcgtcgagcaaaagaaagccgcggaacggagtgtctttcagcggcagattggcctaattctcgnattcatcagttttcctattggatgaggtgcacctgat

SEQ ID NO: 35925 - DNA, 869 bp, Heterodera glycines
ggaggaacatcggccgtgggcaccgcatcacagaagtcggcagtggcacctgctggaggagcgtcggcgctgggcaccgcgtcgcagaaatcggccgccggaggaactacgtcacagaaatcggcagcggcacctgctggaggagcgtcggcgctgggcaccgtgtcgcagaaatcggccgccggaggaaccgcgtcgcagaagtcagccgctgggggaaccgtgtcgcagaaatcggcagctggaggagccgcgtcccagaaggcctgagcaaccaccggacggcataagaacaagacgctctacaacccgcttcaatgatatttatcgacagtgatcagtaatgatgtttaaaagaccccgtattgttcccccacatacctatgcctaattgctctattgtctgtgatcacgtatatcatttgtaaaaccgttgtgtgatcattatttgtgtatatgtatgtatattgtatgtatgtgttcgcatgattatcggaatacgctcaaatatgctaaatattcatatggaaattcgtcctctaagcttcaacccaagctaaaaccatgtctatcgagcgtctcaggcctggcacagtccaggaaaaaaatatgcatgtgcatataattgggctcccttcttaatacatcgatcatgttatgaaatttttggaagccagatataaatagaaaattttaagggctagtgaatgatcctaagtatatttttttatgtttattaatcatttagagtttcaattaagaattaggtaattaattattttttagtaattttataaatatagaaattatgttattcgaaataaataaaaattatatttatcgaccatgggggataaatggagactggt

SEQ ID NO: 35926 - DNA, 322 bp, Heterodera glycines
ctttctctctcatattttctctctctctctctccgcaccaaccgctgcacagcacccgacgctgccgctcccccccccccccccacactccaacacattccaattatcccttccccgttcatcccaatcaacaatgatcgcccccatacctcgatgattcaccatccgcaaattcacgcactcaaccccccacccccccaattagttacatcccccccccaacataattaattactggccgcaaaacatcaaaggaacccccctacggaaaaatgcaaagaatcatcctaacacctgaaacggaccagaggtggaaactacc

SEQ ID NO: 35927 - DNA, 880 bp, Heterodera glycines
  misc_feature (51)..(51): n is a, c, g, or t
  misc_feature (58)..(59): n is a, c, g, or t
  misc_feature (61)..(61): n is a, c, g, or t
  misc_feature (66)..(67): n is a, c, g, or t
  misc_feature (88)..(88): n is a, c, g, or t
  misc_feature (91)..(91): n is a, c, g, or t
  misc_feature (94)..(94): n is a, c, g, or t
  misc_feature (104)..(104): n is a, c, g, or t
  misc_feature (108)..(108): n is a, c, g, or t
ctctcatcatccgtctgcttcttcttctgctgtttgccctactagataggntcccagnngngcttnnagggcttcccttttttgaggntgntgntgtggtattngatntgtgaagtcacgaactgcaccaattgttcagcctgacgatcctggaaaagaattgaaattttgtcaaacaattttttggggttgagaattctcaccacggacaatagaataatatatctatttcagctaactctttgatagagaaagaatacgatagactaattatcatgagtgtatgaacttatcagaatcttataaccatgagagatgaagctgatcctgctgatccaaaacatcttttcgatgagcctcaccagttaaatgaacaaatttgaagaaattctagtgtaatttgttctctattataatagatattatggttaaattttagaaaaatttgaaaaatgtactaaataaacttaattagaaaataaagattattccttggagatttctacaaaaaagactaattttcatcaaaaaatttgctcaaaatcatagacttacgcattttttggaaaaggtacgcagcaagaaaagcggattgtgttttggtttctttaaaatatcttttaggaatttttccagcgattaaattccgtttttctaaataaatttaaattaaaaaaatcattagaaaaaaattttttaatcaaggatcacggctctcggagtttttggggtgccgtgtttctcagattttttttaaagccccgtgatccggctcacggatttcccgtgattggaaattcaatcccggcagccccgggcgggggatttgggatatagcataaaacaagacaatcaaaggaaaataaattttatcttcaat

SEQ ID NO: 35928 - DNA, 1046 bp, Heterodera glycines
  misc_feature (23)..(23): n is a, c, g, or t
ttccaagcgttcgcccaattccntttctcctcgcttttcaccaaattctcaatgttttccaattcgtgcctaattgttttgcctatttaatgttttgagatgggttccaatgactttgtctgttgcaattcgtccgcaatgtttgtctttttgcgttgggtgttcactgcttggtgccggtacaccactaatttgtcctccgatgattcgtctcgacggtccctttgcagtgtcaattccatgcattcgctgttcagctgctcaatctgaatgtttcccccgggggtgttgtgccgtttccgcgacctcttcctcacctgctccttcaacttatccacatcggctttgctcgcgtttttctgtgccaaaatgcgctgtaccacttccaaattacttcgctgtgtgcgtatgtcctgctccaacttctcattcagcaaatatttgtttacttccgtctctctctaaagcactgtcggtcaattaatggcctgtctttgcttcgtcgtcactttcattctctgaatggctgcccgtgggtccgcactttctccccgtctttcttcctcccacaaagtgcgttccaatctgacaatccgttgctcggcatgtttaatctgaagaaaaagtgtacgtttttagcgagtcggatggagcgtgggttcatctcccacccgctgtttactcccaccattttgcctttcctttgttttatgtccccaattccgtgcccaccgctttctgctggtcctgcccctgtatcttcaactcttcgctccgttccatctccgcacggagttgcgctgaaattggtctatcaccgctaatctgagaattgtcaaatggcacctgccaaactcagcaaagtgttcaggtcgggccttctggctgctagccgtcgcttgcatctctcaattttgcgctggagctgttcccgctcctcgtccatcgccttcaaatcgttgctgacatccatcgctcgcatatattccatccgagcatccaaaaagggtgtatgcagttcctatttataggttgggaatggtgcg

SEQ ID NO: 35929 - DNA, 752 bp, Heterodera glycines
ctcacctgggcgggaccctcgtcctccacttccctcgaattgggacatcgcatatcgccgacttctttcaacgaccaagcggctgcaatgctcccccgagcttctcgatcgctattccgccgaattgacacggcagatggacgccgacatcattgagttgaccgggcgagacaacgacgagcactttctgcctcaccacgccgtcatcaatcccaagaaactccgaatcgtcattgacgccagtgctcatgccaagggcactccaagccttaacgactgtctccaccgcgggcccgtactgcttcccgatctttgcgggatcctcattcgcttccgatcggcaacgatgcctgttctggctgacgtccaaggggctttccacgccatcgaagtcgagccggacgacagacgcttctgcaaaatgctctggctgaaagacccctcccggcccgtctcaggcgataatctcctcatttatcgctacaaacggctcgttttcggcgcaacttgctcccctttcatcctcgctgccgttcttctccaccacttcgataggcacgcccacccattcgccaaggaattggccgcgaatatgtacgtcgacaacctcctcatcgagtgcgagacggaagaggaggccatcgacaagtcgtccaccgccaaacaaatcctcaaggacgccgacatgaacctccgggagttcctcagccactccccaaacgtcatgaagcaaattcccgaggacgaccgac

SEQ ID NO: 35930 - DNA, 984 bp, Heterodera glycines
  misc_feature (867)..(867): n is a, c, g, or t
  misc_feature (943)..(943): n is a, c, g, or t
tacaaaatttaaatttgccttttgtttatgtttttaacacacacaaatatttatttaaattttaatttcatttgatttattatttcacagccgacgaacgcttttccaaattcgcccatcacaagcacaatcaatttcggcacaaatgacagcagcagatcatccgcaactattttcaacggaattggtggcattgaagcgaatgacggcacttccagcgaagcgacaaaccgccagcagcagaacaacgacgagtgatggaacacagagaaagagagggaggagagagagagtgagaaagacagagagggcgaccgtattcaatgtgaaatgcatactgtaactttgtgtattcaaaaacaataccggagaagcataccgtacaacacaattaatcgagaattttttaatttgggcatttttaaaaaataaccaaaagtctaaagggaccaaaacattatacttctattgcattctttggtttaattgtatatggtattcttataatatcttactgtctcatatattttttaattaatttccctttttacatcacatttcttccatttagacggtgcataatatgtgaatgtgttacagtgaattgaaaacttaccgtaatttacaaaaatgttttttattgttccattttttcttatatttcctcaacaataaagtacaaagagcttctttaattcaagaaaataactttatattacaatatttcttaattctgtacttatttagtttgatttatgcttttgccgttcaaaattaaaaaataaattattatgtgttaataacagaaaacaaaaaatagttaaataattaaaagaaaatgaattaaattaaaacattcatttttanaaacgaaaaaaggtgcaaaataatccacggaaaatcattctaatggaagacaaaaaaaaaaaagaataaagattanatgaagaatttgtacgagtgtattttgagatttcaatcatt

SEQ ID NO: 35931 - DNA, 1070 bp, Heterodera glycines
ttaccgaaaaatgcaattttgcgttgattagattaaaacctcccgagaggaaccgttaattaattaatggatggacagcggcggtgcattcgaagtaaaaaaaaatggtgagagatggaaagatggagagacagagaaaaaagataaaagagaaattgtcaaagatggatgagaaaaagagggctaattaacggacagacagacagacattattgattaatggagttcagaatttttcaggatcaggatttaggtcagggattcgggaactggatccgggccggatttcaggattaaatttttgtttttcgggacactaatccgggtgaatttctcaaaaattaccagggccaggattaggattttccgggaaaatcttgacagggtccggtaaacatttgttttttcatcatataactttagtaaacaagatttttttaaaatttgctggctaatatagaaaattattatagctatcgaattagatgcaaataatttaaaaatttttttggtatatgctgaatacgaatctgccgttcatttttagctatcaccagggattctttttttatgtaaatacatgtttttttctggattctccatagcctaattagtaggaaaaacactttttttttttgtgtttgcgaacaaaagttgggacttttatttgcatatttttacatatttcgggatttttctacatattacatatgtacatatttcggactttttcgcattttttcgaacatattttgaaatttttgaggattttttaaggaaattttcattaaatgtccccaaaaaaacccaaaatttcacaattttttgtacatatttttaggatttttgagaagtgatagaaatttcatatgaaaaatttaaaattttttttgaaaatatacccctaaaaatcgtttttttcaaaaaagagatagtaaaaagggtgcttctaagcctatttaggtcatttttatggcattttgtacttatttcacccctttacgaagattttttttccaaaaaacacccatttaaaaaattttattttacatatttttacgtacatattt

SEQ ID NO: 35932 - DNA, 871 bp, Heterodera glycines
gtataaaatttatcaaaaaaagagatagccatttttctgggatagagtataaatttaaaaattccctcaaaaataaaaggtaaattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaaaagagatagacatttttctgggataaactctaaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgatgtataaaatttctcaaaaaaagagatagccatttttctgggatagagtataaatttaaaaatcccctcaaaataaaaggtctattgcgcaccgccctccctatcatgctc

SEQ ID NO: 35933 - DNA, 1677 bp, Heterodera glycines
  misc_feature (53)..(53): n is a, c, g, or t
tcaaaaaaaaaacatggagaccatttttgcatgttgaattaattgttatgtcnaaacagcagagcaaatcgttggtgttgtcctttttacacagaaaacctttagacacatttgttagtagttccgctcaactttcgtcatctccttggccactgtcctgctcttcttcgccgccgtattcagcgtcttcatctgctgggggaaaatgggggatggggttttatggaggcacatttttgattgaaattgaagttttggtaaagaaatttgtaccatttagggggtgggacaagcccaaaatcaggggaaagtggggaattcctttttaagatggaaaatccaaaccttcgctaaaactcagattcgaggtccggtattgtctggaatgaaagacatatgcataatcaatgaatgacccctaataaaaccagagggaatttaccagttttcttgacaaaaaagccagcaaattgaaacggtaaccacgggtaaaaaatttgaaaaccgaaaagtaaactaagcctttcgctgaattaaaaagaaaataatttgttttaaaatgctttttaagttattcggctgtcgccctcaccggtgtcgtcgtcctcgtagtcgtagtaatcctcgtccagctcaatcacatcgttggactcgttgccctgcactctcggcttcgctttcaccacgtattcgtcgatggtttccggcactttgatgccgtcctttttggcctcctctttggacttttccacctgttttcttaatcacacagcgttcagataaaaaaacaaacaaattagcaattttttgtatttataaacctggaaatggtaccatgattttgaccggaagatacagtggatgggataattaaaaaacgttttaaaatttcggggtttttttttaattttggggagaaacaatacaggggaactgacccggcggtgaggaaggcacccagagggggggggggggggcgaactgctcccacatgagaccagacgagagctctttttcgaaccgatgtgcagcacatccctttttgaaaacacatccaacaacgaacctgataatagtcgcatactcctggtccccgtggtctgaaataagtgcgtgtgtgtaatttggacgtattacacctttccagccatcggtgtccaagaaaaatttgtttcatttttgaagaaatttcacctttgtatttccggtacatcaccgatgcgtccacgttggccggagatgacgtgtttggctcgttgagcagcgaaatcacagacagcaacactgtgcgcacactttgtgttggattccatcgctcggaaggcatctgagaaaagggaaaggtgactgagcaattttctttttgcaattttttggggggaggttgataaaaatttacgtgcttcccagaattcggcttgaagggggcatagacctctttttctacgtatcccgctaccccttttaggaccgttcttgcatacaaccaaaaagtagtaacatgactttgttttctagtttttagaattaattacgccattacactgaacttccgtaaaggcaaaccaataaaaaaaggacggagatgcaaatctttacctcgccactgtgcgggtcatcaaccggtgggtgcaaaaaggttatgcaaatgtcgccattctaaaaaaattgaatgca

SEQ ID NO: 35934 - DNA, 1976 bp, Heterodera glycines
  misc_feature (1695)..(1695): n is a, c, g, or t
  misc_feature (1708)..(1708): n is a, c, g, or t
  misc_feature (1721)..(1721): n is a, c, g, or t
  misc_feature (1728)..(1729): n is a, c, g, or t
  misc_feature (1734)..(1734): n is a, c, g, or t
  misc_feature (1758)..(1758): n is a, c, g, or t
  misc_feature (1797)..(1797): n is a, c, g, or t
  misc_feature (1806)..(1806): n is a, c, g, or t
  misc_feature (1850)..(1850): n is a, c, g, or t
  misc_feature (1864)..(1865): n is a, c, g, or t
  misc_feature (1869)..(1870): n is a, c, g, or t
  misc_feature (1875)..(1875): n is a, c, g, or t
  misc_feature (1885)..(1885): n is a, c, g, or t
  misc_feature (1919)..(1920): n is a, c, g, or t
  misc_feature (1924)..(1924): n is a, c, g, or t
aataatacatattttatttctttccatttttttgactttttctttctttttttaacttatttttaaatttaatcccaattaatatttccaaaaattgtcagaagcgcataattttccaagggtaattctaagaaatggaataagtcacccaatattttttcgaattttcagccttgaaaaaaataattttttaaattttccatttttcattaattaattaatattttgatgcatttaaggagcttcttcagtgggcagttccaattttaatccagctgattttttgtatacttttaacactgaaaatggttcagcaaatgctaaaacattacaaaacaatttaaaaaatgcggcttccaatgtgattgaaaatggaggtgctttttaaaaaaattaaatttgctaggggaaaatttttgaaaaccaattacttgttatgagaaaattttttggtttgcatccccaattcagccatgctgattttttgaattttcaatgcttacttagcctagtaaatgatgttttataaaaatttaatttagttttatttgtaggcattattttacgtcaaccattcaactaacataacaaaatttctttcgctttataaattgaaaacccatttatgttaagtctttagctaaatttttaagaatttcatacctaaaattgtaatttttttcataattatttttgaattagaaattgatttaaaaataaataaaacacacaattccagtgaaacaagttcatcaaatagtcgatataagcctgttttgtctggaaattttgccgtcaagcatcacagaatcattagaaaaaatccggcatggccattcactgcctgatggcacgttaaacgaacatattttgcagaatttaaagccagaaaacgtcataaaatgtataaaaaaattggttgttgaaaggcgaagatgccaacaaaaatgatggattaaaaccccggatagtggaattttgcattaaatccaggcttttatttgagaaaattccttttgtggttggtttgttaaaataataaaccaaaaaaaatggtttttttccaaattcaaattttattaatttttgaaaaataaaaaattaaattaacgaaaccctggttattttcccaccccaaaccccccccccccaccctttggtttccccccccccccccccttggctttttttaaattttcttaaaagggcccttttaaaatattcggatttaaggggcccgaaaatttttttagaggttttttttattaaaaaaaaaatttttttttttttaaaaaaaaaaaaaaaaaaaaaaaaaaaaaaaaaaataattttttttgtgttttttttttaaagagcccccgtttgggaccccaaaaacccccgcccccgtttttttttgaaaaaaaaaaaaaacccaaaaccatattttttaaaaatttttggggcccggtaaaaaggccccattccaaagaattttaaaaaattttcaaggggtggttcaaaaatttccccaaaaaatggaaaccaaattccaatttttttttttttaaatttggaaatttgcggaaacctgttttgtttctttttgattgaaattttttttaaaaattttctttcaacttaaaaaattttttaaatttaaaataattaaaaacataataatatgtaatattattattattattattatttttntttttcttttttntattttttgtgtntttttcnnttctnttcttatgtgttgggcctttcttnttgatgttgttctgtctttgttttttgttgttttcgttntttttgtgntggttggggcttctttggtgaagcggttgttttcttcttttttntttttccgttttcnnctcnntttcntttcctctcntcgttttctttatgagattggtgccctttcctcnntttnggctttcgccctatatcgacaaatttaataatttacttaattttttgatcat

SEQ ID NO: 35935 - DNA, 696 bp, Heterodera glycines
  misc_feature (636)..(636): n is a, c, g, or t
actgtttcagctaattttttcattccatcagcacatttttgaggatattcttcgaattgcacgtggcgggctcatctttgctcccgaatattcgcccgtttctctgctaattgtgcctttaagacggagttttgaattatatttttatggagatgaatctaagttttagaccgacccaatgtcgccgattatgagttggatttagggcacctccgaggtgatattcgcaatccaccaacaatgccacccgaagaatgccgtcgttattttacgttcgatgaatcgcgttatactgatgctattgtcatgccatggttcaacttttattgacaatttaaattcgatttcttttaaaggtacagatctgaagaccaatgtgcgttttattatgttgctgaggtttgtcattcatcggcatagtgattttacaactttttaaagatttgccgagatcaaaatccgaattcgccgttcccagacaccaaatttagcagttttattgagtattttcttgtcaaataccaactgaaaatttttaatcaaaaacaatgtttgttggatgttgatcacacttcgtcacgaatgagtatgtttttcctcgccgaatgaatgttaaattatttaagatttactccnttccgaggccgggttctgggcaagtgtcccaaggggcttttggatccatcgcaacgtcaa

SEQ ID NO: 35936 - DNA, 157 bp, Heterodera glycines
cactgtcggaatgatgttgtcttactgaataaagattagaacaatttacgtttttttctagcggcggcgggcggttgcgccactttttcggtgagcgagacgcgtggtgaagccggcggcattgcctatacttgagcctggagcaaaaacaataaaa

SEQ ID NO: 35937 - DNA, 1148 bp, Heterodera glycines
cgtgctttgcttcggattagtctaaaatttctggacttctatttacatattagccattttttattttatttgtgaccccaaatttttacatactagccattttttattttattgtgaccaagcatatctttcctcgtatttctgggatttttttcagaatgtggtcatagaataggtgggttgaattatttgtattttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacgccaattttacatattagccattttttattttatttgtgaccgcaaatttttacatacgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacgccaattttacatattagccattttttattttatttgtgaccgcaaatttttacatacgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacaatactgtgaattctttcgcctctttaattcattcgtgctttgcttcggattagtctaaaaatttctggacgccaattttacatattagccattttttattttatttgtgaccacaaatttttacatactagccattttttattttattgtgaccaagcatatctttcctcgtatttctgggatttttttcagaatgtggtcatagaataggtgggttgaattatttgtattttttatgagtatta

SEQ ID NO: 35938 - DNA, 1128 bp, Heterodera glycines
  misc_feature (5)..(6): n is a, c, g, or t
  misc_feature (20)..(20): n is a, c, g, or t
atcanntgcgcaggcccatnagccgaaaaaaagaaattcacgttggcgaaaagccgacgttgttttttttttggtccctaagaattttttctctgatataatttttcagaattaggccttatggcattttttaaagtttgtccaaaaaagcgctgaaaatttttaaaatttttttttacttgtgatatcttataaaaacttttctcagattctttttcttgaaagaattcaaagtttgaaaattttttaaagttttcggcggcgaaattttgggtgcatccgttttccatctgtccaaattagtaaattgtattttttttttcaggtccgtctctttcgtatacccaaattctgcggcctcctcaaaagtgcgctgcgctgaccgaaccaacgaattgtgtgactgcaccacatgaaattcatcgtcttcgatgaacactgtcgtcatcacaaggttttttttctcgtatttttgccctattaatgggtccgtatgccataaatattgtctttggccaaaatactcttttaaattaatttaaaagtaaaaaaaaaaactaaaaaacagttttatatttggtaccattcggtgcaataatgagtttaatcaagctgaagaaaattttaattcaaatagttaaaggctaaaaaaaatttatgggtaaacataattattgattttgaatttttgacatcgggaattgtacctctgatttcctactattttgtttttaatttaaaaaaactaatttagtaaatcttttgtcaaccgtcgtgatcgctatttgctgatcgaagacggttcactgttgaccgactttttcgtcgacctgttccgcattgttggcgacaatccttccggccggcggatgaacatgtcggatttcccgccgtggtaacaatttcgccgatacatccggagacaggtaaaaaaaaatttttcatattgtttgatacaaaacaatttttttttttggaaaaaaacgcagattttcaatacacttttttcaaaaaaatttcttttactttttttcacgtttccagcaaaaaggagacgacgacaatccaccggctggagttcacgctgatgaaaggctatttcaaactgttcgaccctagccgacttca

SEQ ID NO: 35939 - DNA, 1319 bp, Heterodera glycines
  misc_feature (1235)..(1235): n is a, c, g, or t
  misc_feature (1312)..(1312): n is a, c, g, or t
tgggatattctttgaactctgctgccttgtggattttaatttactcaaatccgtgcgggtgttttttttcacccacgccgcgcagcgccgcggaaggtcatcaatcatccacctgtcaccaaagtgagaggtgaaggaaattcaatttttctttttcgcaaatttaaatcttttgatcccaaccttttggggtattttctcaaatcctgagattttttatcataattttttacccgaaattaactcattttgaaaattgccaaaactgtgcggttttttatcataattttttacctgaaattaactcatgaaaattgccaaaaccgtgcggtttttttatcatgccccctcactcccctcccttcctgcgccgcgattccgccgccgcgcagcgccgtcatcaatcatccacctgtcacaaatgtggcaggtgaaggaaattcaattttttattttgcaaattaaatcccaaacctttttgggcggttttattttctcaaatcctgagatttttttatgatgatttttctgaattttgaaaatttgccaaaaccatgcatttcctctccgccccgccggtgcgccgcgatgccggcgccgcgcgaagtaatcgataacaaaataaatacccaacagaactataaattgggggaccgtcccaataaatgaaaaattttttatcgtctccctaacttcttttgagccattttcagatagggaagaatataatgatacatttcatcaatttcagaattgtttttagttcccgtaattacgactttaccggtccagaaaattaacgctgtcatgcttttaccccgcttgaaatttaaaccgcaaaatatttcgggttcataaaaggcacgacgattttttcgaaactcgttcaattcaatttcacgtccgaatttaaaggtcgaaacaatattttcaaccgtgtgtccggtgtaagaagcccccggacaccccgagcccttaattatttctatgaaaatttttatcgcattttcacagtctatcagacttttcgtccccagacatatcattttcccggattcccataataatgccgtggctttgatggaagctgtgcattttataactgcggcattgaattttctagggttatacttaaattcgcattcggtgatcgtcagagagtttagtttaattccggtaccgagattagcgagagcaattatatttacgattatcggtttttgcatttttgatancatgtaccaatcaaaatgttctttcactccctttatataccccctctataaatagcaaccaaaaataaaattaattngaaaaaa

SEQ ID NO: 35940 - DNA, 457 bp, Heterodera glycines
gttgaagaggcgccatgacatcatctgttactgcagcgctccatccgacaacgcaaactagttgctgatgctgctcaagttggtcatgtgccttatatacacacataacccggcaaagttttgtcgagcgccgatgcgtattcctttcaggcgaggggtgcatgttcgtgacgaggtcgaaggtggcggggttgagcgatggagaacagacgacagagagcatgtgacgcaggaacagagcctggcttgggatttgcgactctcgacgacagtagcaggaaggcgagctcgccagtggagcagcaaatccgaaagggcgcgacactagtcgtcgatgctcgagagaagcgcgatgtggtgtgctcatcgcaggtgcatgagtttgaaagagcaagagaggtacgacaacatcatccagaccacgccaatcaggatcgttgagccgttcggtcggcgc

SEQ ID NO: 35941 - DNA, 385 bp, Heterodera glycines
  misc_feature (15)..(15): n is a, c, g, or t
acctcctccccctcnccccttcccctttaccccccccccctttttttttttttgctccattggcctactcccatttgtagcaacagagaagccagagggcacataaaaagtgttagggaaacgaagagagtgtgtaaagagtgtggtggtgagggggagacgcaatcgccgttggagtgaaagtgggagagattgtgtggggatgggttaaggataaatggggctggggagggcggggggggggaaagggtggcggcggtttttgaaaagggactccgttggaggtgtagtggggtgcatttgccacgcctctgaaggttggcgacataacaaggtcaagttaataaacaattcatcctaaccataattgcactaacgggctttg

SEQ ID NO: 35942 - DNA, 930 bp, Heterodera glycines
attaattggtccgcttttcgctcactttgctctcctaattgctcactttaatcgatgggtgtgggttgcccgtcacgtaacatttgaaccgtttcgattcgccgggttggccgttccacactttcggctcgacacgtgccgtcggtggctcttcctctgaatattttaattaacaaataaactaaaaatttagtgaatgggaggggggggagctacgccattctttgtccctccacgtgaaaactcgccacaaaacaacgcagggcaaccatgggcgacccccttacctggagaaggtccctcgcatccaaactctccgtacaaccaaccaggacaaaacggatacttccctcctgctccaaatgccatgcccgcagaaccagggtatccaaactactatggtccatcgccgtccaacgcaggtagttcatccggctacggcgcaccaaactctccaccgccattccaacaacaaggagacgcaaagaatccgtacaactatgagcccccaccaccaacgtcgccagcaccgacgtcggcttacatggcagccacgtccgaagtctcgtatacccaaatgtccgacgtgacccagtcgagtagtgggtacaagccgcccatcgacacaaaggcttcacccttttccaagggtgcagtgaacccaaacgccacgcctgtccatcgtgcggatggtccaagtggtggcgcccaggctccgccacaatacgatgcaccattctgagactcggatttgttatcacgacaggtaatttatggacttatctgggctctcgtatccgctccttttcgccgggtatcctactcttgatcgttacaatgcgatgttcgcacccatgacgccaacccatactgtagtgtacattgaaaacaggacatctattgcacactcgcacacaatgatcgtacatg

SEQ ID NO: 35943 - DNA, 1405 bp, Heterodera glycines
attcagaaaggaaaaaagcaaagtgggccaaaatcctaaggctttttttggctcttcgcctaaaaattaaaaatttattattttccaaattaggggccaccaaagagaggcaatttttgtccatttattactgcttttaacctcaaatatccgatttgatacttgttgttcaaactttatgaaatttgaggtccctaaggtgtccccggcttgaaataattactgtgcctttttttcattgtatcagcagacattcgtaattcggcataaaaaacatcaaacaatttgtctgtcactctcttccccctccccttttccattctctcgcctttctcccaatatttgctaatactcttttccatctcactgttctctctctctttctctctctctcccgtttttctactttcctatgtttttgacacatctaaaactttcctgctgctgctgcttttttttatattggtgtctaaataattgggggaatttaaacggatatacaaatgtgtgatggatgtgaatgttgtatcctcctcttccaccgttccccattaaacaaacaaactctcctctttttcactctctctctctctctttcacacgcacaaaaaaagtttgccccttcccccgggggtcgtccgattcagcgtttgtttagtctgtcatttcatttccatctccgtcccgtcgctcgtttggtgttattgcgcgaatcgctgctgctccttcctctcacatctgtccaccaattttattggcgaccgaaacgatagctaaggggggggggcgacagcgacataaacgaatatgtaattggcgggaggacatggcggggcggggggcagttgaacggacacacccgaccaaccaacaaacactccgaggatcaattcccaactcaaattttcccttttccgcctccgttcgttttcgccgtgtcgccgcttccttccattttttgccttcatcttaccgctttttgctcgctcgattttcgatcccatttttctgttgcttcatttttcatgaacaaattgcatacacaatttcatgtcgcaatatttttgcttttttatgctccatgtggttttttttattaccaatcgccttttttgggattttttcttcatggattcattcaaatctgctgttgactttctttaccaatcccacctacaattacaacaaacaaagtggtgccttcagcaacggtccatgacacacaaacattcgcttgaccattaaaaattgcaaacattcacctacccctcgggggggggggggcatcggtgtcagtcacttttgctgagggggctttctttgctcgcccacttttatggtaccaccattcttcgccgtgatgtctgtttggttttctgttgttttgttttctctgtttgccctt

SEQ ID NO: 35944 - DNA, 927 bp, Heterodera glycines
tcttttccttcatttcttccggtcttttttccgtctgtcgttcgcttcttctccttccgctgactcagttccttttttaaatgccactgaaataattccgttttccgccacttccgttgagtcactgattttcgacagcgtaaacattacaaaaatttcgtccttcattcttcccattcttcatggcctcattattgcgtaaattgttcggttatcgacgcaaaaaagtgacaaaaaaggactcaatcaccggacggaacaattcatttgtgagtctttgaaatgccctcaggcatttctaaccgaagtgaatttattcattcgtcagccagtgccgtatttgtccaaattggaaggcaatcagttgcaaccggggcaatccctaattgtacgtggcattatcatttgtatgtcgagtgcttttgttttttattctcgataacttcttattgttcagcttccgatgagtttgtcatcaatttaaccaatggtccgcggtaattaaaatttcaaaaatttacgccttttaatttgtatcctcttaaccctacaaaataaaaaatatttttaattaattattttgagaattaatgttgaaattaattccgtatttcttgaaaaagagctctcgagggctctgtttttcaaccccctctcaaaaatatgggggttttttagggggggggggctatattataggaaataaggtataaattttccatttcaaatttatgttggttttttcagtgtcgaattggacgacgaagtgcggacactcgacgatcggttgctgtgcatgcgcgtggaaatggggcagaagaggcggaaagtgcatttgaacgcgtgcataaacggcgaatggggccgcgaggcactcatcaaacacaaatggcgaaacggtgggggcgggaatgaacaaaatgaata

SEQ ID NO: 35945 - DNA, 1159 bp, Heterodera glycines
  misc_feature (46)..(46): n is a, c, g, or t
  misc_feature (68)..(68): n is a, c, g, or t
tcctcaaaatacaccgttttctttgcttccgcaatctgtgaatganccgtcgacgagtaccaaaaatntattttccagaataattgtcatatttattagctttgttttggcttctcttggattcaagtcgaatttttgtcgaagatttggaaatgccaaattgtgtgaaattcgatactcaaagagttttggaagttagttaattctcatattttaaattaaaaaaattaatagtaaatagtaataattctactttcagctattgaatttttgtgttcgaaagaattcgaatgggattgagcagttcgacgtcttttatctgcaccttttgctgaacagcgaaataaattgcataatgaacaccgaaattggacttatcaaaaaggtttgtggatgttcccgaattggctcaccattgaatgaatttgctcctaaggaagcggctgccatcctcgattactgtatgctgcgaaatgcccgcaatttgcttgaaggagcctgtgtccgtctgcttgagggttggctttcggtgatgaatgttctgtccgtgcactgtcccttgcctttcatcgatgcccgtcgctttccctttgcaataaattcaagatttaccctataattcagaaacacaccaatgtcttctggtcgatgcgctttttcttctccgttcctattgcaattgcgtcgaaatgagttccgaattggcctcttctgttgcgttgtgcatttcgcgaactgtgcgggcaatttgtggcattttccatagaatccgcgaggtccagccaaatctttcgcccattcggcgttctctactgcccattctccatctcctacttcaaatcattgttcttcctggtaaaaccaaacattcatgattcaataattgtaaattcaggctacagcaaatcaatcgctttcaaaatggagctttattcaagttgtctacgtgttttagacgtttgtagcgcaccgccaaaaagtgaaacagaaaaagttacgacgcctgtatcaaaagacacaacaacggagttcaaaaatctatgtgatttccttctttcaaaaactaaaagcgaactttttggtggaagaatggaacaaaacgacgaaaggcacgacggaagcagcgaccctttggcggaaatgttacagaaaaggggca

SEQ ID NO: 35946 - DNA, 803 bp, Heterodera glycines
gacaaatctggcatttgccaaacaataaaatgcagattcagcgccatcagaaaacagcaatttgcacgggtccgggtgtttccgggcccacaaaagccggatccgggtccaagtttttcaacaaggtcaaccgggtcctgaaaaaatattcaaattttgaaaaaaaattcacgaaagaatttgtgctttacaattattaaaataaatattttcgatagattaatataaaatcaagtaatattttttgaaaaaactcaaaagacacaaaaaattaaaaaaataaatttttaaaatttcaaaagatttctccaaattacttgagtttttagtttcttaaaattaattattttcatgaaatgagaggtcatgttaaaaatttataaaattccttctaaataaatgaattataaaatccatttaataagagatcatcttttgaaaaatgtcaaccctttaatctcattcacagttgtcaacatttttgcaacagctccatcggatgttggcactttttccgaattgtgccaatgtcccttcctttctcatttttccgttccgtctctttttccaagttttttccttctcttttttctcttccctttttttctccgacgaacgaattaatttttttgttacaattgaattgcgaatgaatgctttgcctttccacttctgctgatggtttgtttgctgatgaccttgtccctatttttcctatttatttcgtccatttttttttggtaacgcctttcgactgtcaaaaagtgcctttatttttccctattttcccttgttttgctccc

SEQ ID NO: 35947 - DNA, 697 bp, Heterodera glycines
  misc_feature (663)..(663): n is a, c, g, or t
ctccatggattattgaccaatggccgtcttgaagaattccttccggtgagaattgagaatacaattttgttttttttgcgtttacattttctaatgtaatggctaatcatttaaaattcagtctgtcgctcttacacgcctggaaatgatctcaccgagcattgcgaagcaaattgcaaaaaaacttacgaaaatccaccaacagaaggacatgcctttggaaataaatgtgaccaattactttttttcttcatttcaattttcctcttcagcctaacatttgcgacaccattgaagggtggatccttattttgttgtgttcatttttcaattttatttaagttggctgagtctgttgagaagttcgtccgcgtcgggatctgaattttacgtggaaaatgcagatggaaaatgtgttggcataaattgtgaacatttacagcaagaagtggagcatctgaagtgggtttcttcgtgccgtcccacccgtccaattatctaattaagggaccgaattcgacgaactcaaagtgtgacagcattttgccacaacgacctgcaacccggaaatttcttgcgttgtcaaactaataaattgacgctgaatgccaatccattgaggaacaccgatgcaactcttatgatcattgactatgaatatgncagctacaattacagttgagtgatatcgattcac

SEQ ID NO: 35948 - DNA, 1799 bp, Heterodera glycines
  misc_feature (757)..(757): n is a, c, g, or t
  misc_feature (994)..(995): n is a, c, g, or t
  misc_feature (999)..(999): n is a, c, g, or t
  misc_feature (1023)..(1023): n is a, c, g, or t
  misc_feature (1129)..(1129): n is a, c, g, or t
agtaaaaaattaaattaaattaaaaaaacaaaataaacgcgatttttaagaaattaaccaaagtgttagccgaagcaagcaaaggttagccaatttaacacttcttttttaatagctcaaataattttaaagggagtcactcaatcgcctcattattcggttcaaacaaaacggacaaaaagtgatcggtggctcgaaaactaaccaacgattgttactatcttttggcccctttttattttgtttttttttaaatattctatttttaaacaattgctttttgcatttattgtaattattatttttattaattatataaatttattggtttatttcacataagtccattttgaccattttttagcaaatgtcgaagagaaaaaacgcctctgacaaaagcgaatcggtggcggaggggtcgcccagtcccaaattgggtttctccgcttccaattcgatggcattttgttcggtttactttaagcgtccattttcgtcaacccttctcagaggctgaatgggctgtggaaagtgatccccgatcagctgctcatttactccgtcgatggcactgaaaatcgaccgaaaattgcggcatttgatttgggtaaatgggggttttgggaaaacaaatgtgtgattgccttgcacagatggcactttgatcagaacaaagtccggcaacacttttgccaaaaactgcgacgattggcaattttggtcgggcaaagtgatcggcgcattgcgaaagtgcacnttccgaggggttcaaagtgtgcattttcaccaaccaaaagggcattttgggtgggaattggcatcgaaactcgaaaaaaatgaacgcaatttccatccgcagaaaggacacgtcgacgcgggtcattcaaacgaaaagtgcaaaccatgtcacgcaaaattggagtgcccctccaggccacaacactttttgccattgtttgacttttttccccattttaaggttttttgttcgctnngganctccaacacttccgaaaaccttcngtcggtcagtgctaatggcataagcaattagtccaacaattgcccactgcgggacaaagagcgacagtccgtttttatgtcttttggtgttcgacccccgccggcntttcggatggtatcccaaattcattcaaatcggaaagtgtgaaaggagttatagccaaaaacggactgtctctcagttggccatcgctcagttgtcccttccgttaattgtcccgtaacttttgcaatttttcaaaaggaatgtggcaaaagatggaaggcgaagagaacggcgaagtccgagtcatccgagaagactcattttacgtcggagatgtgagaaaagggggaaacccattaacaaaatcactagtcatgtcataagaaacactttaggctgctggtcgccttaaatcatcggtttttcgtttttttcatttttccgaaaaattcgccgttttattttctcagatccgtcccaaaaacgaccattcgtgcgccgaccgactcttcgccctcaatctttcgctgacctttcaaacgcccgaacagtttttctccaaagtctctgccgaagagccgttccgtctgcccgagttcaatccgtcccaattccttcgcgaacattccgcccaatccgtcccaagtcccttcccccgccccccaatttccaactctaattagtcgttaattaacttttcagatgatttccaaatgcccggcccttctctccccgaacttttgctgcaaaacggttcgcccgcctccggcaaaagcactttagcgcgtcg

SEQ ID NO: 35949 - DNA, 601 bp, Heterodera glycines
tgatttgggggaggggaggaaataaaatcattcatttgttggtgtcctttctcctcccacgacaaacgcacttcatcatcatcatgcccagcagtaacaccaccaccgcacaatcactcatcagcagcaacaaacagcacacggaaatcggtgctgttcaacgcgagcagagaatgacaaattgcgccggaggggcgaagggaggaaaaatgcgaggcaaaggcgggggaaaggcgagggggggggagaggagaccgggggcaggggacccacgcggacacccaccgaaaagtgattagcaaaatttggggaaactcttcttcgaatgtaactgatcaaaaaacagtgggggctcaggggcatttcactcagtcattttcagtcaactccaattaacttttgctttgtaccctcaggctattatcactaattgccccccccccatttgtttgacatttgtttttgaaaagatatgccatttccctcgttacccttttgtgcccgcccagtcatgacatgtcgaattacctgcccaccctctgctgatcacagcaacacaacccccacccatgcccccccccctctttagtcaccccttttc

SEQ ID NO: 35950 - DNA, 750 bp, Heterodera glycines
  misc_feature (656)..(656): n is a, c, g, or t
  misc_feature (684)..(684): n is a, c, g, or t
tttgatcaaaaaatccatcgaattacaactgaaaagtaatttggtcgcgtaacagcaaaactgatcacaaatttcaactgaaaagcaatttgatcgcgcaaaagcaaaactgatcacaaatttcaactgaaaagcaatttgatcgcgcaaaacaaaaatgatcacaatttgatcaaaaaatccatcgaattacaactgaaaagcaatttggtcgcgtaacagcaaaactgatcacaaatttcaactgaaaagcaatttgatcgcgcaaaagcaaaactgatcacaaatttcaactgaaaatgatcgcgcaaaacaaaaatgatcacaatttgatcaaaaaatccatcgaatttcaactgaaaagcaatttgatcgcgcaaaagcaaaactgatcacaaatttcaactgaaaagcaatttgatcgcgcaaaacaaaaatgatcacaatttgatcaaaaaatccatcgaattacaactgaaaagtaatttggtcgcgcaaaagcaaaactgatcacaaatttcaactgaaaagcaatttgatcgcgcaaaacaaaaatgatcacaatttgatcaaaaaatccatcgaattacaactgaaaagcaattttggtcgcgcaaaagctaaactgatcacaaatttcaaactgaaaagcaatnttgatcgcgccaaacaaaaatgatcacnatttgatccaaaaatccatccaattaccactgaaaagtaatttggtcgcgcaaaagcaaaactgat

SEQ ID NO: 35951 - DNA, 1273 bp, Heterodera glycines
taccatcaccaacaccacggctactatcactggtgttcatggcacaggtaaattcaccatcgggcattacgccaaccgatttctgctgttgggacattgtgggaatgtccatcatctcctctttgatcagcttttgtgtttcaccacccgccgaagcagcagcagcagaagcagtgcctccttaacaaaagagaaggggtaaatttgaatttaaaatatgatacctaattttgttctaggaattatgacaaaaatagatggagccttttttagggatggaaagaaagttcaaatcgggatcccgacaaaatcggaacttgagtcccggtgtcaggacgcaaatcccggcaaaatcaagacttgaattccattccgggcctgatataattctgaactcaggtcccacatctttttcaaaattccgggttttctactcatatcacagggactcaattggccacctgtccccgctgctggcggcgctcttttctcttttgcccccgccggcgtttttgttgttgtcgtctccttcatttcaccatattcatttagctcggattccatttccgacaatttgatgcgctttatttggtcttgggcctcgagcagcggcactttgtgctgggacattcggtgccgcttcacattctttcggcacgaatacctgacgaaaaggaaaggaagggttggggtacggtagaatctttgcttctttttttttgccaactcagcttcaataaaatttctcgaagtttgaaccaagaaaattgacataaaaatttgaagaaaatttatatgagaagctttctaaaaaaaatcttagaaaaaaacttttataagaaaatttcaagaaaaaaataaaataaatttctctaaccattttttctaattttcaaaattctttccaacaaatagatgaaattaaaaaaaattgtttcttgaaactttcttaatttttcagaggcaggaggaggagggggggggcataatttttgtcgaacctctaaccctatgaaaaaaaaacggacggttttctgcactctggacaaaggtagcgataaacatttcggcctgacgctgttgttgtcaatgctgccgttgtctgttggctttttgaaggtgccgaggacgacgcgctgccatcaacacaacaatcagctgcatcagcaccaccaccgccacttttcttaacacaaatgggggtgtgagaattgagtgaaaaacgattttattttctaaccaaaaacaaattcaataaatacaaacgaaacat

SEQ ID NO: 35952 - DNA, 1280 bp, Heterodera glycines
  misc_feature (41)..(41): n is a, c, g, or t
  misc_feature (1245)..(1245): n is a, c, g, or t
aatggatagtaattaacaagacaaaaggatcaaaagcgaantttacaattcggaccgatgatgactatcacaaatttgaggaatttccgttgccggaccatgcgctgcccaacaaaatccgctttagagaccttcggattgagtaaatttatacttttgttcattcatgcacaaaaggtgtatcaggactcgggaccgaagaattctcatacaaaggcccaacaaattttttccatcgcgactttttttgtgactttccacattgcttttgtgcggggcgctctttcaaaaaaaattttttttttttttgaagaatgggatgggagtagagaatggcaaatcaacctttttattgctttttgcggggtatcaatttaaatgtgcgtgtatgctgactgatcatttttccaggtacattgaccattccgtgatcacatttctccgttccaacaagcaaatttttgaccgaaatgtcacctatttggggttggatatatttacagacataattgaaaatgatgaccatccgatttggccaattttggcccgtcaaatttggccaatttttgcgacaaacattcacattttggactgtgccgatgacaatcatttggacattttggcgtaccaaatttcaccgacaattctcaccgatgttgatcaattgaatgtaatcgcttttgatattatgttccttgatggaattgatgatgaaatttctactggccaattgttgtccgaatggttgcacattccgagaaaaaatggtaaaccgaagaaattgtattgcggcaaaggatttaatgttgaacgacacttagattggatcaacagtttcaaggaggtgcgtttggtcacattctcataaaatttgggttaccgtacttacttactgcattagtacccccctctgtattaaaaccgccctttcgagagagggaataaatagtctgtggtttgttccccccttattcaaaaaaaaaaaattaaattttcaaaaatcttgttaaacaactttttattgggctttcgaggttgctgaccacgaatctgatacccatttcgacctatttcggaacccggacctgaattcagttcagattcaaacataaaagtgaattttgatgaaaaattgattttcgatttttgttcgaatttggatcatgggttcgaaattggtcgaaatgggtattagaatcgtgatcagcgacctctaaaactcataaaaagtgtattacacgattntttataaattttatttttgaaaggggggggggggg

SEQ ID NO: 35953 - DNA, 926 bp, Heterodera glycines
tgaattttatataatattaatttgttttttttaaattttcacctttattttaattttattttttgtggttttataataatttttaaattatcaaaataaattaatttttagaattttagttttatattttctttagatgattagatgtgaatataattacaatgtaacattagtgatgaagtttaaatttaggatggtgggaattatgttcattttttgatggttaaagagggctctatgatataaaaaaatgcttaaattactaaaaatttttttttgcaatttctaatcattgactttctaatttttaatttttccctataaatttcataataatcgttcatcatggctgttaagccttttcctgcaaattagctgcttttcatttctgcacacaaacactgctacgaatctgccccgtccaatcggcataaattggatagcaaatcactctaattataggcaattggcaatttttggcacccaaaccgatcatcactgtcagttttgacaaccaaattcccatttattcgaaaatgccgtcgttatttgaaagggtctgtttgcgacaaaactcgctgtaactttatatgagggcttgacttttttaaaattaaatttctacagagtgagggagagaataatgcttgtgacccacttattttcagcatttttcaatttgtaaaaagttactttcggttatcattttacataatctccaaaaaaaattaattattttccttttttaatcaattgagtagaaaaaagaaattatttaataaaaaaaaattcttttaaataaatggccagtagggaagaaaatataattttattttttatttttttccaatcatttttttaccggagatcagaagagacttgtgattttttcatgtgaataaaaaagctctttattgactaaaatg

SEQ ID NO: 35954 - DNA, 1001 bp, Heterodera glycines
tttttgctccccataattgtttgagtaccccaaacggacatttgaaaaaatcgatttatttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcgggcagtccccctgaaccgatgcgcccagatttatggggagaccgaatccttcgggaatagcttccctatagcctgtactttaattctgcgttggatttttgctccccataattgtttgagtaccccaaacggacacctgaaaaaatcgattttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactaaggagggatactgaaaggaagagaaataacctattttaa

SEQ ID NO: 35955 - DNA, 1268 bp, Heterodera glycines
  misc_feature (123)..(123): n is a, c, g, or t
  misc_feature (1003)..(1003): n is a, c, g, or t
  misc_feature (1121)..(1121): n is a, c, g, or t
  misc_feature (1149)..(1150): n is a, c, g, or t
taaattttcacgccggatgaacagataaggaaagaaaaggttttgctgttgcactttcagcgttcaatccaaatgtgcgtggcagtgcatccaattcacagaaaaagtagttcagcgagtctntaaagatcacgtgtcgttgatggttccctttcaaagtcatcgaaaaaatttttagtcccgttgtgcaaatacgctttggtggcaaattgcgccggtgaagtgcctccagtattaaatgaatgtcgtattttccgccattgtgtgataaacaaattgttttcacaccatgtggaccacttccggtgagaaagttgataaaatcgtccaccgggtcattgttggtagcgtcgtcaaaactatggaaaaacagtcttcgtgggttgtagtggacattggctgatagagcattgtcatccccaggtgcattcagaaacggaggagaacaccagcgacgcccccttggtcccgcaggaggaccacacacacacccatttgcgtattgtccaacaccagaatgaaccgaaattccttcatttatacacgcttcgcagataatttcggcaataatgagcattggaacatgtttctgtacaacctttgtacgcagttgaagtggtaaatcttgggacgtttcagcgtcgaaaaagcaaagtctgaccgaccgatttgttccaacttcttcttcttcctcattatcagcatcatgaccgtgatcgtcgtctccctcctcgttaccatcattatcatcatcatcgtcttcgtcatcgttattattattttgttgttgttgttgctgttgccctcttcttctccttctcctcctcattggttcatctttgagaggctgaataaaacaagggtctccactttgatggggtccagagcatcgtgcacagcgcacccattccgtttggccaatttgggctggacatttatgtggataattcgcataggttatggctccacattgtcggcatgctcttctccattcacatattgngcgaaaagtgcgtcctccctgattatacatgcttataggtgcccgattgctcagatgataggcgaagcagtcgtcatttggaaaaacgattgacaatcacggcaaagacgattgccangtgacccatctgctcgggattgctgttnngttgtgtgttgtttacatggataccctgcgccaaaacgtaaacacagacggcagacgactttgcattccctgcggtgggaccagcgtgtcacgcgacgttcacaatcaatacaatatc

SEQ ID NO: 35956 - DNA, 725 bp, Heterodera glycines
ctaaatcatatcaatggttgatgacttattgaagtttgcatacttttttcatgcatttaaacgaccttactttcttgtatgaccctaaaattatgacaattttaattttctttataagtttaagctcaaagatttctctattttcagttaaatttcaatacattttattgagtttcaaaaagttggggacgaaattattgagtctaaatttttacgaaattttttagttaaaatttttcttagattttttaggtacatatgattgaagatgatacatagagctatcgcccaatgccaagtttcactaatttgactaagtttgagctaaagtatgatttttaattctgtaaataatgttggcgctatttaaaaagagtaaacttttgaaattttttcacttttgtttggtcaattttttttgtttattttaatgcagaatttgcttttttaccagatggtacgcatttcacgctatttaataattgatttacaacaaataaaagtatattcacgattttttataaaaaaaaaaaattttcaaaacaaacgggaccccctatggtttttgataaaattcaaaaatccaaagtctaaaaagtatctttttgaaatttttttcactttgttttcaattattaaatagcgtgaaatgcgtaccatctgataaaaacgatttacataaaaataaagagaaaaaaaaattagaccaaaaaaagtggaaaaaa

SEQ ID NO: 35957 - DNA, 1332 bp, Heterodera glycines
tatgagattgtagttcatgccaatgcgtttgataagttcggtttttcaattggcgtcaattcaaaaagtttgttcagcagatgctcctaattgacgacataagcgagtcccgaggtaataatcatcacttctaattagcgggggctcaaatttgaattggtaaaaattatttcattcgaaaaagataaattgtgtatgcacaaccgcgcaaatgaaaattttcatgttaaaagtcggaatgatttccaataaacgtcaattattggaagcagggaacggcacttctgtgaaaataaaatttgcaattgggctatgtttttcacctgacaaattggaatatgagactgaccgagaataaaaaaggattaattttgaataaaaattgaaaactttttgtaattttctaattattttttaatttaaaaaattttcattgttaataaaatttaatttttctagcttaagtcccggtcattcattcacctgtttctcacgtgctaattcccttaataatcattttaagattcaaaaaagcattttcttttttcagtttcctatttctcagtatggctcgacttctgcttttagtttttggcttggccttcgttttcgccgttttggcctttggcactgcgcagcccccgccgcccttccaagggagcggttcgttcagagaaggtgaagccatcaatttaaatatttaatttgttatttttggcattttaaggccaattcggcgcccctccgtttggtggcaattcggcggacgtttcagtctcggcgagtgattcgtcggaatgcagcggagaaggaggaaatggagtgcaaggaggtgaaaaaaacgcgcatttttactttataatttatttttaattcaggtggggaatacggtaatggcaatggcggctttggcggaggcggtgccgaaggtggccaagggatggacatcgatgtggatgttgaacaatcatccgagaagtgaatgattttaaccacggttttttattgaatgtgatttgttttcttggtgtatttagaattcggaaatggacattcagcaacgataaaattattaccaaattttatggctttaagttccgcattagagccgtgaaaaattatcatttacaataaaacctcattatgaaatccatttgcaataattcaatcattaatgatcaagaactagttaaaattcgaaagtttgaactaattatcaaccaatttcgtgaaacctataataaattttaccagatttacacaatttttcctctattttccctcctccaatgcaaggagtcacttcacaaaccaaagccttgccaaaatata

SEQ ID NO: 35958 - DNA, 875 bp, Heterodera glycines
  misc_feature (16)..(16): n is a, c, g, or t
  misc_feature (72)..(72): n is a, c, g, or t
  misc_feature (151)..(151): n is a, c, g, or t
tcattaagcatcattngatcttcgctactaatgaggcaaacgtcggaaatgaaaccttttcaagaaaagacngcatcttatataaaaacatattagtaaagaataaatttgtaaaaatttatcgcatcaaaaatcaaaatgatttacattntattttctgaaataaaatatattaataaattctatacccgccggaaggaacaaactcgcgcagaatttttacttgaattgttctttcatgcatttttgtgggaaaagcaggaaaaggagtcattcagcaagagcagtggatttatttaaaattggagatttttgcaagaaatttttaaaaattaattagattttagagtttgaaccgaaaactgtgggtgattcaacaaactcacaattataccacttcgtttgaaaagaaaaaatattattttaagtctaaaaaaatctcacgtgtttttagggaaagaaaaattttaattttaaacgataccaccaaaatttaaataataaacattttttataataaaaagaaattgcaaacaagttggcaaatatttcacacattttactgtatttaagaatcagcagacatccatctattttaatcaaaatttatcctaaatttgaacaggagatactaaaatttaaatttcgtttgttcgagttcccgtttatgattaggaatttcaagattgattcagatttgtaatttgcgtccctgaaaaactctgtaacaattagggggagtttgtaaatagggccgattgttttcccctgttttcctgttttcaaccctttcttagcgaactataataaattaccactgggtcattaaaaagattaattttttttaatcaacgggctgcgcaaaagtttttttt

SEQ ID NO: 35959 - DNA, 658 bp, Heterodera glycines
  misc_feature (516)..(516): n is a, c, g, or t
  misc_feature (524)..(525): n is a, c, g, or t
  misc_feature (532)..(533): n is a, c, g, or t
  misc_feature (546)..(546): n is a, c, g, or t
  misc_feature (581)..(581): n is a, c, g, or t
  misc_feature (627)..(628): n is a, c, g, or t
aggtgttttcgacagtgattgatttcgacagtactttttaattgattttctacataatttattgtacatataattaatattataatatacgcttccatatacaaaatttataaaattaggacttgtatgattatttttgtgaaatggtttatcacttcactttttctatacaaacatcacttgatgactgtagtcaagaatacaaaaatttcttatatatttaagattttcgaatcgtgtgggaaaacctgccaatgaatgccgggtttgagtgccaagatgcaaatctgcaggctcaagcagaattcgaaaatcgcaaacccctctgcaatgtagaagagcatatgcttatccttttaataacagcaccgagcagggatgttgcgaatagaaaaataaaatacgagacacgagaaaaacgagacaataataagacacgagaatacgagacgagacaagatcgagacaaaatttttttaccaaaaaaaatcaaaatttttgattattcatttttancgagaaanntgtcggnncggaatctatctnaagataaacagtttttaaaatttggttcattttgngcgaagtatgaaataattctgtcaaaaatttttttatttttatggnnttttgatctatttatgtacatcgtgacgct

SEQ ID NO: 35960 - DNA, 777 bp, Heterodera glycines
ttaattgccatgaatttttgagggcattgccatccatatgcacatgtcagcattttgggaaagtaatttaatagaaaagcatttatttgtttataaagaaattttttattattttaaataaatatttattattagagaccggatttttatgtgctaaaaatcctgaaatatgtaataaaatatgtgttaaaaaaacccaaaatatgtgctaaaaacccgaaaaatgccaaaatatgtgttaaaaatgtcaaaatatgtggtaaaaattttgaaaaatcaagtgttttaagcaaaaaaaaaatcccagtaagtctaattctttattcatttcgccagcacaattgcaaattaaatacatttcaaggtgttctggggtaaaattgcctttttttgataaatcatttctataaattgaaagttccagcagagaacttcgaaatccaatgacgaattaatgaattcgattttgttactttctacattcgaaaaaaaattttaaaaatttgaaaattctataagaattgtgaacaaaagttgatttttaggggtgtatttttcaattttcttgtatttttattgctaatttttctcaaaaatgccaaaatatgtgccaaaccccaaaatatgtgctaacatattttatgtgccaaaacgccaaaatatgtgtttttatgtttttataagtcgctctaaatcaaaaattgttcggagataatgctatttttgggcttctctcgccataactaagccgcaaaaaaaatatgtaaaaacataaaa

SEQ ID NO: 35961 - DNA, 751 bp, Heterodera glycines
attaccatagcataaattgggttggggtgacaaaacaaaactgctacatcaatattcctacgtgaatggcataatacattgtgataattttttgtgtaggaaaaaaaccgaaaagtaccggtttctcttcatcccttactgtcttttcatttcctcgggaaatttaaaatatattttcaaaaaaatcttattaatatttccgtcccggtttttaaatcccgaacttttttggatatatagctttaacaatttgattttttattttgagatgtcaacactgtgtcgcgctttgtggatgaatgtcttggccaggatgggtatttgatgttgcattttgtgtcgcaaaatgcagggaaactcatcgcttctgagctgaccacccttttgtttgaccttatgacggcctctgactgattggacgccatttacatttttatgcattttcaatacatgttaattttgtcaggtccaattttggtttcattactttttcgcttgacattttctcctttgactcagacttcgatctcttttattgttttttttaatttgcttttgtttaataaatattatgacaattgggtgggtcttgaaaatccgatttacctatttaaatgaatcgactacggcggccgcagtgagtggggcgctgctcactcggcgcccactactgtatttgttcctcacattcccctttttgcaaattattattttccctccgttatttttgtggtacttaaatatctatttt

SEQ ID NO: 35962 - DNA, 628 bp, Heterodera glycines
  misc_feature (597)..(597): n is a, c, g, or t
cttttttgacatacacattgtagatctttggtaattggattaattaattttctataaatggaaattttaccagatgcatttcttccttttcgactgctccggttgcccgattgtaaatatccattgagtgccgtgccaatccatgctcttcctccagttttgcgtaaagcagataaatatctaaaattggaaatttacaatcaatgtagtattaagtaacaacatttacttttggcatatttgggtgggcatttgtccaagcattgctcaaacaaatcgcgagctctttccagctttttgccaccctataaattgaaaatttatagtttaaatagaccaaaaacacagcacatatcgttggatgaatttggtcagataaacgttccaaatgtcaaatacgagcggccaccggaaaagcccaattcccttctcgaacgccttgaaagcatcctcaaagtattggttgtcctccaaaaacagtgcataatttatcacgatttgtggtgttgctgaaattactccgggtaaatcccattggatgcttttcaagattcccagtttggtctaaccaatttcgcactccaacatccgctcatnaattgcttgcacttttcagtgagccatcgac

SEQ ID NO: 35963 - DNA, 1104 bp, Heterodera glycines
cgaaaaacaaattcctttaaaaaccgaaattagtgcgaaaatttgcttcatgaaaggttgaagttgaagacgagcaatggaaacgaattttgaaaattgacgaagaaaaaaaccacgcaattcgggcttgcaattttccattgttccaatcaaagtgggaagtaactaaagataaataaatttaaaaaaataaaattactaataaatacatggtgaacgtattgaacagttctcggtccaagagttgcaaaaatttggagcaacgcattcacaatttccttatgcaaagaagagagcagttgcggctcacgcatcatttgaacgaggttggagatggccaatgccgggtaatattccgccaaagtgcaccgctcgtaatttatccattggattatatcggtgccatcttcaaaaataaatcaaagccgtttatgggaattgcaatgctttattaatgcgatcgcatgcgtacaaagtgtcgtccaatttacccttcgctgcgactctccctcccctcccccgttattgtccctcttcgactggggagtgagggggggggggggggggatcggctggccgacctcttgtcttgtacaccagggatgggccaaattgaaaaataaaaagcgaaatgcgaaaagcgaaatttgcgaaactgaaaaatgcgaaatgagaaaaaaagcgaaatgcgaaacgccaaaatatgcgaaaatgcgaaatgcgaaaagcgaaattttttctacaactttttaatagttaaaattagagatcgacattttgaaaaatgcctggacctgaattccatgttggacctggatttcctggacaaaaatccaggaaaatccaggtccaggaaaaatccaggctcctcgagacctggatccaggcctggacctggatttttttaaactcattttaaaaatcaaaaaaatgtttgaaaaattcaattaattgcttgggaacatctaaaaatatctaatttacaataataatttgtttttaaatatatttaatcattttttgaacacttgaaaaaatatcggtcacttgaaataataaattctataatttttgccaggaaaatccaggttctttcctgttttg

SEQ ID NO: 35964 - DNA, 1099 bp, Heterodera glycines
tccaatcactgggactcaacccaccagcattccaatcactggcactcaactcaccagcattccaatcactgggactcaattctcctgcatttcaataactggcactcaactcaccagcattccaatcactgggactcaacccaccagcattccaatcactgtgattcaacccaccagcattccaatcactgggactcaacccaccagcattccaatcactgggactcaacccaacagcattccaatcactgggactcaacccaccagcatcgaacattttcctcgtcttttcttatttcttgtggcatttccttatggcacaacattcttggcattttcatcatctcttcttgttcttatcttttcttatttcttgtggcatttccttatggcacaacattcttggcattttcatcatctcttcttgtttcttgtggcatttccttatggcacaacattctttgcattttcatcatctcttcttgttttttggcatttccttatggcacaacacgacacacattagtgtctcacactaaggtcacacaaaccactaatgttttttcaaaagcatgacacacattagtgtctcacactaaggtcacagaacaaaccactaatgttttatcaaaagcatgacacacattagtgtctcacactaaagtcacagaacaaaccaaagatatgcatttctattcattaaaagttcaaataacattaagcataagcataattatttcacgtaaagaacacaaaaacaaaataaacaaacaaacaaacaaacaaacaacaaccactaaatcaaactcaaacaatatactgataaattttttcgtttacaaaaaacaaatttatatgacaaataacttaataaactatgaacatacataaaaaagcaaataaataggtataattttaagaatgtttattgcaaaacaaattgaaaaatcaaaaccaaacattttcatttttcaaatgcttttttaacgcaaaacaaaacaaaaacattttcattttcaaatcattttttaacgcaaaataataacaaaacgccacacaaattcaaaaatccgtacatacatacagacactcaacttta

SEQ ID NO: 35965 - DNA, 710 bp, Heterodera glycines
atttccggaacttcatatcattgaagaaatgtgaaatttacattcttaaggatcattgataactttgttggttacgccttttagtgtatatttatttcctagcacagaatcctatttcgttctttaatacagggtcagcttcataaattgaacaagaaagaaacaaacagttcgcttaatcggtccaagttttgaaaagtttgcagaggaggcgccgtcggaatgactcgacccttcggcggtaagaagaaaaagttcgaattggccgttgcaggatttgaacagaagttgctggtcatctcggagttcaaccttcacttcactgaagaaataaataatttgttacttattaaatttaaaggttcttttaacataccctttcaaattccaatatgtacttaattatcggggtcgctgatcgcaaaaactcaaaagtttgcccctgttcgggtccaggcttcccaatacttttacatagaaaaataaaaacaaataaactgactgaccctccaacttcggggtcattcgctttgcaataaaatttgaaatttgttcgattcagcaccgatttaaaagcagctaaaaacaaattataaatgaaatcaaaaatagttatctgttaacccaatgtgattttgtcagccgaggcgggaacatccgtacagtagaggagtcggttcatcatcgatgtgatagtaaacctggacaga

SEQ ID NO: 35966 - DNA, 880 bp, Heterodera glycines
ttcataaagtgccaccacgtccgtgtttttgctccaatttcatttcatcatacacaaaatttacgggctggggctgaggtaaattattcaaatttttgcggatggggacacctaagtaggtgtactaaatttttcaaattttaggacagtggttttttggctgtaaaaatttgtattttggtttttcaggtgaaactttcattgccgccacacaacgggctgatggtaaatttccaaattgttttgcttttttctaattttagaattgtaagtagcgagaaaccctccacatttggggaaaaatggagaattctttcgtcgggtcaaagccgtcggacgcataatttcaccttcatttttagaaaatttgtcaacttacagaaaactcaaatccaaaaaaatttgaaaaatcattttttataatctttcccctctggctaacgaattttgccaaattttttatagatgtagtgttttccagggactttccgagttttcgtgcatggggagaggcatagtgccacaaccacaccaggatggggctgtcatgtcgatgaattttcggaattaaaaaaaagttttttaaattccatcaaatttgaggcagttggcgcaaaccgcgccgggtgaaggccggctacgtgccgcaggacgagcagccgcgtttcgagtgccgggcgcaggcggagctgcgccagcgcagcggcggcgccgaggacagtggcgccaaagtgccgttgggctgggacccggtggcaatggtcaaaggcacgccgacaaagcaagagcaaatgccatcgaaacagcaacagaaacaaccgcagcaaagggtaaagggacggtgaaggcacttttaacgagtccaaccaaatccatttgt

SEQ ID NO: 35967 - DNA, 603 bp, Heterodera glycines
aggaatgatagaggaagagaacgagaaatatgaagagaacgagaatgaggaagaaaagaggaaggaaaaggggaacagcaaatggaagaggaacagaaagcggaagagaagaagagcaacagaaagtggaagagaaagtggaagaggaacagaaagtggaagagaaacagaaagtggaagagaacgagaaataggaagagaacgagaaagaggaagataagaggaaggaaaaggggaacagcaaatggaagaggtacagaaagtgtaagagaagaagatcaatagatagtggaagaggtgcataaagtggaatatgatcagaaagtgttagagaaagtggaagaggaacagaaagtgtaagagaaagtggaagaagaacagaaagtggaagaggaaggaaagaggaagagaacgagaaatatgaagagaacgagaaagaggatgaaaagaggaaggaaaaggggaacagcaaatggaagaggaacagaaagcggaagagaataagagcaacagaaagtggtataggagcagaaagtggaagaggaacagattgtgtaatagaaagtggtataggtacagatagcgtaacagaaagtggtagag

SEQ ID NO: 35968 - DNA, 595 bp, Heterodera glycines
gtacaaaaaatataatacgaacgtggtagttattaataattttgaccagctatgaaagtgccgcggattgagcagggagggctctgcctttgactcaacaacgggcgcagcggtccaaatggggttttcctccccagcgccaagggggaattccgggggtgaaacaatgtcccgaaactcggcgggccattcccgctccgagagcttgagccaattaggcccaaagtgccataaatcgaggccactaatttctctgggagaagcccctcgtgtgcctaaatccgcgggattatcattggacctaacgtacttaaaaattgcttccttttctctccgaatttcgttaaggcgattggcaataaatggcggttggggggtgtcgttagccacccaagataaaacaatttgtgaatcggcccaaaagaaaattttttcaaaaatatagtcgaaattagcgacgacaaaattttttgccctgaccgcggcaagcaatcccaaaagctcaagccggggtatggttagcccatcgttcttaaaccttttcggtctcaaacggaagaagcgaagaggaggtaagtcccaacccggccattat

SEQ ID NO: 35969 - DNA, 1076 bp, Heterodera glycines
  misc_feature (1054)..(1054): n is a, c, g, or t
  misc_feature (1072)..(1072): n is a, c, g, or t
aatcaacacagcaaaagggatttgactttgggggccccggtaatttaattccaaaaattgcttaattaagtataaaatatttaaaaaagacccttaaacattttttctcacattgttattgcccattttgtttctcaatttcgtggatttttgttcgcaaagataacacttcgtcgatcaaaataatctgaaaataaaaattctataaaaagttatttcaaataaggttaaaataaaatgtaactaaaacactcaccagttgaattcttgctgatctgcagggcatttgccattagtgtggtcccattattcactattaaataattaatttttttaaataagaaatttttaatcataaaaatcactgcttgattttttggcgacgcgagtatttgttggctgaaaatattcaatcgtttttaaattaagtaatttaatgtgctgcacttgataatgatggctcattggttgcgtattgttcaatttcgttgccgatcgctgctgctgtaaattaaattttaatgtattacaatttcaaggatgaggaaatattcataattaccactacagcaattggtaagggcgggaaaagcacgtgcaagtaatcacctgttcattaaaaagtctaattaattttttttgtttttgtcgatcaaacactgactacaatgtttaaaatatttgacaaggatttgaaaagctcatcggattaaaaagattgcccaccaattgataaaaaaaataaaacgtaaataggtataacactcaccatcagttgtatttttgctagttacaaggacattggtgcgcgatgtaacattattttctgataaatatttttttaaattaaaatacgcaatttttattcataaaatcactgcttgaattattggcgacgctgatatttgttggctgaaaaatatccaatcgtttttaaattatgtaattaaagtgctgcactttatcatgatgtcccatggcttgcgtatggttcaatttcttcgccagtcgctgctgttcttttttctctaattcgacattttttgacgacgantgtattctaaaatatcanaaaa

SEQ ID NO: 35970 - DNA, 949 bp, Heterodera glycines
tgtaatggcattttttgtagtgggatgtgttcgctcgaccctggcacggtctaaatcatgtcgaacagcatccagatttaggtcacccgtgttggacatggaggtgagaccacgataaatttcttgcgggacaagtaaaaatttatttgccatctctgttaaatgaataatggaattcacaaaattcaacaatgatgagaggtatttatgcgtttttgttcacaaaggatttttgccacttccattagaacgggtgtcaatagggcagcgtacaatccgccaaatcctgcgtctttctggacaagcactcgcttggcaccccgttcacttctcgctctgctgattcggcgtacagtatccacataaggcattagtcgcttcttctgtctggttgtcagttggaagcgcgaagcgacgagattcaaacaaatttcgaccagcgatagtagttgttcagtgtttgcatttcgtataagtttcctgcatttttttccggattttgtcctgaccaaggcacagagccaaccgcgattctcttttatcagctctccaatctttactggttgctgtttatgccgctccatttttgggaatgaatacaactgttccttcgtcttcaccctgctgctcgtccttaaatatgttggttcgcagccgtaacgatggatctgatgcagcgtgcatatcaatcatcaaatagccatagggacgggcggtcgctttgcggtaagcatcaaggaaaaagtcgagctgacgcggaaagagttggataccaatgttgcgaatggacaacagggaattaggggcccgcatcagcaccaggtactgagcggacaggcgggccactttgattttccgctcaaacggtgggactcccgaatacacatcgactcccgccttttgaagcggcggcactgtcgaattcatttcaccaaaacatagagcattg

SEQ ID NO: 35971 - DNA, 838 bp, Heterodera glycines
ctgttattggtcaatttcgtgcggctgaacaccgaacatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggagagaccggcagaaaagccaaccaaaccagtaacacaccaagtgtgcaccggacggctagcacagatcccactacgagctttttaaccgcagcaataattctatgcattttg

SEQ ID NO: 35972 - DNA, 1338 bp, Heterodera glycines
  misc_feature (1314)..(1314): n is a, c, g, or t
ctttcagataggcatcggtgtcgaaatgctcgtggaaatggcgccggtcaaaaagttcgccgggcattcgtcgctcagcggcagcggtcccccgcttctctccctttgtgctgctacagctttcctccccttccgaactgtccattggagttgctgttggggcggaacaaaagagaacaaattgaacccccttttttaggctagcaaatgaaagccggaaaatgaaaaggacgacggacggacagaagggaggcggtggggggaagttgggatctttggacgaagtttggacaccaagcaaaagtcaacacagacggaggaaagagaggggagagagagtggaggagatgaaaggagagacagagaaagagagacaaatgttgaaggtggagagaatgaacgattggcgagggggggggggggaaagcagacttgagtaaatgatgagtgatgaatgatggaggaaaagccgggggaggggtgacggcagagacgggggggggggacgattccgcggaagcgaccgatcgacgaacgaataccaccatctcagcagagaaagggtaatttatttccaaattatagacaaatcccatggaaataatccatcgattgagctaggcttactgaaacaaaaaggtccaaaaattgcaaaaaaattcaatttgagaggggaagcacagatcgaacagcgaaaggcgtgcagaattgttatgactcgtccaaattgttcttccgtttccctttcacttctgcgtattcatacggtctcgccacgaagccatcgccttcggtgccgtttcgggttttgttttctccaatggtgccgtcgttttcggtgcaacggcgttcggtgccgtttcgggcctagtcttctctaatggtgccgtcgttttcggtgccgttgatttcagtgccgtttcgggttttgttttctccaatgatgccgtcgttttcgatgtcgtcgttttcggtgccgttgattttggtgccgtttcaggcctcgtcttctccgtccttgccgttgcacccctttctcccgtggcgccctcctccttcggctttgcttttttcggcactttctgtgccgttgtgtctttgctttccttccgctgctctgtctcttttttaggcgtcgcatccgcttttgttgttctatttttgctgctactgctgttgcttttgactgttgcagtttctgccaattccttcgcttttgcgtctctgtccgccagtttctctcgccaactcggaacaacttaatccaaggctcattaactccgtaattgcgttacaatttgttaatggtccctnaattaccccttcgccatttgtccc

SEQ ID NO: 35973 - DNA, 1077 bp, Heterodera glycines
tgtttagtcactttcattaaacgatcttagtattaaaattgtttttcatttttttaataattttatttatacaataattcttttaaattttagatatgttcaaatataacacacggcagtttaatttttatccaattataaagagtacgagttttggaccggccttgggttgagaggcctatattgctttggcgactgctgtacttttgtatctaacataaagagtcttaaatttaaagttttgtcacttatttccactttatttttatatattaaatttttaataaataatcattttgtttcattaccttttgggtaattaaatctttcaggtaattttttgtgttggatatttgtgaccttttcattatttaaattagtttggcgttttgttggcgtctttcctttattgttttgttaatttattttccctcagttcgtaattattgttagttttattgtcttaataaataattgtgctcgttctcctccgactattttgtgttctttgaattgtgtttgagttcgatcttagttagtgtggtccaacaatcccagtcctgtcccaaagccccccttttatttccaacatttgattaatttattatttaattaaaaaagctttatttaatgaatagcaaaatactagtattttgaacaaatgtttttcaaatatgacgccttatcgcagtttataattaataatttaaggcattttaacgaaatattatcaatttttataaaggttcttaggataaattttctaatgtatcaaagatattgaaaaatataccaaaaagagaatttgaaatacaagtataattaaataacttataaaatattaattatcaaagcgtattaaattaattgtttatttattttttttaatgagaagaaaaatggttaaagaaatgactaagaatttatttcatatattgttccataaaagaagaaacaacataactcatacgtgcaacaaagatagaatataaaatgtatataaatgtaatgggaaaagcaatatttaaatttaagaagttatttttttgttgaaaataaatgtttcgacatattgat

SEQ ID NO: 35974 - DNA, 530 bp, Heterodera glycines
ttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcacaaaataaataaaaacgaaagactcagattttccgaaatttttttg

SEQ ID NO: 35975 - DNA, 1140 bp, Heterodera glycines
ataacactgtgcccgcaacgccgaccatggtttcgtgaaagcgatcacatacaatcggaggaaacaacaacagttgccacaacaacagtcggcatggcaagtgccacaacaaactgtacgccaacatatgccacaagcactccaacgagtgccacaacagtcggcacgacaccgagcgtcacaacgactggcacaccggtacttaccaccaccacgagaccaccaacaaatggcgtactgtgcagatgcacacgaaaagagtaccgtatgctcaccgcagacgaacggacaagatatgtaagtggcggaggaagaaaaaaatagagatagaaaagaattcaaaatttaacaatgatagtatttttatttttgtgggattttaggagaaacgctaaaatggaacaaaatatttttaattttttttcttgtttaggaccaaaaataaattataaaaatggatttaatacccgaaaaatagcataacaaaagcatatgaatgtgcttttttcgtatattttaaccaagggaagctcagtaagtcctattgtagaattaaccgatataaattataatgacaaaaaatacttaaattcacagaaaattgattatttcttctgtccatggttaatttgtcgtgtgggtttttgtctgtggctcttttgtcacaacgctaattggaccatgtcaatttttcttggcaattaaattatagaattttggcgtaatattcataatgtttcattgtttattatttaatggtaattagtagggcttccttttttaggcacaaaaaatcgcgaaataggcattaaataggcacaaaaatcctcaaatgggcactaaaataggcaaataaaattttttattaacgtttttaggtaacaaaacacgttaaaacttaaatatttcaattgtaaatgaaattataaaatattttaaagtttttttcgaatatgaacaaatttttaaaccaaaaaatttttattaagaaaaaatatttaattttgggaacaattttttgaaaaattttttcaattcttaagggtgtattttctgaaattttttttgggtcatttcttaggggtgtgtttttcgtttttattgcatttttgttaaggattttttcgaaaatccttaaat

SEQ ID NO: 35976 - DNA, 861 bp, Heterodera glycines
  misc_feature (746)..(746): n is a, c, g, or t
aaaatcttagaaaaagggacattttagctttctaagacccggcccctccaaaaaaggacaaatcttagaaaaaaggacacttggccaatctgattttgtccaaaaattaccaaattttgcctcaatcttattattcttggtaaaatagtgagtgatattatgacataattttccataaatctcttgctttttacaaaaacaagtacttatttatttttaaataatattaaacataaaaaataatcgcttcgataaataatttttttttaattggtccaaaattgccgcggagtcccaaatgtcgcgcatcgcggatcgtgcaaaataaaaaaccgcggccgcgcacaacgcattcaaattgccacgggcgcgaccggggatcgagcaaaaaaaaaaaaaaccgcggccgcgcaccgcgcattcaaattgccgcggccgcgaccgaggatcgcgcaaaaaaacgccgcggatcgcacatcgcgcatcgcggcgcggtcccagccctgtctttgactccatattgatttttccacagtcaaattccctttccttcgttcctccgacaatatttgttttatttatttttgcatttgtctttaataaatattttggtgtatgactttccacaaataattgtttgagcaattaactggctcaacatatttcatcaaaaaaaatcatcgcccaattcggcaagcaattaattagcccaatcgtaaatcaattcccgttatttgataaactanattgagtgaacaaacctttaattaaagaacaaataatatgtatagacattttcttttaattgctttacagcaataaatttattttctcaattccgtccgccaacatgacatttaa

SEQ ID NO: 35977 - DNA, 1332 bp, Heterodera glycines
  misc_feature (692)..(692): n is a, c, g, or t
  misc_feature (751)..(751): n is a, c, g, or t
ttctgtttataaaagccgcttttccctcttttagcctcctcggcgatggtgccaagccccgtggtggtgcccgatgttgaggcggatgcattcaggacgatgttgggcttcatttacacggacgatttgagtgggatggacggagacaatttgttcgacgttctttacgcgggtaaaactttatttttgggttttcccgttcagtttaatccccaattttagctaaaaagtacaacattgtcggcctggtcaacgcctgcttggactttcccatcccttcgctgcccaacgttttcttcgcctttgcccaggcgcgttttctcgaagaaaaggttggcatttatttatttacaattagtcgataattaggggattggaaaataaatgacataccatttgtaaaataagcagcgatgctgaaaacatactaggattaattttcaaaaaaatggaagcctaaagcctctccccaaatcaaaaacaaaaaaattcaacgaaaaatataaaaaaagaaaagttggaataagtaaataaacgtttaaacatataaatttttgatttttaaattatgctaaaaatctaaatccggaatttctaaaaaagaaaaacacacctaaaaaccaaatttttgaattcccccccccacaaaaagaaaaaatctcgggagtttaccagagaagagaacttttatngtcatttgtattacgaatttttttgacctttggaatttcatagtttatttggttcctanaaagcccctcaaatttttaaatttccttttaattttaatttgatttttcaaatttattttgggattttgctcgccgttgcatggaatacattgaacaaaacatggacactttgcaccaatcggacgcctttttggaaatcggccaaagtttgctgtgcgaagttttggaccgagaaaagctggcaattgaagaagaacttacgatttggcggatggtaatgccaattcaaaccaaataattgggtcaattgttttaattgggcctaattaataaagtaatttgttaattttttggcactccattgggcggacggacagtgccgccaaaagggcctcgaatgttcggcagagaatcggcgcaaaatgcttggcccggcacttttcaaaattcgttttccacgcatttcgaaggaggacttcaccgagcacattggtaatggacagttcaaactcaagcgatttatttatgccaactaaaaaacactaataaaccaataatagagggcaggaccaacttttttaaaaataattttgttaaaattttaaaaccttttcccggcggcgcctttaggcaccgccgg

SEQ ID NO: 35978 - DNA, 807 bp, Heterodera glycines
cttcctcttctctttttcctctgttgcttttcttccttttttcctctccatcatcgcttccaattcgctctcttttctcttcaatttgctctctttcgaatggtattccaagcttttcaagcagttctttcatttgttcttcttccataaaccatcccaaccttctcttttctatatagcagctttccaatcctaagttttatttcgtttattttttaatttttaattaattcattacccttttttaattcattaataagactttctcccgggtgaacaaagaacgcgttttctgtttctcttcccagccgtttatcagcatattttttgaattttgccgcgtgtaattccttcacccattttggcgttgcgtccatcaaattattccaattcgtccgttttggcatttcgtccgccctccgtttcgtttctttgtctgcttttttcgccattttgtcccattcctctgccaatttcttttctatgccggcgtttctgttagccgctaaaaattccttcatccctttgatcgtttcttcgaatgccaatgcgattttcgtcatttcgacttccaattccacgtcaaacagtccgtcgtacattctatgcatttcgattgtccgctttttctgccaaaatttgtccatttttgccccctttggttccgagtcggaccaatggacgaaaacggacagatcagcagccaatttgttggtcattcgactgatttccgtttctccaataagcaaagcaatcaaataatgatccatcaacacgacttctttgtcaaatgctaaaatgcttaat

SEQ ID NO: 35979 - DNA, 1064 bp, Heterodera glycines
ttttctttttttttttttttttttcttcaaaagggtccagaatctaaaaaaaaaaccctcccgggggaaaaaagggggtttgaaaattttttggggaaaaaaaaaccctttcaaaataatcccctgggagaaggggggggggagacatgatttcaaaaatttcatatttttttagtttaatctactcaaaacggttcagaattcaataaaaataacattcaccggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaaga

SEQ ID NO: 35980 - DNA, 1349 bp, Heterodera glycines
tgaaaaacctgtaaaagcattgtcttttttatttgcccctatcccaaaaattagtctaggtaactaatgtcgctgggcaggcaggatgaggattttcgaaaagcaattagatcacttccagccttagcaaacaaattcaattaatctaataaattgttacaataattttgaggcggtttaattttgtgccgcaaatgtcattctttagcgaaaaaacttatgaaaattttgtttcatacacaagataaatctttacaaattgataattttttttgggtttaagctacagagacctttccagcagtctgtttttttgaagtgtcaattttatgtaatgctctaacatggcaattttcctttgctcacaacgtcagaaaaaatgcacctgccaattttgccaatgaaatttttcccttaattttctttaatcaaaatcgtttgtcaaatgaatagatgaatttgtgattcacaataatgagttccaactcgaaaatattatcgcaaaattaaaggaatatcattcactaattacattttgccgtatggccatatttctgccaatttaatttcatttaatgccaaaatggcaattcgcctatttacccacttattaaatgcatgcacctgtcaattccgttaattaatgcatttgtctgaagttctcactattaattaaaaaaaaattgtctacagatgaaattaaatagcatgttgaagagtaacacaattttcgatataagaatgtgtaaaatattacgttgatgcttatgcccctaataaccgtcaaataaacgcgcattttgttaaataattattttatttcttaatagtcttgcccattagtttgaaataatttaataagcattttagagtgaagtgaacacaaaaggttttgttcattcatttaaaagaaaattcgcctttataaacgcattttctctaatagtttttttaaaataaattttcatttacttttattttgcttttatttttgccaaaaaatttcaacgataatataatgagagtcattcatgcaaaacaaagttaatgaaacaattaacaaattgtcatgcaataattaccgtagtccgtcccgacttttaaatgtgtgactcgtcccaatgttttcccattaacaaaagaatgactgtaaattaagactaattgtaccaaaagacacttgaaaaatacaataattgaaaaatttgtacataaaaacaaacgaccgtttcaatgaattagcattaatttgttaattttaaaaaaaataaaatatattttaaattctgtgaataagaattaagtatatatttcgccacaaatgaagttgcttttgttccggttcgacc

SEQ ID NO: 35981 - DNA, 802 bp, Heterodera glycines
  misc_feature (24)..(24): n is a, c, g, or t
tcatgttaataaataaatataaanagggtggggctttggtaaatccaaaaacaacaaaatgaggtaaaaaaagccttgaacaaacagttttaaacctcgaaaataaactgtggatttggcatagcacaatggtaaaaattgccggaggcttgggttcaaatcagggctggccgtgattgaatttccaatcatgcaaatccgtgatccatgatcatcggacttacaaaaaaaatccgtgacccgtgatccgtgataataaaaaaatttctgaatgattttcttgagtgtgattgttaacagcaggttttgtccaaaaaagtcaaatatttgttaatttatgggtctactgctgttttaaaaaatgaagaaaaagatctttaatgtaagaaaattttcttttcaattaaatttcaattaaaagtaatttattcctatgcctctcaaatttgtatatctgctactgtgtttaaccattgaacccacagaaattcatcacttccggatacatttgctccaactgaatcagtcccatctccccaattaacgtaattagcttctctttgctttgtaccagccgatcgctatccattttgcagaaaaatattcgcatattaatgaacctttcaattagcatgccaatacaatataaattaattgttttgcccctttctccttgtgccataattgactcataaatttgcattgcttccattttgtcaaattttggaatgtcccaattcccgatctgctgatgatcgtcgcatatgcccttctcaaattccttaattgcatatatgaaaat

SEQ ID NO: 35982 - DNA, 1228 bp, Heterodera glycines
agtgatcagaaacagtgatcattcgaaattggtccgttttgatcattcccgatctttttgataaaataaaaaactcaaaatgttgattcattcatcctcctggtttctctctcattgatcagtcccgaatattactcactctctccctctctatctctctctctttctctctctctctttatctctctcctcgcttagtgcattcaataaatcattactactttgatcactttatcactgcgatttctcaaagaccctcattttccgatcacactttcctcttccggatcgcttcccttctccacccatattgatcactctgatcacttaaatgaaaacttttgttggcatgccaattcgatcggcacattggtgcccattccccgggcaagcaccacctccgccactttttggctggcccgccaacgacggagcgccggcgctgtcccctgccggtggtgccgttgatgaatcggatttttttgccaacttttttgtgccacggcgcactcgtcgcgagaagcggttggcacgttgcagtgagaaacgcagcgtggcaggaaacattttgacagtttagcagaaggaatgtctcagtttgggaaaggcaaacttgggcgcaatgccaatgttcaaaataatttttaaaaatggagaaacaataaaaaaataatagaaaaaatttgaaattaatagaaaatttaaaaatttcatttcgtttttttttgcaacaaatttttgaaccgatttaaaatacaattggattagggctaattcgtaagtctctattaaaaaaaaactcggaatttcggcttcatcttaaaagcttggtgcaatatttaaattttgggctcaacactcgaccgcgtctcttaaaaattaacgataaccagcccttgccagcgggggaaggggtggggaattccgtccccccccccccctccggaaataaaaattacgagaaaaatggcaaatttttgaaaaatttaagttttaccccaaaattgcaaaaattaggccctgacgataaccaaagatattaggagaggtttaaaatgaattaagtgtcgacttagcgacaaattaagagcactaaaagtgccgcaggccggcagaaaatgcgcatttcgctcgagagtctcgagagaatgaacggccgccgtcgcggcgaaagtgccacccgacccttggggtttcaaatttgttggcatttgggaataaaaatgga

SEQ ID NO: 35983 - DNA, 1356 bp, Heterodera glycines
tttcctgacagcaattcgtttgaactgagcagttttcggagggtaacgcgttaattgtgtcaaaggcaaaattttcgactgcttttcgtttacttacgaaaaaataaaacaccgaattgcctataagcattgctttttttctcaattgtgtgtctacataagggccgaaacacactgattaaatttaacccaaattatgatagtcttccggaagagatgtactgatgaggcccctcttccgtaggatggatttgtctaaaaaagctaactattttttaatagatagtgccattggccatcccgttgtacggtcgcggtcgtcattttcagaaccgttcggcttagctaatgtgataaaacaggttaattcttttcctttcagtatccctgcaaagtttggggcgcttctgataagtttctgaaaaaaaagttaagcctaaacttttttgcctgtttaaaaaggaattaaaaatttttattcttcaccatttttcataatatacgcctaagagggcctttaacacgtaaataaaataaaatgaatgaatgatttgaagaggtaaacggaatggtcaagactttggcaaacatttttatcagcaaaaatgctctcatttctcatcactttggttttatgggtcactccacatttacttttgcatatttatttatttatggttgtatggatcacttatctttaattattatttattttattgtacttttgttaccagcataccaaactaactttttttaatttggtaacaaatttaagctaaattgatttgattgagatatttttaggaaataatccgttctaatgacttgaaaatatttttttaaatagaaatttactgtaggattgtccactgtcggattgtccactgtcggattgtccacttctgtcggattgtcctcactgtcggattgtccgggagccctttttccccatatcttcccttccccttccccaccctctacctctctttcctctccttccactctcatttctcttccctctattcctccactttttcatcttctcttccttccttccttccttcctctctctttctgttctttgtgtgcttttgctgaatcaggctcgtaaatcagcgttagcgatcatttccgtttaatctgagtgagatgacttatgcgatatttgaattcaaaattaattctttcttcgttttttcttttgatttgtctcttttctttgctcgtttgtcctttaattgatggccgattagcgattaataattaagattaaaagtcgaccaactaacactcgttgtcggctcactcacccacgtttatcgcacattcattcgtgcaccccccccccatggcgac

SEQ ID NO: 35984 - DNA, 892 bp, Heterodera glycines
ttttgcctaattacgacaaacgcaataattaacaacaatattagggatttattaaaaagtcgcaagaaaggggaaaagaaggggaaaaagtgacaattaaaaggaacggatgggggggggagcgaatgatggcaacgaatcggaaaagcgaaaaaaagaataattgagcaaaagccaaaaacagtgagtcagtgcctttcagggacagaagcgacaaaacgaaatgaaaaaatattcattctgatcattcaaaaattatcaattcgtaaatcaatttaatcaatcaatcgtcggtggggtgaccatttccaattcttcggatgaggaaaaacactgagacgaaagcaaaggcgaaacagtacgagcgagcgccttcggcacctccgactgcggcgaagcgtccagaaaaagatcggtgacaacggacgacgacggcggtcgaagagtgtcggactcgcagacagccgaaacggtcgttttgtccacgggttggaagagcgtcgatggggaggacgaagacgaagagacggcgacacaatgctgaggaagaggaggaggaacagtgcgagaggaagcggaggaaacggagcagcagccggaggaggagggggaagaacgacgggccaactgaacggacacaacaaatggcaccattgaaagaagaaaagggaaggggagagagagaaagaaaaagggggagaaaaagaaagagagaaaggagcaaaaggtaagggaaagaaatgattagggaggggaaaggggaacaggacaaaatcacgccgggacaaaatccagccgctagaaatttttaaaaaatttttccaaccctagtatttttcaagaaaaaatcttacaaaatttttttataagaaaattttaaacaacaaaaaaa

SEQ ID NO: 35985 - DNA, 912 bp, Heterodera glycines
ctggaaacataagtacaaacaattaattaactcattgatacggagttctaaggatttgagatattttagttttttaaatttgctataaaaattgaaatcgaaatacgtcgcaacattttcataaaaaatcaataatcaataaaaattaattaacgtatttcttccattaagctccttcagccgaagggaattgaaaaattgagccctcccccgcccattaatgcaccctaagaaggtggttgaaaaacactcccccccccctccattaaagccaccctccaccccgtggtggtgttgaaattcgaagaatatacaaacgtaaattttttttttcgcagttcatttgccgtctcattgtatgggcgtgacgatggatttgagcacaaacggttgcgcaaacaagcggccaaaacgctgaaacaatttgagtctgatccggcacgtacagccgatgaccaggagaagatgaagcacatggtgatggccaatttgccatcggaccaagaaatgtccatgtacaaagacagcattgggctgtacgcggattattatgcggcaaaaagtggcaattttgttggcatcgcggaatgccaagcattgtccatacatttaaatgtgggttatatgtacattttaatttaaacatttttttagtaaaaattatactagacaaattaacatgtcaaacagcatgagaatgtaaaaaaaattatcatatctatgcgctaattaaggggcgctaatggaaaaagcataattaagattcaatgtacaaataaattttaattaccatgctttttaaaatagagccccccccccctttttagcaccttcaaaagggaactttattcagaaggggctttaatttaaggggggggactaaatccggagaggaacgataagggggggggg

SEQ ID NO: 35986 - DNA, 107 bp, Heterodera glycines
ctttggcttgtaactgtgggtcgggaacattgtcgactcgaacatctttggcaccgtgataggttaatgcgcgcatgggtatgactcctagttattgttttgctgtt

SEQ ID NO: 35987 - DNA, 75 bp, Heterodera glycines
cctacagcgcatctaccgttcacagtcgagcaccagtggcaccacgctgtacctgattgccgagcgtgccgcgtc

SEQ ID NO: 35988 - DNA, 294 bp, Heterodera glycines
aaaaaaaaaaaaaaaaaaaaaatttttttttttttttttttttttttttgggggggggggggggggggggtctcgcaaaaaaaaaaaaaaaaaaatattttttttttttttgttgtgggggttgcaaaaaaagaagggggggggggaggccaccccccccccccccctccaaaaaaaaaaaaaaaaaaaaaaaaaaattttttttttggaggggggggggggggggggggggtttttttttttttttttttttttttctcccctcccccccccccccccccccccccccccccc

SEQ ID NO: 35989 - DNA, 1173 bp, Heterodera glycines
  misc_feature (16)..(16): n is a, c, g, or t
aataactatacgtatncaccggtgtctctaaaaataatgatttgttagcgattgggcaccgggaacagaaaattgaggttaaggactttctgatgggggattttccccaataatatgcaaatccaaatgaaattggaaatcgctcgcagcggtcaaaagattgttcgccatttcgttcagtagctgagcacgcgcattttgctgggattcgattgcatgctgaatcttctgtcgctccaacagatcagctgcgattttttccaaaaattcatttttggcgaccaaaagtttttggattgtttccaatccggcttctttttcgtccagcaaaaaagccattcgttgaagctggatagcaatttgggaattgtcggacattgggctacaaagtttaaattataattataatcaaacgaaaaataattgactgtttggctacaaaattgaaatgataaggggttatttttaaatttatcaatcatatcaaaaacagtttttaatatctaagggttccaataataccaatttaaaagattaattaattggaacttcgatactacattcagtcggagaaagatttctttagattcgatctgatattttcaacgttttaattttaccgaatttttcattatttaattacgatctccgttcgtccaattacatgctttatgagctgtaatcaggtgagtcggggctgtaattgaatgaagaagaattcggatcagttaaagcgtcggagttgtcagaacgtatcttatgaattccttgctctgaactcgtgtaaaaatcaacacattcgccacgctcaatgcgcgagcgaaggtccgtgtactgatcgcgcaaaattcgtaacatgcttttcttttcgttcttttcgcgttgcatctttcgtttttgctcgcggcgctcagttttttgctccgcatcggccaaaatttgctctcgcgtgcgccgcggcttaaatgttgcgcgcatttttttgccgcaattttgacattcagagcggggagcagcagaaaaaaggcatcccgaccattttgatttcggctccaccattttgtacagtttattctcgaggctctttttgaattctataattgttaaaaatttccaagggaaaaacaaagctgaacgaaaattatgaatttatatttgttaattgtggaaaga

SEQ ID NO: 35990 - DNA, 727 bp, Heterodera glycines
gtttttttagatctttgatcattgcaactgtccttgacccccgttttaaattgaagttgtttgaacaaatgaaggaacaaattcgggaatggatgagagcggatttacaaaaaatgttttccgggtttttaaacacgacgttggttcgccaatcaagtacatcgagtagttgttccacggaaaaacctggccttttagaagttttaattttaatattttccataaagattttaatgattttagtcatccagtgggtcatccaatctcaattaccgatgatcaatcgaaatcacaaaatgaattttacgatgcgcttcaccaaatggacaaatatttgagagagccgcgagtaaaatacaatgttgatctttttcaatggtggaaaaagaatgaagcggaatttccaagcttgggacggcttatgagaaagtatcatagtgcgccgccgggaagtgttgagtcggaacgcctgttcagctgcgcaggatttattttgaatgacctccgaaaaagtctctcgcatgaaaatctcgaacggcttatttttcttcatcataatattatcctttacaattttgattattgataatatgggaattttctaattatgcttttacaaatgtgcgatccgcggcgttttttgcgcgatccgcggcgttttttgcgcgatccgcgatccgcgaccgcggcaaattgaatccgcgatccgcgaccgcgggatttttct

SEQ ID NO: 35991 - DNA, 703 bp, Heterodera glycines
aaaagttaaatcgggagggcttatatggggccagtcatttctggcacctgctaaaaattaaatgattagtcgggtatttttccgttatgccgcatttccccccccccccccaaaaaaaaacactagaaaataacaataggcgaaatttattcgatctgttcatggcgcataaaattttttatggccgaacaaatttgaaattattttctatttttaatccgtcaacatgctttaattaacatcattttttatagatttaacacaaaatataaaataagcaaaaaattcattccctttgctgggagggcaacaaaattgtggaatcaactcgataaaatacaaactcttttaagcaattcaaaataaaattaaaaataagcggacttttcccttcagtgaattatttttttttttgacaaataaatagggttataaattatattgactaaaaaactccaaatatggacttaaaaagcccgaaacatggattaaaatgctcaaaaaatgccaaatatggataaaaatatggactaaaaactgccaaaataaatctttaaaaccttaaaaattccgaaaaatgtatttatattcagtatttgccaaaacagatttaaaaatacgctaaaaactgccaaaaaatggatttaaattttaaaaaataccaattttcttaaattctagcttcacaattgcaaatcaaata

SEQ ID NO: 35992 - DNA, 581 bp, Heterodera glycines
agagcgcggggggagagggagggggagagagagaggagagagagcggaggggatggggacatgggacggactattaaaatgatgatgggaaagtaaacataaaaagggtggggaaggaaggggggggggaaatgggaaaaatggggggcggggagccctcctaaagaaagatgggatggaagaggagggacatatacactttccattcatcaaaaaaaagttggttgaatggggggagggaggcggatgatagtggaaatggtggtcaaattccacaccacggcagcgcccgagggggggggggggagccgaaaaagaaacaaaaggccaacaatatgtgggtattcgtggaaataggggagacaaaagggagaaggggggggggtgaaatcaaccaaccattatttattacaatatggggacgaaaatgaaggcgagaagtaagccaagagtcatcacatcatccatctgctggtgcttaggtgctgttgctaaaagtgacaaaaaaaagtaggggataaagcgggaatttatgggggttggaaaaagtgaaattagcgggggatgaaggggggggggga

SEQ ID NO: 35993 - DNA, 1543 bp, Heterodera glycines
gatggctatctctttttttgataaattttatacacatacaaatgctctcgagcatgatagggagggcggtgcgcaatcgaccttttatttttgagggaatttttaaatttatactctatcccagaaaaatggctatctctttttttgataaattttatacacatacaaatgctctcgagcatgagacggagggctgtgcacaatcgccattttatttcacagaggatttttatatttagaggttatcccagaaaaatggctatctctttttttgagaaattttatacctcacaaaagcgcttgcgtatgagacggagggctgtgcacaatcgccattttatttcacagaggatttttatatttagaggttatcccagaaaaatggctatatctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatcgaccttttatttttgagggaatttttaaatttatactctatcccagaaaaatggctatctctttttttgataaattttatacacatacaaatgctctcgataataggaattccaaccgcattctcagaataattacgccgatactaattgttctggaatttgtttctcggcgcgtttgttttggaaaaatttggaaaattggctatctcattttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaacatttggaaaattggctatctcattttctgctcaacagtaataggaattccaaccgcattctcagaataattacgccgatactaattgttctggaatttgtttctcggcgcgtttgtttgggaaaaatttggaaaattggatatctctttttctgctcaacagtaataggaattccaaccgcattctcagaataattacgcgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcagcgcgtttgtttgggaaaaatttggaaaattggctatctctttttctgctcaacagtaataggaattccaactgcattctcagaataattacgccgatactaattgttctggaatttgtttctcggcgcgtttgtttgggaaaatttggaaaattggctatctct

SEQ ID NO: 35994 - DNA, 1230 bp, Heterodera glycines
  misc_feature (377)..(377): n is a, c, g, or t
  misc_feature (389)..(389): n is a, c, g, or t
atatttggcactgatgaattttatttcccaatttacatttttttaaagttttgctatttgtaaattttatttaaaaatttttaaaatatttcttagattgcacaatacactttctttaatttgaaaaaatgtcatcatccatcggttcgccagatacatttttccgttcagaaactgatcagggtaatagaaaaattttaaaagaattacgaaaaataaaaaaataattatttaaaataaaatacaaaatctctaaattttatcacaatcagaagcagcagcaggagcagaagaagtgggcaaatacgaagtgttcagttggcacggaaatttgagtgatcaattgtcagccgaattgttcgtcactgatcagcagntgctgaaggtgngcccttttgaatggacaaatgatcaaacagcgggaggggaggggaggccaaaaacagagaaagatttatggaaaatttagttcgaaatttccaatccgttttaaaagttttggaatgaataaaaataaaaaaaaaaaggggccgacccattcctaaagaaatttgagggatttttgccaaaacccttcaatttttaaatttaaaaaaatttccaaatttttttttggaaaggaaaaattttgtttatttttagggaaggcccagaaaaaaatggcccactccccaatttgggggaaaaaaaaaatttgtgggggaaaacggggggggttttttggttgaatgtggggaaaaaaaaaaaaaaagtggaatttttttaaaaagggggattttttggggggggggggggggggaaaaaaaaaaaaatttaattttttttttttttttaggggggtccctccccaagggggggggggaaaaaaaaaaaaaagaggggggggggcgcccccttcttttttttttggggggggggggggctttttctttttttttggggggggggagagaaaaaaaaaaaaccttcaaaaaaaaaaaaaaaaaaagggggggggggggttggtttttttattttattattttattttttttttttctcccccccccccccccccccccccccccccccccgcggggggagaaaaaaaaaaaaacaaaaaaaaaaaaaaaaaaataatttttttttttttttttttttttttttttttttttctttgcccccccccccccccacacatttttttttttttttggggaagaaaaaaaaaaaaaaaaaaaaaaaaaaaaa

SEQ ID NO: 35995 - DNA, 232 bp, Heterodera glycines
  misc_feature (207)..(207): n is a, c, g, or t
atttgtgttaaattcgagatttttttgggtgcccttatagttttttttggtaaattaaccgagcacagattaccttacaggtctcatgaccatctgttcaactatacattttaaaataaagcctaagcataggcctaggcccaagcaagcttaagcctaaagatagcctaggccttttacctggagtagaagcggatatgtttccantataaatattccccatatttttcta

SEQ ID NO: 35996 - DNA, 919 bp, Heterodera glycines
atttgagtcacagagattgaaatgctggtgggtttagtttcagtgattggaatgtcattgaaagttggtgggttgagtcccagtgattgtaatgccggagatttgagtcccagagattgaaatgctggtgggtttagtttcagtgattggaatgtcattgaaagttggtgggttgagtcccagtgtttagaatgccgcagatgagtcccagagattgtaatgccggagatttgagtcccagagattgaaatgctggtgggtttagtttcagtgattggaatgtcattgaaagttggtgggttgagtcccagtgtttagaatgccgcagatttgagtcccagagattgaaatgctggtgggtttagtttcagtgattggaatgtcattgaaagttggtgggttgagtcccagagattggaatgccggagaattgagtcccagagattgaattactggtgggtttagtttcagtgattggaatgtcattgaaagttggtgggttgagtcccaatgtttagtgtttaaagtaatgccggagatttgagtcccagagattgaaatgctggtgggtttagtttcagtgattggaatgtcattgaaagttggtgggttgagtcccagtgtttagaatgccgcagatttgagtcccagagattggaatgccggagaattgagtcccagagattgaaatgctggtgggtttagtttcagtgattggaatgtcattgaaagttggtgggttgagtcccagtgtttagaatgccgcagatttgagtcccagagattgggatgccggagaattgagtcccatagattgaaatgctggtgggtttagtttcagtgattggaatgtcattgaaagttggtgggttgagtcccagtgatttagaatgccgcagatttgagtcccagagatgaa

SEQ ID NO: 35997 - DNA, 1819 bp, Heterodera glycines
  misc_feature (314)..(314): n is a, c, g, or t
  misc_feature (1772)..(1773): n is a, c, g, or t
aaaatatgtaataaaaaatgctaaaaatatgtatgaaatatgtacaaaaatcctcaaaatatgtaggaaaatatgtaaataaaatttttttaatggttattttttggaaaaaaattcttcgtaaaaagtgaaataggcacaaaatgccataaaaatgaccaaaataggcttagaatcacatttgaatattttacaaattaatttttgatatatcattttttgaaaaaaatcgattttttaaggatacattttcaaaaaaaaaatttttaatttttttacaaaaaatttctataaattctcaaaaatcctcaaanatatgtaaaaaaaatgaaaaatatttacgaaaaattgcgaaatatgtacgaaaaagtccaaaatatgtataaaaatatgtacatatttaatatgtagaaaaatcccaaaatatgtaaataaaagtcccggtttttgttcgcaaacacaaaaaagaaagtgttttttctgctatttagagcatggagaaaccaggaaaaaaatatgtatttacataaattagcagccttttctttcattcattatttggctatagactctttttctattaataaaatatttgtccgaattcgtaccctttaattaatttctttaagcgactatcaatgagctccatcattcttttctgtcctaattgtccttcttaaatcatccaatttcatcccaatttagcatatccggcacctaattaacgcctttgactttttggcctcggttgggaaaacgcccattcttatgcgcatcgcctccccctcctcaaccattcgggcaatttgttactttttgaagagagcagcaaatgcttgagtgccaatccctaggcgtccaaacatttctgggtattgttaagtaaaaaaaatgtcattcccacaatttgtctacttgtgccacagaggaatggataaataaatggatgtgtgtgtgtgtggcgtgccgttgtcgtgcaaaaatgaatgtgtgtccctgagtattttttggcaaatgaatgtcaacatcataatgaatgaggaatgatggaggatgtctttgtacttttaatgacattggcgccgtaaggccataatcaattttttttaaataaagaattataaactcaattttaaaatataaatatttatttacttttatgagttcaactccaaaattgaaattttttatcgtaattgaatattttattaaattgcttattttattttttaacggaaaattcggggtcaataatcctctccattctttaaaaataaaaacaataacattaaataccgagaaataataataaaaaacttcctgaatggcgcccagcaacgcaaacgcgtaaaaattataattataaatgacaccgcgagaaaaatagccccaagcagattgcctgagggcattttgtaaaaataaaattaattacatgtttgttttcttgctttccaggcaaatcttaatgttgcgcataaacagtgtgtgatatttattaacagttttttcatattttccggcacaattaaatcgatttcaaaaattatttttcgaggcaggcgaaagtgtcattgagacagtcaaagaaagataaacgatttttttttggtcttgtaatggttaagtaatgatttctggccttttaatcacaatcgagaattttttcgagaagaaaaattctgaactccggccgggcctaaggctgaaactatttgaatctctcgtgaattctcgaatttgatctccaccactttattaaatggattaanntgatgaattttttttccccaaaacttaagtttttaaatgttcattt

SEQ ID NO: 35998 - DNA, 881 bp, Heterodera glycines
tgccaaattgaaggatttttgaactattaaaaggatttttctgaattttcattaaaaaatccgaaatcctggccaaaactagggtccccgctgctcgtccgtcacccacccgtcactgttcgccgccgcttctcctcccctccactccatttcgggcccatttgttgtcggcatttgccaatgaccagcattgccctgctgctgcactacggcattttgttgtgccaccattagtggtggtgttggcttttgatgttgccgccatggtcgaccaccgtcagctgcagcagaagtgccaccaccgacagaaaagggaccaccgtcataaccggagacggcaccattgaagcttaagtgaaatgcgatggaggggcaggggtcattaaggtggattaaggctcaaagcgcaaggctaattggtttaatgcactaaatccatgcctcagcgcagggcagcgatgcggacggaaaagtgccgaaagacgcggaaaaaggggagggcggtatggcaaaaagtgatggcacgaaaggacactcgcgaacacaattacaatcagctggtgaaaatggaccgcagagaaatgagacgcgacgcgccatttttggttaacgaattttttgaaataggataacagagaatatttagagctattgaatgagaaattttgggaatgattgactcggattcgaaaaggatcaaaatggatgccagaatcggattctccgaccctgaaaccccataaaaataaaaaaaatttcgaaaagggtggctaccatcagaatattaccaaaaaatgaaatcgaaaataataagcccattcgttttttgttttgttcaagtatttcaggagtttagcggtttatgcgaacggagggcgtag

SEQ ID NO: 35999 - DNA, 758 bp, Heterodera glycines
aaccaaaaattggtctcaaaaaaattcaacgattttaaagagatttttaagcaaataagaaaaatttttgaaaaaagtctcgggttttttgggtctcggggtcaagtctcggtctcgagtcttgggaccatggcattttaattctaataaaagtgattttattttatatttcatattttaaaaatcttttctaaattttgcatccgtataaaatgacatcaaatgggttgtacagaatttgtagagaataaaagatttcggatcttctgccattctttcacaaatgcttggcgatattcgctactaaacatttattgctaaattaaaattttaaatttaaaggctttcctcgtccaaaaaagaatctgctcatttgaaatgcaactaatgtttaacaaaatgccaaaaatttgattttggttccaaatttcattaatatcacgagcggttgggcgatatttttggatatatcgttttgtttttgaaggtgtgcttggaacagtgcaatcatgcgcacccgtccgatctggcaagttctgcaacgattgctgactagccaacaggttcggcgccgtgatgaacccaaccatcactgcttaccccgcggcacccggtacggccccccgaaggaatgtatctaattatattctcaccttagggtatttattttcgcattaggtcggccgttagcgattcgatcgctctagtcaatttttaaaaatttttgctgaaatatttgtcgtgctctgaaggaacgg

SEQ ID NO: 36000 - DNA, 616 bp, Heterodera glycines
ccgctcccgactcccgcatttttcggtgaacgggatttttaacaggagcgggatttttacgggattcccgttcgggactcccgtcccggaaatttttacccaaaaaacgggagtaaaaatgcactggtaagaattgagtttttttgataaatataatgatttttcattgaaaatctgttaaatatagtcaaatttcaaaaaaattttcccggcggcgcctatcggcaccgccggcctccctcttccaccctggtcaccaaaaagttttttcaaaaaatacgtcgcaaaaagttgttaaaattaataaagggagtcaacaaataaattataaaaaaatttatttgaagcaatttgaaaaaatttctgattttcgacccaaaaataagattttttatttcaaatttctccttactaaatatttctgtatatttttaatttaataaaaggattgtccttcaaatttatgcattaaaatatttttgttagtttttaattaaattttcgaattactcccgctcccgcccgggactcccgtaaaatttctgcgggattttaacgggagcgcgattttcacccgattcccgatcccgctcccggaaattttttttatcggact

SEQ ID NO: 36001 - DNA, 835 bp, Heterodera glycines
ataggactttaaaaattaaaaaatttttaaatttaaatcactgccattctttcgggttggtctatccgacaaaagtttttgtgtttctgattcggtccggctgatgaccggtcaattggacaatggcaatcccaatggggcctcaatccgacataacgcgggttcgtaattctcgagtgtatagattggacgatacgattggatgaacccctttttccttctgttccacattcatcccgtaactgccattttcccaaaattttagcgataagagcaggggaggggcgggggagggagggaatggacgacgactgagggggggggggggtcggcacttctcctcgggcgggtcccaatgggacttgaggggcattgatggcgatgaatgggacccattcgggtcaattatctcctcacaccaattgcagcagcagaagaagcctcgggggagggcggaggaagaaaatgaaaatgagtttggggttatttattcattttgatgaaaaggaacaattgacggggaaataggagggcaggcaaattaaatgattaaataacacttaaattctttaatatttaaattttggcaattagaccactgaattgagtgaatgcaaagcgttggcctttttttcctccaatggccaatctttgccgaagtccgccgtttgttgtcaaagtgaactctccgcctctgctggccaatcgtcgtcaacagctgttgctgacctttgtttaaagcgccgaacaaagagacaaagccaaaaataaagtcatttctcaaatttattgggttttatagtgatattttttatatttaatataaattggaaat

SEQ ID NO: 36002 - DNA, 1137 bp, Heterodera glycines
cagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaattttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatatatggggagaccgaatccttcgggaatagcttccctatagcctgtactttaattctgcggtggatttttgctccccataattgtttgagtaccccaaacggacacttgaaaaaatcgatttttttgttttcggggcagtccccccgaaccgatgcgcccagatttatggggagaccgaatcccttcgggaatagcttccctatagcctgtactttaattctgcgggggatttttgctccccataagtgtttgagtaccccaaacggacacttgaaaaaattgttttttttgttttggaggagtcccccccgacccgatgcgcccagatttatgggggagac

SEQ ID NO: 36003 - DNA, 930 bp, Heterodera glycines
  misc_feature (828)..(828): n is a, c, g, or t
  misc_feature (894)..(894): n is a, c, g, or t
  misc_feature (907)..(907): n is a, c, g, or t
  misc_feature (914)..(914): n is a, c, g, or t
atatgaacaatatttttccgaaagaaagatttttattaataaatgaggtactcatttaaaattatttattatttacgaattttttttttttgatataagttataatgcgcgaaacattgtttatttttaagcgcaatttatattcttgcacattgtctgtgtaattttttgcagtattgcttttatcgagctatttttattatatttatttaaccatcaagtgaacgttaattaatttagtatttgagtgtttacattgaattaattaaagttgctttattttcacaaataattcgagtctccgatggttgaaaatggttggataatctattatttaaatatattttatttattttttaagaaaactataaattgttatttatttcataaaggaaattttattttattttgtctatacaatatattgtttttaggtttatgtcgtgcagatgcggatgactttgaatttttaactgcgttagttgtttggaggattaaatttgagctttagttcatttaataatatttgccacctaatcgatggcttgtgatgacgcaagaatctgacgttggcagggctgtaggcacgtttttgaattttgggaaattaccttgattttcttttttgtttcttttcccaaacctttttattttccttcgaaaaaattcgtctattaaacatttatatctaatcaacaaattcgagactgttttttgatcataatatttatgaaaatacattcgtacattatttcctttattgattttaatatttagtatgttctgtttatactatcattttcatgcaaaaacccaaaaaatgcattnttcatttctgattaagatatttcttctacttatgtagttatacagaatttttttattatttattgnttaaaaaaagggntagcttnattgcatcttttctca

SEQ ID NO: 36004 - DNA, 958 bp, Heterodera glycines
  misc_feature (4)..(4): n is a, c, g, or t
tttncaatttggcccatccctggttcgccaccccgccaaaatcaaccaactaactgattcacttccgcctctttcctgtcctatggaatgaatgatttatcattaaacggttttctcacctcttctttttcctctttttcctccttttcctcttttcttctctttttattttttcaataaaaatacataaaacaatcatttgattcggaattcgaacccaaattggccgactaacggcaatttgcaccttttagcggctccttttcagcttatttaggagtttttctgttctttggctttatttgcctttgttagtttttattttttcaaaaagaaagccgttcgatcaattaattagtgattcattcagtcaaaaaacaaattttacgactcttcaaaaataattaatgttcggttatgcaagagaagagtctgtctttgtttctaacatttaagtgctgaatttatactttttatgtcatcccttccccccccccccaattttctccccttttccgtccattttacccctccggcgggggtgagactgaccttcgccaccccttccccctccctctcccgtttcacccaccctttcctccatggcattgggtgccgaattggccatggggacacaaacattggctgaattatgtggagcgggccgccatcaatttgccaccctccgccgaggggaagcgatcaatgcgaaagcgaagtgaagtgaatgtctctccccgcaaattgccccgagggcgaaggacaaatggccaaaggaaagggcagaagcaaaggacagaaggaagagcaataaataaattaatccttgcgcttggaagaggaggaaagtgcgggccaatcccttcctcccgttcccctctttcctcttcgttttcagtgaaacctcaaatgccccccttcgtccccaattgtcaattttaaacatatttaaaaaata

SEQ ID NO: 36005 - DNA, 963 bp, Heterodera glycines
  misc_feature (946)..(946): n is a, c, g, or t
ctgactcggccgccctctggtactgtaactgatcgaggtcttcatttgctgggacaaaagttcgttagttggtgacgtaatgtccattgaacgcttctagaatcaaattaatatgtgtttccaattttttttttcttgataaatcaccttctgaagctggtgcatacgcttattgacagccgaagcgtaaattaatgccattttgttttttaagtgttttcttttaaaatgttaaaataagcatccaatttctcctaaattcttttgacaattaattttgctatacaaataaaaacaataaaaaaaatgtttcacatttgtacttattattagactttttggtccaattcccccacttttataggtcaaattgttaaattttatgactaacaaatgaatgatcttcaaactcccaaatcccctcaggagacaattaaacgcattccattaatgggacattttaaatttgattaaattgccagaggtactacagcgtatattctttttttgaacaaatgacttttgcgctaatgcggtctgctctttaggagaagttcacgtgaaattcttacaacaaacaaattgccgaaaatcccctgagggcaaatgggacaaaaaaatggcacaaaatgtagccgtacggacggcgagtagaaaaggcggaaacggcgacggctaagtggccccggaattaattgagcatgtgggtggaagaggttggacacaacagacagcaattttctggtccatagggtttgtgagcaaaaaattggcacttttaaaccgagcgggggaagggatttaagaaaactttttgattttcgatttctttttggaaaaatttaaaaaaaaaagatttttttatttttgggatttaaaaaatgaaacccattaagaataaagagaaattgtttaatttacaagatctaatgttattttaaaaaanatattttgaaatgtttt

SEQ ID NO: 36006 - DNA, 1026 bp, Heterodera glycines
  misc_feature (884)..(884): n is a, c, g, or t
  misc_feature (910)..(910): n is a, c, g, or t
  misc_feature (951)..(952): n is a, c, g, or t
  misc_feature (970)..(970): n is a, c, g, or t
ttatttattttttgcaaattaattcataaatattttttacaaagtgctctgaaacgcaccaaatgttaattaaaagttaaataaggctctctgatgctttttctatcaaaaagggagatgaataaaatttttaaaaatttttaattcctttttaaacaggccaaaaagtttaggcgtatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttcagaaagtgctctgaaacgcaccaaatgttaattaaaagttaaataaggctctctgatgctttttctatcaaaagggatatgaataaaatttttaaaaatttttaattcctttttaaacaagccaaaaagtttaggcttatattttaaaaagtttcatcgaacccagcgcactaaaatcgatataatctctccaaattttgcaggccttctccattgtaaaggactaacttaacctgaaaaaatgccaacgcttgttgtttttaaaatttttcgaaattctgactttttcattaattatttattttttgcaaaattaattcataagtattttttcagaacgtgctctgaaacacacaaaactttaattaaaagttaaataaggcactctgatgctttttctatcaaaaagggagatgaataaaatttttaaaaatttttaattcctttttaaacaggccaaaaagtttaggcgtaactttttcaaaagtttcatcgatcctagcgcactanactttgcatcgatataatctctccanattttgcaggccttctccatttgtaaggactaacttaaccnntgaaaatgccaacgcttngttgttttaaaattttcgaattctgacttttcattattatttataatttgcaaaat

SEQ ID NO: 36007 - DNA, 1388 bp, Heterodera glycines
cctcttataatcactgttcttcctcttttaatcactcttttacctcttttaatcacttttgtacctcttctcatcactgttgtgccttttctcatcattttttgacctcttctaatcactgttcttcctcttttaatcactattgtacctcttctaatcacttttgtacctcttataatatcagttgtacctcttctaatcaatcacagttatacctcttctaatcacagttgtacctcttctaatcaatcacagttatacctcttctaatcacagttgtacctcttctaatcaatcacagttatacctcttctaatcacagttgtacctcttctatttacttttgtacctcttataatcactgttcttcctcttttaatcactattgtacctcttttaatcacttttgtacctcttctcatcaccgttgtacctcttctgaccaatgttgtacctcttctaatcacttttgtatctgttctaaaatttaaaaaacggccgcgaagcggccaaaaagaacaacaaaaattagaaacgggcgtgaagcgcccgtctgagtcgatcaaaatttaataacggccgcgaagcggccgtcaaagcccaacaaagtttaaaaacgggcgcgaagcgcccgtccaaggccaacaaatttgaaaaacgggcgcgaagcgcccgtccaaggccaacaaaaattgaaaaacgggcgcgaagcgcctaacaagctaaaaaacgggcgctaagcgcccggataagttcaacagatttaaaaacgggagccccggggacgaaatgagcccacaacaaacggagaacttgtttgtcatcggatagcgagcttccaacgggtttttgtcgcgtccaaatccagccgtttcttgttcaacacgctgcgttccttctgtaaaggaaaagggagggatttggattaaaaattgtcgaaaattgagtgaaaaattgcaaatccacgcctggacggtgcgcagttcgttctccaggaggtgccggaggcttgccaaggtttgcgtggtgaccgattggatgagttggcgttcccctgctgccattttggactccgtctgtgacaccttcagcagaatagctgaaaagaacagaaaatgcaattagtggggttaattaaattgagcatttccgattcaaattctctcacctccgaaggtcgactcggcgcccaccgctttcgatgctgcttccttaaattttggtgggcattaaaatgtgttgtgaatgccaaaaaccacaccttcatcgcctccccaagaccgtccagcgtattctgtcggacggatttgtcctttcgcgtgtccagcgctcggactgctgaaaattgagggaaaatttactgttttcctccaaaaattgcaaattcc

SEQ ID NO: 36008 - DNA, 1254 bp, Heterodera glycines
gtcatattttttcatgacagcctccttttttttgccaagtatcgcccctcagttgtttgacggttttctccttgaatcggagatgtcccaattccgcgcactcttcggcaacttcgcgccaacagtcctcaacaattttgcgaaaattgggccccactgctgtgttgaaaagagtttcatgtcttttctcaaccgcctaaagtcatcatactttatatttatgcttcgaccgaattggcacaccttaacaaaggctaataattcatccgagctcaaggcagggccatgggcagtcatttaatagcagttcggagagaattgaccaataatttttggaggaaaaacaatgatggcttagtcaatatatgcaatttttaataaatctacaagctcattgatcactctttgttggccgcacacttttctttgttcccccaaaatttgcccaaaagttttgacaaacatatttattatttacttccatcaaaattgagaacaaacgacaaattactctgaaaaatttggtaattctgattggacgacaattcggacgacagagacaaacgacaaatggcaaaacgataaatttggacgacaaacgatatatttttttgtcgtaacgacttattaggagacaaacgacaaatttgtcgtttgtcggtcgatttgtcgttcgtaattctgaaaggcccctgaaccaacacaaaaaatattttgtcattgttctcattcacccattctctccaccgcttctccgttagcccaattgtgacgttcgaaagttgcatgctcagctgtttcctcctcaagctgacccctctctgtgcctgtttctgttgcggctgtttgcattcggtcaatgtgcccattgtgagcagttggcaaacgcaaatgtcggtgaagtaacggacaaactcatgccatggcatctgaatggcttaatagccaatcaaatgcccattaagcaaagtctctttacaccaccgccatttgcctaattattgaattggtccgcgacaaacccaaaactctccgtcctcgtcaacggtgatgccaagtcgccatttctgctcttcagtcacctaaaggtgttgttttgtgtgggcatggattggccagtgtttgtgccatttcatttcgcgcccttttccctcttaaatgggtcgacctgctcccattcgggcgacccgtccgaccacggtccgttccattctttcattcccccagggctaaagtgcaatttcattgggaaaa

SEQ ID NO: 36009 - DNA, 891 bp, Heterodera glycines
  misc_feature (63)..(63): n is a, c, g, or t
ttctgagagttgttaaaaaaatattttttttaataaaccccccttaggataggaaatattatntggctccaacgcaaacttggttttttttggatggcatttattttaaataatactggttttttaaatgttttttttggatggcatttattttaaataatactggttttttaaataagaaattccaaaatgtcaaatctccaaatgtcccacaaaaatcaaatccccaaatttcgtgtactcctcaaaaagaccccccggcgcggcttttacccccgccaaataggggtttaacactttcatatgcttcatcacacacaaccacccaccggtgtatctgttgtccaggatcagatgctcctccagcagtgcgcccaaatcctccactttcttcagcttggcccgctgtgctttgatgtcctgcgcattgcgacgtattgtgtccaattgttgctcttaaacattctattttcccagcggaaggcattcatcagaattgaaaaatttatgtgctttaaattttgggcggaataaaaaaacgattgattacccctccaaatcttttatcgttacgacggccctacaaaattaggcatccactcgggataattggtttgccatactcacccaatgatccgcttgcttccatcatttcgccacgtgtgtccgccaaccattggtggaattcattggcctgtcgtgcaaattctcgtctcagtttgtcgttgtcctcctggcgcctgtgctccttttgcagctccaactcgcgctctttgattatctgttggcatggaaaattaatttaaaaaaatattttttaacaagtctataaaaattatttgattcatttctgatgatgaaatattaatcaattacaaaacactgatgatg

SEQ ID NO: 36010 - DNA, 882 bp, Heterodera glycines
gggggggctcccccgaaaacaaaaaaaaacgattttttcaaaggcccgttggggggtctcaaacatttatggggagcaaaatcccaacccagattaaagtacaggctatagggaagctattcccgaagggattcggtctccccataaatctgggcgcatcggttcggggggactcccccgaaaacaaaaaaatcgattttttcaagtgtccgtttggggtactccaacatttatgggagcaaaaatccaacgcagaattaaagtacaggctatagggaagctactccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaa

SEQ ID NO: 36011 - DNA, 1303 bp, Heterodera glycines
  misc_feature (42)..(42): n is a, c, g, or t
  misc_feature (1115)..(1116): n is a, c, g, or t
  misc_feature (1137)..(1137): n is a, c, g, or t
  misc_feature (1139)..(1139): n is a, c, g, or t
  misc_feature (1166)..(1166): n is a, c, g, or t
ttaatatttttgtgataccaatgtttaagtgcgtactgttgntgaaaatagggtacgaaaaactgtgataccccattcagagactagcaaaaaaatcagaataggatggatttgcgtaccaattattatttttataatgggttggttaaatgcgaaacagatgacaaaagttgttataactcaattcagagatgagatagaaaaaaacaacaataggcttggagagcccttgaagagctgcaccggatgcaagtgccgccgttgctgtacgcttagcggttgctgtgcaatgacggaaaattgctaaatcagaaaaaaccaaatattatcaggaatacactctaccatctcacccgtagacaaaccgaatggtatatgttcgaacggcaagttgactaccgtaactaattaatatttttgtgataccaattgttaagtgcgtaactgttgtgaaaaaagggtacgaaaaactgtgataaccccattcagagactagcaaaaaaaatcagaataggattggatttgcgtaccaattattatttttataatgggtttgttaaatgcgaaacagttgacaaaagttgttataactcaattcagagatgagatagaaaaaaacaacaataggcttggagagcccttgaagagctgcaccggatgcaagtgccgccgttgctgtacgcttagcggttgctctgcaatgacggaaaattgcaaaatcagaaaagaccaaatattatcaggaatacactctcccatctcacccgtagacaaaccgaatggtatatgttcgaacggcaagttgactaccgtaactaattaatatttttgtgataccaattgttaagtgcgtaactgttgtgaaaaaagggtacgaaaaactgtgataaccccattcagagactagctaaaaaaatcagaataggattggatttgcgtaccaattattatttttataatgggtttgttaaatgcgaaacagttgacaaaagttgttataactcaattcagagatgagatagaaaaaaacaacaataggcttggagagcccttgaagagctgcaccggatgcaagtgccgccgttgctgtacgctttagcgttgctgtgcaatgnnacgaaatttgcaaatcagaananacccaatattatcaggaatacactctnccatctcacccgtagacaaaccgaatggtatatgttcgaactgcaagttgactaccgtactaattaatatttttgtgataccattttgtagtgcgtaactgttgtgaaaaaagggtacgaaaaactgtgataacccc

SEQ ID NO: 36012 - DNA, 937 bp, Heterodera glycines
  misc_feature (896)..(896): n is a, c, g, or t
tttttccattgattgaaattttgaaaagaagaaattctgacggacggcacaatggcttcatgtgcatatgtaatttgattgatgatttttgactactcactgcttcttctgctccttttttggctgtttgagatgacaaatgagtccatgagagagggcagatgttttttgggggacggcttttgcccaaaataaagcttcatagttccaaatttttttttgttttttttgtccatgagagagagcagatgttttttaggggggggggggcggcttttcctcaaataaagatttaaaatttacaattttttcaacaagtttttaaccactggggaagaatgtgtcccgagaaagcagtaatggttacgcaggccctcaaaatttccgaaattccagcctctcaaaaatcgccagtcccggataaacagaattaaaaattctggccggaagcatcaaaaacctacgaatatcattttaaatttcaaattaattcttttcttaatttataattaaattgttaattaatttgagattgaataagcttacaaatttggaggaaaggacttaatttccattaaaaaacaatttgttactaattgcgaaaagcccatttatctgtaaaaaagggatgtcacgacacttaaaaagcctgaagccaactggtttttttcatttccccacttttgccttttgttttttgttgtttttacggttggctgtgtgcttgcgtttcctttctgctgatgataaaactgctgctgctgctggactggttgttgttgttttgtttggacaaaaaccgatcgaaaaacggtgctgagagcgagataaaagctgtattttttgctacagatataatctacatatacattttccccaccctctaataaaattanttagtttttttaaatcccaattttgtttgggccttaaagct

SEQ ID NO: 36013 - DNA, 999 bp, Heterodera glycines
  misc_feature (943)..(943): n is a, c, g, or t
  misc_feature (968)..(968): n is a, c, g, or t
agaagcattcttcatcaaagcattttttcgttatgtttcttaaataattgtagaacgattcctaaaaacgccagcaatttacccaaatcaattaaatgcattgaaacattacggaacaacattgcttgattaccttctcacgaatggtgaaagcaatttgtcgcaaaaattggtccaaatcgatggcatgccaaatttagtcaaacatttttgccaatttttgggctatggtttaatgaaagatgcagacccaagcgaaaatgatatcaaaattgagctgccagcagaatggaaaatattctgcaaaaaatacatggaaaagattagcaggaaaatcagtggttattccgaacaactcaaatccaattgtaactgatcagtgatcactagtgatgcaaattatatggaaattattccatttttcctggactgatgcaaggcatgaaacgaacgaaaaacattttttaagcttggtttgaagcttctagcatgggtttctgtaaacatatttttccatatttcgcgatttatttcgtaaaatttggtaaatttagaaaaagttgtatgaaataagtactatttctgccatagcttatgttaaatttgatagttttattaagttttctaggctaatagagaaaaggcttgcttattgaatggtaccaagaatgtaaaatttaattgcctttaagcaaagttatataccatgttttgccgaaaaattcgctaaaatggcggatttcacgaacgacccagcacggttataaactcttttgtggtttgtctatactattatgggttctatcctccattgtccatgtttttcgcttttttaaaatttattttttatctacaattaatttattttaattcaaaaatatataaattaaaaaaataaacagcgcatatccggtacactccaaaaaatgtctcctgaagactntctggaccatatgtttttcgattgnccgacatttgcgccgtgacactggaggcgca

SEQ ID NO: 36014 - DNA, 997 bp, Heterodera glycines
gaaaattcaaaatattttaattcctgtagaggtattgaaccaggggaaagaaaaagacaaaagtaaaggggactagccactaggccatttgcacaatttgttctaacacttttaaagaatatttttaataattttttttctaattttttcctttgactccaattttcatcactaattttccactcagacccccattcttaacagtgcttgtttgaccgggaccttcaaaatccgggaccgggaaccgggaccgagatttcggcccaactaagccggtctttaggactaagtcaaaacagaaacaagtacatgtttaactctgtttaaacagctgtaaaaattgaccaaataataagattaccaggcttttcattttcaagaaaatatcaattttcaagacacgagagttgtttaatttactaaattttaatgatttatattgtaaagcgcaattaattcacacacatttaactggaggtgctacatttgcgcccctacatttgcgccccgcacatttgcgcccctacatttgcgcccctacatttgcgcccctacatttgcgcccctacatttgcgcccctacatttgcgccccgcacatttgcgcccctacatttgcgcccctacatttgcgcccctacatttgcgcccctacatttgcgcccctacatttgcgccccgcacatttgcgcccctacatttgcgcccctacatttgcgcccctacatttgcgccccgcacatttgcgccccgcacatttgcgccccaattgtgaataaaaaatatattcataaaattgcctttcccaagggctaacgggagtgattatattattaaaaaatcatcatgcacatccgaatagctcttgttttccttctcctttgactgcgtacagcatcagtaggccaagatcggcccttgaatttttcacttttcgtctcgccattgtctttgctttagtagaggagtaaaatttacattttaatttattaacaaac

SEQ ID NO: 36015 - DNA, 779 bp, Heterodera glycines
taaaaaatatttatgaaaatgtttaattacattgcttttaagtttaaaatacaaattttcttaataatttttatttatgaaagcccaaaacatttgacgttaaaatgaatgggtaaaaatggtctttttttgtgcatttctcatcaaaataaagctgcaggaaaaatatttatccaatgtaaatcctaccaatcctactaattaattggtaattatttaattaattatccattcgttttgcatttgtttctgtttttcttccgctaattgattcgttcgtctattattttgttaagccatgtacgccattgtgctcatttgcttgggtctgaccttcgtccatttgtttctctcagcagcgatgctttacggttgtgtaaaggtggaaaaattataaaattttttaaaaatttatttgacataatacctcttgagctcgggtataatcgggatttcccagagttcgccgggattcctgtcctgtttacgctttcccgatgccttccaatttgctgaaatggtgcccttttcatttggccattattttatcgctctttatcccccccctgttggattaacgatggattagtcactcttttttaataatttcttttaattctttccccagcgtctcccccaatggcttttcccctggtttttctctgcccttccgctgattgttctttccaccgcttattccgtgctgtggtggagtggcgacgtgttcaatgagcagttgaccttctcagttgcgcagttcgccatgtctttggcggtga

SEQ ID NO: 36016 - DNA, 858 bp, Heterodera glycines
aaaaaaagagagatacccatttttcggggatagagtataaatttaaaaattccctcaaaaataaaaggtttgttgcgcgccgccctccctatcatgctcgagaccatttggtagggtgtataaaatttctcaaaaaaagagatacccatttttctgggatagagtataaatttaaaaattccctcaaaaataaaaggtctattgcgccccgccctccctatcatgctcgagacctttggtatggtgtataaattttatcaaaaaaggagatacccttttttggggaataacctaaaaatataaaattcctctgagaaataaaatggtgttcgcgcccaccctccgttccattctgcaagccctttggaggggtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctctacgcaagcgcttttgtgaggtataaaatttctcaaaaaaagagatagacatttttctgggatagagtataaatttaaaaattccctcaaaaagaaaaggtctattgcgcaccgccctccctatcatgc

SEQ ID NO: 36017 - DNA, 898 bp, Heterodera glycines
  misc_feature (879)..(879): n is a, c, g, or t
tcgttgtttgaagttgttggaccacttcttccactccctcctcttctccgcccactttcgtcttttgctgccgttcggtttcctcaatttttcgtccaatttgaatttgatcattttgctctttttctgcttcttcctcttcgtccctttcctcctcatttccgctttctattatttcttcttttttcgcctctttcgcggggtgtggcgccgttgggggtgcaattgcccaagaaaagtgtcgaaatgttttggcggcaactggcgaagatgcttcttgtctatcaaagccagcaacattctcatcaacttcaacatcgagttgctaaaaattgtgtcaaaataagaaaagaaagacaaaaattgttgtaaatatgtaactataaatgttaaattgcctgcgcaaagaagcagataaacgaaccttcctctttcgctttttgagaggtgttgttggttctgaggcgggcgatggatcgaattttgacacaaatcctcctgcaagtctaacatattcttggagacgaaaagccaaatcagctgcactgccttttgtatccagccctgaaagtttaatggtaaggtccattaactaattaataacagaaagaatgcgcaccgcgagcttctaattctttcttgactcttgccattgggagtaaatgaatcgttgatgggttcagcccacccgaatccacaattcccgaacgtcgcgaacgcgttgacgacatactgaattaggtatattgtacctaaatagaaaataaactaaagtgacaaaaccgaaagcacaaaaaggaggaaataaaaataacaaaattaattaattaaggaacgaaaagtaacattaaggcacggcacgcgaccaaaacgaataanaggcgcgacgcgaataatg

SEQ ID NO: 36018 - DNA, 1030 bp, Heterodera glycines
ttgggcacggagttcggcatttggtggaatgccagcgctgctgagcaaattttggtcggacaacgacgagccctggccctcgacgaagccgttggtcgccgcattttgcaaccacgacggaacggattgtgacaaaagattcagtccctaaacaaaatttaaatttgaaaggtatttttagttaaaagaactcaaaatgactaaaagtagaatttgcttggtgttttttacctcgacgagaagtgcagcaagatccatgtcagtggccgggtcgaagaatgtggtggacattccctgttggattcgcccggtacgtccgatacgctgcacatatttgtagtaggcatcctccgcactgtcagcacaaggcaaatccaaattgatcacctgaaatggtttgcacaaatgattgaccatccgataattcgtttagtcttggactctccccctccaccctcttaataaatggtagattaacagacgcgctccaaatttttgatgtcgtggccacgggcacaaacgtccgtcgtgacgataatttggaattcgcccgttcggaagtcccacaccgccttctcacgcgttggttggtcacgtcgactaaaagtatttgcagcgaacttcagagaatgagagaacgcacccattaattgtcgtcgctgagaatccgcgagaattcaaaaaattacacacaatttcagcatcgttgcgtgtgttgacgaaaaccatcgtgctgagaagtttttttgaacctgaaaaatcggcctttttaacatgtactgtttcaaaatccacatacggtccaattgttcgttctgttccttctcgagttgcaacagtcggacgagtgtgtgccgtttctcggcactttcggcaaggacaaatgtttgtctgatgcgtctgttcggtgttatttttcctctggagactaacacggggttggggcgcatgaattcgtcggcccatttcagcacatcggatgaaaaagtggcggtgaaaaaaagagtctggcgcaactcagtctaaagga

SEQ ID NO: 36019 - DNA, 915 bp, Heterodera glycines
  misc_feature (7)..(8): n is a, c, g, or t
cctgcannggtcaaaattaaagttgaattttcgccggtggtccgaaaatccccccccatgtgttcaaaaaatggccagagccaaagctgctaaatgccgaagaattgaaacaggaaaaaggcattggcaaacaaattattgaattttttaaagggaaaagcccaaaaaaaggaaaaggaaagggagagagctcaacagaatcaattggtagcaaagaaaatgcatatcgtttacatgaaaattttaaaaactttttgaatgaaatgtccaaaactgcgaaaagaacgatttcaaaaaatgggacggacgaagaaaaactcaaatggacatggctattttcaaggataaaggtattaaagctgggatgaatgtactttaaataaattccaattacgatcaacctatttcgtatttaccgaggtctttaaaaataccgtaacaaaatccgtcgtggtatccaaaaaaccccacttaatttccgtgtttcagcttgacgacgagctgtttcttacttttatcaaagaacaaacaaaatttgaggaaatttgtagagaagaaggagaagaattatggacgaaaattggcttgttatcaaagcgaaaaggcaagggcacatacgatattggggatacggtagaatatttgacgaaacagtacgaaggttatcttggtattttgtatttattgaaagagaaatggcaatgtgacggaatcacggagaagcaaaaaagagagaaatgtgaaaagtttcagaaatatgttgagattatttttattattaataaaattattagctaaaaactggcggctggcacaacaaatttccgcttcggttccaaactttcatcttggcaaagaaacacagagtgccattttgattgatgttttggacagtctgattcacatttgggcatt

SEQ ID NO: 36020 - DNA, 566 bp, Heterodera glycines
  misc_feature (33)..(33): n is a, c, g, or t
  misc_feature (51)..(51): n is a, c, g, or t
aataattaattttaaaaaaagatgctatgtaanttggaatgatacaatacntctgaagaaaactcaaaatattcatcatttatcgagcgtacccaaacccacgacaatggggcgctaaaatttacgagaaaatttgtcaaaaactttacatttttcgtttttcatttcagccggactatgaccgattgcttgatctgctgcagatgatcagtgtgttttcgccggagttcaacaacaatgccaaattgatcaccagtgtcaccgtgcctttgatagtatcagcaccgccaacacgaacgcgtggagcagaaaaaatgccatcatcggtctcgacatcattggcacaatttagcggggcaccgatgtgctgccaaatgcctgcgacagcggaaaaaatgacacaggtcgaaaaaatgaatattttaattgacatttcaatgtttaatacctgttcaacctattatttccttcaaaaaactgaaatttctgatgtctcaggtcgattttgaatctacaaaaattgacgaaaatggggtgcaggagcaggatgatcagcagaagatgaa

SEQ ID NO: 36021 - DNA, 1392 bp, Heterodera glycines
  misc_feature (1328)..(1328): n is a, c, g, or t
ggcatttgcgcttgttgtgccaccgcctccgcaaatggctgcgacgaaaccgttgccggcgatgacggacgacgagtgcggcggcggcagcggtggggcgaaggaaagcggcgccggtgggcgcgtgcgctgtttgcccggcttcaccgcactgctcaaaccgttggcggcggacaacggtcagcctcagcagaacatcatgaacatgatggcgaacaacagcgggggcgtcgcaatacaagcacaacagcaaaaagcacgcttttcagtttatgggtcttcaaaatgggggattttccaaaaaatatattgttttgacatctcgattaaaaaaagtctttaagttagttaaaagtgaacgaaatttaaatttttctccttttcagaccgattctttgcttaaagtgtacgagagtgacgggaacgaaagtgacggggccagcttggccagtttcaactcctcactgctcaacatacaaacgggtgcattttaaaggcattgtaaaacgtgggacactcgcgacacataaaaaaacctattaaagttttgttttaaaattcttttgagaattcttaaacaagaaaaaatgtttattctatggtattctttcgaaatttttttaattttaatttttcattcaaaaaaggtcggatttttagttccgtttttattcgggggggggggggggagtgcgcccgtattggtaaaacgacggaggcgcattttattattattttttataaggcttttcctccgatagccgtcaactgcaacaaaaacagacgccgcaccaccagcaacatttgcagctgaagcggcgcggacggcccaaaaaggcggacatggcggacacgggccgcagcggaacgccggtgatgaacgggcgacagccgatcagtgtggcggaggcgatgaaggttggagttggcggcgatgggatgggattggcaaaaaaaatcattatgaaactggcacttactgttaaccctgcttatcgtttaaatttctaattgtttcctttccagtggagtccctcccgtttcaccagcgagtcgcgctttgtgatcgcttccaaagtgaatcggctgctcggcttcagcagtcgtggaggtgagcgacaggccgaaatcagaattattaacagcaaacagattggaccggggttagtcatgccaggaaacggatcgttttttaaattttcgagtggtttatctgaaaaatccgaatggaaaacccaaattgcccggtgtccagacatttgcgccaatgtcctaaatcggattcaaatttaagtttttcattccctgatcatacataaaaaaggggngggggggggtcggctgccgacgacccttttttttgcaaacttttcggcgcggtttttcccaaaa

SEQ ID NO: 36022 - DNA, 1073 bp, Heterodera glycines
cgaccccccttcgctttttccgacccacccccctttttatgtatggagggattacatagttcacatacttttaccacaagacaaagagactgttcatggtacagagtaataaaggcgccgattaatccaacaattcgattttaggtaacaattgacgatgaaatggctaatcaacgaggaatgggcgatttttacgattcggatgatgaaactccgcccgaaaataaatcggaattgaatgacagacagcacaattttggagatgaattgggcggagggcagtgggacggcaattccgaagggaatggcgaaagggaaacccgcgcgcacgaagcggccaatggttacgcatggactgtggtgcgactggcgattgtgcgacatatccaacacaaattgcgcaattttgtcgagatggtcggcttcgacttacagggcaagcaaataaccgaccgaaaaaaaaaatatttcggaaaacgcacttaccgcacaacttattgttagtgttgcagcaccaaaatgactcttgataatgttacaagtggaaataactgtgtattttcagaacaaagtcaaatggcacaaaaatttaaagaattccttgggtaataaacacaaataaaagcgctaaaacagcttcaaattgccaaatggctttcgtggttttttttttgtttgcttacaactagaaaacagccaattccgttctctattgcggtcatttcaaaccccaatttataatttgcgtttcagagattgcgcacctttcccctaaacttaacctcacaatgaagcggttcaattcatgggcctcccaattggagaacgaactcgagggatggaaggacggatgtccctgcgactttcttccgaatatgtcgccaatttcggttttccgcagggcctttatgctaatgtccaatgtcttaaggatgcaaatgactcctcttccctctcctcttcttcctcctggtcttcgccactccttcacaaatatcgcttgctaattgagcgtacgttttattttatttggtttttttgattcgctcactttcgtttgtttatttcatttc

SEQ ID NO: 36023 - DNA, 608 bp, Heterodera glycines
  misc_feature (545)..(545): n is a, c, g, or t
  misc_feature (592)..(592): n is a, c, g, or t
gttgcggaaagatcgggcggtacggtaatgcacggtaacaccatggcaagcggacggacaagcataatgtaaacatcacgacgaacagttttgttgaacgccaagtagatgctgggtggaattcctgttttaaaaattaaaaatttaatttttaattaagatttattaaaatttaatttcttttaccatgcgccaaaatccaataaaattggccagcgaccaacagaaattcgcttaacgggacaaattgcatgaccacataaattcctgaagcaattgcatttacgctgctgatcaaaacaacttggacaaaaatctgaatttttttttaattaattttaaattaaaaatttttaattggataaaaagtttaggaggtatcctttacttaaaatttcaattttaattcattttacacgcctttttctgtgaaccattggtggtggtccgtccttgattatgcgactcttcatgaacagaatcaatgcaaaaagcaaatagatgccgggaagtacagtaaccacaaggacgtcatgtaccgattngaaatcatttacgtactaaaaaatatttctttttgtctactgtattntatgagttcaaatttc

SEQ ID NO: 36024 - DNA, 811 bp, Heterodera glycines
agttcgaaatacaaattttcaaatgcaaacaatttttaaacttaaataactttcttaaagttgaattttaacctgtttgtcttgaatttatattgcgaatgttgtaaaaaaataaactaaaattttttataaatcaaacaaccattaaagaataatataaaattctataattattttctgttttctaaatcattttaaatatattgaattaaaaaataaattaataaattaattcgagataaacctcgtacaccattgggttttcgaggtcattttccaaatttcgttttcatttttgcactcacttatttttgaaaaagaatggacagattgaataatataaaaatatatttaaaagtagcaatatttatattctaagataaaagtaataataatagagcaaaagttaaattataaaatattttaacaaacttggtccaagcatttggtgttcagttcgtaaaacaaattttcaaatgtaaacaaactaattttttacatcaattttgagaattattatgaaatttataataattattttaattatttcaattttttgtaacatatgaaatagttgtttttgttgcttaataatgattttattacctcattagagcagggtttcgatctcagaattttgaaaatcctcatttcagccataaaaaatcatcattttttaaaacataaaaaatgcaaacaaaataattaaaattcatattttccgtttgaaaacaatcacggcgcctattaacgccgccggaccccaataattcctattttttcttaaaaattggaccagaaatcgcaaatt

SEQ ID NO: 36025 - DNA, 1331 bp, Heterodera glycines
  misc_feature (1193)..(1193): n is a, c, g, or t
  misc_feature (1261)..(1261): n is a, c, g, or t
tggcaggtctcatcagaacggtacggatcgagcataagggaccaatccaatcccgacaaattaatagtcagtcactaagtgccgtggcatcttcatcggatgccattgccttccctgccccaatttcgattttcagggatggtacccgttgaaaaaccacctcagagcgctttccggcacgagtgccatccgttggaaaagggaaactcccaaaagtgctcgcaatgcttttgctgtcacttcgcccgcgaggcgtccgttttttgcggagaaaattatcctttggacgacgttgaataacttcagcaattgttcctcaaattcatcgcctaattcttttgaattgtgcactttcactgcccaatgctgacgatcgatgtgcaaacgatgccaacggggaatgccctgggaaaggaaggactcttagagtgatcagactgatcagcaggtgaacactaatcattaatcaaagtgatcggcagggaatgatcagcatttgattagataattgatgatcaaaaagggaaactgtttttcaattagtatgtctaagctcagttaatgaagaaatctacttgagatttatttaatataagaaattatctatcggagtgatcggatttctctttgccttttccaaatgttcccaaaatgccgtcagaaattgctgcaaacttcgcacagtgtataaatcattttccgagtagaaatttcgaactgattgaagagaaaagaacaatttcattgctttgaaataatcggaaggaatttttctgaatttattttaaaagatttattaagacttattaaaaataaatgacctttgtgtcgaaataagttgaaaaagcattcttacaaagaccaaattaaacaatttttcgacattttcccttggtaaaagtaaaggctaaacaaaaaaaataaaaaataattaaaaaggaaagtgtttaaattaatggtggattactttaagtgtggcaaattgttgaaacaaatcagagagaagagaaagaatgaaaaccaattcatcagctgacggagaatgtccgccagtggaagaggcgaaaaattcaaattcgaccaaagcatcgacgatgggctgtcgatcgccctcattttgcaaattgaaaagcacggaaaacaaattttgaaagaaaggacgacgaatgtgccattcggcaccaatctgttgnggggggggggtaaatttggggaaaagggtcggtcgttaggaataatatcaatttagcaataattaccnatgcaaaaatgtccaaaattgcatgtttctccaaacgaacagtcccaagcagatttgctggaaaaactct

SEQ ID NO: 36026 - DNA, 1304 bp, Heterodera glycines
cacacacacacacacacacttcaggtttaatgcgttttgaaccggtggaatgcgggacgctgaactgctcggcgatgtgttttgcacccgagggatgggaggagccgaaaatttgcgcttccgtcgctcccgtctgtgacgtgccaaaaacacccaaaatcgactggtctttgctcaccgacgcggtttcggctctcatgttgctcgccaacattttcttcacagtttggctcatttgccgcgtccaacgcttgccgaaggaagcgcctccaaaggacccggcttattgtgatcagtgccatcgtctcctgcttccgcgggtccttcctcatcgccgcgtcagcgtttttgaggacgtctcactggtgtccgccgtttaaaagcacaatcagaaataaaatcacttcaaacacaaacacacgtgcatttgatttttgttaattaattttatttgaataaataagcacttaaattgtccagtaaaacgagagagtgaggggaaaatatattagagaaaagctaaaaaattttgggtgaagtcttacggtaggaaattatggaaatgaatggtcaaagaatttaaattttaaacaaaatggtgaatggcaagcaaatttaagtgaggaaattaaataattaggaaatttaccaaattaatgaattataatggggagataacggggcagggatttgaaaattttaaggaaaatgaaggaaatttatggaaagaaattttaaatttgaagggggagaaatatgtaaaaacaatggggaattttgtttacgcaaaattaataaacgaacggggaaataatggcagcgcaaaatggggcaaactaaaattgttaatttttaccaatgcttgagaaatattaatgctaatatggggaaaagcaaatgtgaaatttaagggatgcattggggaaaacgagggaaagaagtgttcgcatccacccaggagcaccatgacaaagccctactctggagactgttgggactcggggacacccaaaatggggcccctcgtcgcagctccgggcgggccaaaaatggcccaaaacaccaagcccccaaatccgcttttcgctgtcctctttatttgctgagtggaaaaaccaagccaagccgaaacaaaggtgaaccaattaacagaaatgaatgaacgaaccgggccaggggaaattgagggtgggcaaaaaaggggagggggcagttggtccatttgaggggacaaaaagtgatgagaggggttgacacaaaggaagggggaaggaactcccaagcctcagccaaaggggaacccc

SEQ ID NO: 36027 - DNA, 854 bp, Heterodera glycines
gagacagcaattttcaaaccgacattttgtagggctcaaccgcagatagtaatgcgtttttggggaaaccccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccattttctgagaatatctattcttctgagaaagcaattttcaacccgacattttgtagggctcaaccgcagatagttatgcgtttttggggaaaccccacatgtacaacggtgtagaaaaaaagagatagccatttttctgagaatatctattcttctgagaaagcaattttcaacccgacattttgtagggctcaaccgcagatagtaatgcgtttttggggaaaccccacatgtacaacggtgtagaaaaaaagagatagccattttctgagaatatctattcttctgagaaagcaattttcaacccgacattttgtagggctcaaccgcagatagtaatgcgtttttggggaa

SEQ ID NO: 36028 - DNA, 865 bp, Heterodera glycines
aaaaattgatttttttttttggggcagtccccccgacccgatgccccaagtttatggggagccgattccttcgggatacctccctatagcctgtacttaattttgcgtggatttttgctccccataattgtttggagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggagtagcttccctatagcctgtactttaattctgcgttggatttttgctccccataaatgtttgagtaccccaaacggacacttgaaaaaatcgatttttttgttttcggggcagtccccccgaaccgatgcgcccag

SEQ ID NO: 36029 - DNA, 1232 bp, Heterodera glycines
cccccccgccgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcagcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatctccctttttgatagaaaaagcatcagagtgcctaaactaacatgtaaataaaatttggtgcgctttagagcactttctgaaaaaatatttatgaaataaaaaaatcgatttattcaagtgtccgtttggggtactcaaacaattatggggagcaaaaaatccaacgcagaattaaagtacagactatagggaagctaatcccgaaggattcggtctccccataaatctgggcgcatcggttcggggggactgccccgaaaacaaaaaaatcgatttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccacataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagccta

SEQ ID NO: 36030 - DNA, 780 bp, Heterodera glycines
tttttgaaaaaataatttctttaaaattttaataaaaattattaattcaaaatcgaaatgcatttaaatgtttactaaacatgaaaaataataccgaaaaatcatttacttcaccgggatccgaacctgaccccccccccccccctcagaatgatgcctaagaccccatttatgcagggattctgaggccttaacggagtcctaaccaaaagcttatttcagattctttatcagcgccctaaaatacacctaaagacatatttttggaggattttgggcaaaaaaattttacactcaaaaaacatatgcaacccccccccccccaccccattggtcccgaatcacaaaatgagtttttaatgttaaaactttctttaaaaaagagataaaaatataaaataatatacctcttgttagagatcggaccggtcggtttttttcggtatttttcgattttcggtttcggtttttaaccgaaaaaaccgaccgagaaatttttgagtttttcggtttttttcggtttcggtttttttttcggtttttaaccgaaaccgaccgaccgaccctcttgtccggtctctatctcttgtaatgcaaaaaattacagatttttctttattttttaagctagctttatccactaatattgtccaaccctgaaagcgagttattaatttctaaaaattagcgtaaatttccctggctcaaaaaatgaaaaatttaaaacaaattcagaattttctgaaaggttcaattcgtatttgaatattttcgggggtt

SEQ ID NO: 36031 - DNA, 766 bp, Heterodera glycines
  misc_feature (408)..(408): n is a, c, g, or t
  misc_feature (414)..(414): n is a, c, g, or t
tacatattattattccataaaaagggggggggaatggaatgaaaatgaacttattatgcatcaccaccatcaccacagcagtagtgctgttcgagaccaaaaatttcccgagactcgagactcgagaccgagactcgactccgagaccgagaccgagaccgaaaaccccgagaccgagacccaaaaaacccgagactcgaacttttttcaaaaaatttccctattcgcttaaaaatcgttaaaaacattttttttgactctattcttaactaatttttgcttttttttaattttgattcaatttggtacaatacttatcatttcaaaaacgcactacacagcagtagtgaagaatgcgggcggaggggggagttaagtggggttttgtggtatagaaaatggatttgngggggnggggagaatggaattgatcatcacgggagaatgtttggggatttaatggagtggggttgagggcgggaaatcgcccaaatcggcgctcgcctaaaacgggactgataatgtgattgatcggaactgatatgtacaatcaatttgggagttgagaattacattttcagaaaaatggtgcccgattaacgcgagggattggcaaattggaagatacgaggaaatcatcctcgacgatatcacattgtaattgcatatcatttaggaacgaatgcaaattcgtgatcagaaaccttgagaacatctctataaacttatatttacgtattttaaaatctcaaaaaaagtttgaaaa

SEQ ID NO: 36032 - DNA, 1133 bp, Heterodera glycines
ttgcggctcaaagtcggtacacctaatggtgttagtcaaaaatcatcaaaaaggcattaatcaaaaaaccatcaatcatagtgggttgcttttgaactgttttaatgtatttttggccacagcttttaaaatattaaattttttttaaatttctgaggctaataaagataaacaatcaatggccggccacagaattacaccaacagaattacaccaaagtagattcatatatatatatatatatatatatatatatatatatatatatatatatatatatatatatatatatatatatatatatatttttttttttttttaatcataacctcctccgttttgatagacaagatgggcggcataaccgaatggaacagcaagagttaggtcaatggccgtgaagatgcgcgggtccatccacttaagagaggagcttccctaataaacgaaattatagtattggtcacataggagggatatactgaagtgtcggggtcggttttggcacggaaattattttaatccattccttaagccataccgatttaaagtttttaggtgttttaggcatattttcaaattttttgaaatcgctgaaaaatatattggaaaattcctcaaaatgacgaaacaacacaaaaaagcactaaaatgccaaaagcacgaaaaattaaaaaattgagaaagcaacaatataagcaggaaaaatataggtttaaaagcacgcgtttttcatgccgcttagctcgaccgaaattagcattacctatttttctacctattttgagatttttttatacttaattaatagggcttccttttttaggcaaatgcctaaaattttgcgcacttgatatgcaaaaataagcacgaaagacgcgttttccgcttggttagagatatctacaatgacctttataattcctaacttttcctatttcggggttttttgtgcctaatgtgcctattttaaggtttttgaaaaaatctttaacaaaaatgcaataaaaacgaaaaacactcccccaagaaaaacccaaaaaaattttcagaaaatacatccctaagaattgaaaaaaattttcacaaaattatcgcaaaatttattaattactttcttcataaaaattttt

SEQ ID NO: 36033 - DNA, 1410 bp, Heterodera glycines
  misc_feature (158)..(158): n is a, c, g, or t
aaatcaatgggtacgaaaaaaatgaaaattactttaaaagcttaaaaaattttattttgacattcttacccatttctaatgttgtaatggtgccttaaattgggccagaaaccccaactgaaacttttttaccatgaaatgcgtgggccaaaaaagcnattgttaaaatgatagacttatttaaatttgcggagtaagtttcggaaacatttttaaaaaattaataaaacatttattgccaattttaggggtgatatttttacagtcaaattttcttttaaacaaatattacaagtgacaaagccaaacgcaaatttgcgtacggaaggaagctatgggccggaaagaaggtttaacaaaagccaaagatatttggactctttagaaaactcatttaggaaaatgaaagcaatcgcattattataaacactcaaaaaatgtattaaaaaattgttccgaaaaagtaaataaattaaattaatagaaatgaaaagaagtatattaatttttttaattgtgaaaaactaaacaaaatcaatttttttaaaattactaaataataggaaaggtgtgaatatttgaatttttagaatttgtcggaacactaaataaaattcacttaaaaataagtacccaattaataggaaagttttgcttattttttttaatttacaaaaaccgattaaaaaataattactcaaattaatttaaaaaaaaatacttattaaatcaaatgaacaattttgcaattaatatattagtgtatatatagcgcgagaattaaatggtgtgattgggttggtggaacaaacgttcaaacacttcgtcattatcattatcattatcaccgaaatcgccggcagtgggacgactaatgagtgagtgcacgacgacctcgtacagcactcactctccaatcggcgtaacaaaaatttgttggttattgaaggaatcaattaattaactaattaattagcagcagcaacagcgccgctcattaattttgtgtcgtcactaattagtgcggggaaatgggacgatttgcccgcaaaaccatttaccaatcaccccttctgtttggtgctactactcgccaaattctgtaatcacgaaaatgtcttcttctttttgggtaacacgatgggggtacaccacaagaattagttaaatattataaaagaattattaatgtgaaaaatgcagggcagatgacattcactagccacaaacaaggagcaattaaaaatagttggaggttggaaaatgatattttttgttttcagatccccctgaaaaatatatttttgaaatgtataataatttataaataaaataaaagtttttgataaattctaatgaacgacatttaatacactaattgtaaattttgtcaggaattaatttacctta

SEQ ID NO: 36034 - DNA, 1093 bp, Heterodera glycines
  misc_feature (53)..(53): n is a, c, g, or t
  misc_feature (58)..(58): n is a, c, g, or t
cgctcagcttgtcgttttgacatgggatgtacgggagcggagaatagatgatntatgncatttcggtcacaatttcctaatttctttgaaacgaattgtgtgccgttgtccgtgactaaaatttcgggaaggccgtaactggcacaaagtgagcgcaaattgtccatcgtagtggcggaattcgatgaaacttttgatcacctatcgtttgccgcggccttggccaaatcattgtgcccaacggaagagtctttgaaacaaagttcagaactcctgtttcattgctttcacgaatgtttgcaatgattacttcgttgtccagcactggagtcttcgcgataaggcgagacaaaatatccgcttgaccaaaatcagcagtattttggtattcgatttcgaagtcatagcccagcaatgtgattgcccatctctgcaattgattcgcagtgcatgccttaattccctttttgttgccaaaaatggacaacagtggtttgtggttcgtatgcagaatgaaatatctcccgaagaagatacttgtggtatttctgaacggcaaagacaatcgctaagccttccttctcgatttgagaataattcgtttgctatggacaatgacgatgctgttgtgcgatggcttttagacttccatccgaaaagcgatgagagatcacggctcctattccatgctcagaagcaccagccgatacactgatctcttgtgccgggtcgtagtttgtcagcaattgatcagatttcaaaattttaatcaccttctcaaaggcattttgacaatcagccgaccattgccacactttgtcctgcttcaacaattcgtccaacggctgttggatgaaccttatgttcttcacgaatcgttggtaatggttgatcatgcccaaaaatcgaagctcggacacgtttgtcggaacaggcatttcagaaatagcctgactctttgtttggtccggtcgcttccgtcctgatcaatgataaatccgagatttttgatctcttactttgacgaaagaggcatttctctggcttgacacggaacccaaaattttcaaattgaagacctcttcaatgtgcg

SEQ ID NO: 36035 - DNA, 353 bp, Heterodera glycines
ttttgaaaaaacgtctatctctttttctgctcaacactcaaatgaactccaaccacattttcggaataatagcgacgaccctaatttttctggattttctttctgggcgagtttggctctgaaaattttgaaaaaacgtctatctctttttctgctcaacgctcaaatgaactccaaccacattttcggaataatagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggattttcttct

SEQ ID NO: 36036 - DNA, 975 bp, Heterodera glycines
ccccgctccccgctccccctcccctatttccactcacccctcttccccactgctcccacccttgtgtctgctaacataccatttttaagctgaacaacgcagttttgtgttcctttttggaaaagtattgtcaacgcgccgtgccagaccagtcaactcttcgaaaaaattatttggtccaacttttttctgaggttccaaaattgttcaaaaaattttttcaattttgatttttagacaatgacaaaaattaaggaagacattggtgaagcatttgtctggatttcagtggacgagactacggataaaatggggcgaatgatcgccaatttgttgttaggcaaattgtatggcaaaaaatggcaccccccgcatttaatttctgtgaaagcgcttgaaaaggtggacagtggagcaatggcgcgttttgttaatgaaggccttggtagtcgtttagcttttattcctagatattttttaattttagacagttttctgctaatattaagaaagagcgagtgctgtttttggttacggacggggctgcgtacatgaaaaaggccggaagacaattaaaagttagaaaaaagaaaattcaaataaattttttctctttttcaggttttttacaccaatttgttgcatgtgacatgtttgtgtcacgcattgcaccgcgtggccgaaaaagttcgtgacgagtttgcgcaagtggacaaattgataagcaaaacaaagcaaatatttctgaaagcaccgcatcgcctttctgtatatcgtgagatgtgccctgaattgtccatcccccctcggccagttttgactcgttggactacctggataacggcagtgtccttttattgagagcattttgaggcattaaaagcggtaatttatataattttattttttgtagtaaaggtttgtattttttaggtagtgaatcattcatgcaaatgatgctgtgtgtgttaagga

SEQ ID NO: 36037 - DNA, 976 bp, Heterodera glycines
tgtgtttttttgaatggagttcatttataaattatgacgccgtatgtgtgcgttttaaaaggtcatcgttggcattggcacaatatttttttgcgttcttttatcgttttgccattcgagcactcatttatttttttgaatgggctcaattttaataattttgctgcaacttacagtcggacgacgacaacatcggcaacagaagcggagggagagacagacaaactcacataaatttggccataaaatatgaacaaaaagccatcaaaaaatatcggcaacaattggaagaaaatgaacgaaatgatgcggctttatgacaaatattttttttatttcttgccaaatgacatgaaacataattaaaaaataaaaaggaaaattgaaatagaaacgtgtgaaaaaaataataagaaaatatttttaaaggaaataatttttgaaaatacccaagtaaagtttggtcggaattatttagctttcaaaattaaaaattgacaaggtacaaaaatggatattgccaaaactaaaataaattctgccgcaatgcttaaacgatgctcagttctaaaaaaagagttgaaatttggaataaaaatttaaaaaaaaattaaattttatattttactttaaattttaattcaccttaattttttcttaaaaatgtaaatataacaaaatattattaaacatttttttcgccttttatcgaaaaattcagcaacaaaaaaataaaaccatttaagggccttttttggactttttcgcgcttaaaaatcctcaccctactaatcagtgatcatttaaattttttattttacgaatttattttaatttttttctgtctttctgtctctatctctgtgtcactccctagagtggtgcagtctctctcctcctcccccgtttctcgtccacctgtgtgtgccctaaagggcacatttgaatgttgtccctggggggggggggggggggg

SEQ ID NO: 36038 - DNA, 1022 bp, Heterodera glycines
ctagtcgatagaataatgtaggtaagggaagtcggcaaattagattcgtaacttggaaaagaattggctctaaaggtcgggtcagccgggctcgttgcgtgaaacaggcggcttttgcccgtggctgcgtgctgttctttcggggatggtgcgtggactagtggtgagagctgcttgtggagcgcttcagctgcgtgtatgctcgtcagggtatgcacttcggttggcgctgaacgaccagtttagaactggcacgaactcggggaatccgactgtctaattaaaacagaggagacggatggtccttgtggacgttgaccgtgtctgatttctgcccagtgctctgaatgttaagccaaggaaacttgattaagcgcgggtaaacggcgggagtaactatgactctcttaaggtagccaaatgcctcgtcggctaactaccgacgcgcacgaatggatcaacgagattcccactgtccctatctactatctagcgaaaccacagccaagggaacgggcttggcaaatttagcggggaaagaagaccctgttgagcttgactctagtctgactttgtgaagaatcatgagaggtgtagcataagtgggagccgcaaggcgccagtgaaataccactactttcatcgattccttacttaatcggtaaaacgggagtgcgcccgaaagggtgtccattttggtgttaagtcgggccacccggtggcccggcgacccgcgccgatgacagtgtcaggcggggagtttgactggggcggtacatctgtcaaagcgtaacgcaggtgtcctaaggcgagctcagagaggacggaaacctctcgtagagcaaaaaggcaaatgcttacttgatcctgattttcagtacgaatacggaccgcgaaagcgtggcttatcgatccttttgaatgtgtaaagtttccagcaagaggtgtcagaaaagttaccacagggataactggcttgtggaggccaagcgtccatagcgacgtcgctttttgatccttcg

SEQ ID NO: 36039 - DNA, 963 bp, Heterodera glycines
aaatactttttcagaatggagttaggaatttttttctgattaatcgaaaatttccagattttctggaataacttttttattttggaagatagaaattagaaataaatcgcataaaattctcctatttttttggtatttttcaaactttattacactaaatttgatcaaaaatgaagaaagttatgaattttctaaatttcactggattttccggggctcaaattttgacgatttttcaaaaaatttttaccaccttccaaaaaatctgaaacgcaaaataaagcgtatatacgtattcagcaccaaaaattaggccataaaaatgcattttggctaatttaggagcaaaaaaattttcatgaaatgcaaaaccatggggtcccccctttggttttgagtttcaaaatcacaattaattttataactttttttaaattcaagataaaaacatgagataaagcacattatattgggctttaaattctctacaaaaaagctcttagacaattttttgataaaatcaactcctgacgagttattgagccagaactgaaattgaggcctagcaaccaaaattttctatttccaaaaaaattttaaaaaatttttctgaaaatgacaccaatcgatagagcgcgaaaaacggttgcttgaaagtggtcttggttttcccgagaaaaatctgcaaaaaataataaaattcaaaaacggaaaattttcgagggggcctagctcgaaaatttctgaaaattttcaaaatccgaaaacatggatggatgcagctcgtcgagctgcacaaaaaagtaattatcagcatcccgctcagatcaaaacacagcgagttattcgcgaaattcaaaaaatgccaaaatggttttcaaaattgccgagtggacagggcaggctttgatccaaggctttcggcaagaaaaaaaaaatttcccaaaattccaattagggccc

SEQ ID NO: 36040 - DNA, 795 bp, Heterodera glycines
  misc_feature (773)..(773): n is a, c, g, or t
cggtcaacacgggcgtgtccaggaaggaggaacgactcaatgcacgaggcaatcccctggggaggaaatgagggaatgatcagtggacgaatatgacaaatggagggtcattaatagtcaaattagggaaggggggtaaattgaggtaaccaacaagggaatagccgcaatttgtttggctttagaattttttttacggattattgatttaaaaaaaggaattggtgagaggaagttttgggtatttaaaactcgattatgttttttttgctatcttttgctatcatccgtcctttgttgacatttttaaatttgaaaattaggcccagaacggaaaatgccgaaatagtgaaacggggacggtgggggaattgatccaaaacaagaaagaagaattattggcccagaaagctttgtaagaaaaaaagtcacgttgcgtcaccaccgccgagggagggaaaaacggtgggaaaatgagataaaaaagtgattattattatcggaatgacatttccaatcaatggatgaagatgatgatgtgatgatgggatggatgggtaaggcgatatttgtcgtcgtcgtcgtcgccgcggggggcggcggacaaacgacggaaaacggaaagaaaatgcattctcgtgaacggcgggcggcggaagagcagccaaggcaaagcaaagcacccactcaaaacggggggggggggggggacggggcaacacaacagcagcaacagatgtgtgtgatgggatgggatgggatgggcgaattgngagccgaagtgggggggggggg

SEQ ID NO: 36041 - DNA, 877 bp, Heterodera glycines
tttcctggggcctattcaaattagcatcgtatcaacgatgcgatgatacgatgatcatatgcgtgttcaaattaaagactttcgccatatgatgagctgtcgtttgcagctcatcatacgatgagatcgtacgatgatccaatcgtacgttctcatcatacgatcgtatggctgttcaaattaattttatggataagatgtgatgatatgatacgatgaatgcatacgatgtttaccacaaatcattttatgaatatttccattggcaattttaaaataattttaaattcgacaaaaatttaataaaaataattacttttaatattcgctgttattttctccaaataatttatacaaacctaataaggtagctgctgatcctttttttgtgtttgtttttgtttaaaagaagtgttaatatgagacgaaataactcatgtgatgatgtgatggaaatgaaacaaatatttttattcaacgccagagtcagcagcagttagtaacattctcagcagcagaaatattccaaattttttctatcaacagcgggcaatgcaaataaactatcttttgcccatttacacccaatttatttaaaatttttgtagataaaatgaataaagccgaaaaaaaatttgcgaattcttatgaaatgattgggagagtttttcaattatttaaaactgttaataatatttgatttgtaaatcagcggcattaacaacagtcactacaagaagcagcagttaattagttttcaaattaaaggaaaaatgcgttcttttgaatgttttatgtttttaataatttgactggcttttattggtactaaaaatttaaaatttatatgaaaaaatagctgagactttaatctata

SEQ ID NO: 36042 - DNA, 924 bp, Heterodera glycines
agaaaaatggctctcttttttgcgagaaattttgtaccatacaaatgttcccagcgtgggcagaggggcgcggagagcaatggccattctattctacagggaatttttaaatttattctctatgccagaaaaatggctctcttttttgcgagaaattttgtaccatacaaatgttcccagcgtgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcgtgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctctcttttttgcgagaaattttgtaccatacaaatgttcccagcatggcagaggggcgcggagagcaatgtccattctattctacagggaatttttatatttattctctatgccagaaaaatggctatctcttttttgcgagaaatttt

SEQ ID NO: 36043 - DNA, 851 bp, Heterodera glycines
gatgcccgagccgggggcccggtgcggcggtgtggggggaattggaagtatgcatattacaaatgcaacatctacaacgtacacttattatgtgtgtgttattaacggctgacaattccaatcgtaagttaaaacattgggcattcattttttgaggattgtatgaacattgtttttggttttaaccggattccgttggcggcaaaaacggaagacaattggttagggaaagactcaagggggcgaacggcccaccgttagcaatcaagaattcaaattaccacccccccccgcactcgcaaaacctgcctaatccaaatccaacgttgatgctatcattcgaacattctttccacgcattattacccatacaaaaagcaaaaagattttttggcttctgaaaaagaaacattgaaaaaatctcaaaatttcgactttttcacaattttcatgtatgacttttttggtattgtgtgaataatttttaattttgtggatgaaatcattattaattttgaaaatttttcgttggaattcgagttgtctcaacaacccctttgccgcttttttaaaagcatttgtatttgtgaggcgccaacaaataaaacaaaaaacaaacaaagtgtaaaaacaaaatcgacgcacaaagtgaaataacggttgtgaacaaaatgggcaaaatgatatgatgatgaattctaattttctaagcgcttctcttcacacacattttttgatcaccgccaccaccggcggccgccactccgttacgttttctccccgtcgttcgtctcgtcctccatcgtcatggcgtcgaaaaccaatatttcttcttcgcaacggctcccctc

SEQ ID NO: 36044 - DNA, 1309 bp, Heterodera glycines
  misc_feature (80)..(80): n is a, c, g, or t
  misc_feature (82)..(82): n is a, c, g, or t
  misc_feature (89)..(89): n is a, c, g, or t
  misc_feature (145)..(146): n is a, c, g, or t
  misc_feature (148)..(149): n is a, c, g, or t
  misc_feature (159)..(159): n is a, c, g, or t
  misc_feature (163)..(163): n is a, c, g, or t
  misc_feature (168)..(169): n is a, c, g, or t
  misc_feature (175)..(175): n is a, c, g, or t
  misc_feature (179)..(179): n is a, c, g, or t
  misc_feature (187)..(187): n is a, c, g, or t
  misc_feature (191)..(192): n is a, c, g, or t
cttcactcggtttcgcccaatgtgcttttgtccgacatatttccgctggtttctcatcggagggatgcgtccggtaattngngcgatgngaaaggggcacttttttgataattcatttacttagtatgtgaactgtcaaattccnnanntatccctctncccnatctnnttcagntggngctttccntttnntgcttttgataaacgcaggttttggacaattccgccccttgtcggtttgttattttggggcattaaagggggaaaaaaaagcaaacgaattggaaaaaaaaaatccaaaaagcaaaaacccggttttccttttttacgaaaatataaaacagaaaacccgggttttttggaatttaccttttaaaaaacccccttattggtttttgctttttttttttaaaaaaaacctttaaaagggggggtatttttttttttttaaaaaagggggttttttccttttttaaaaaattaaaacaaaaaatttaaaaaagggggccaaaaaacggggggggggtgtgggggggaaattttttttggggggggggaaaaaaaaaataattttccgccccccaaaaaaaaggggggggtttttttggggggggaatatttttaaaaaagggggttttttttagaagaagtggggggaggaagagaaaatatttttttttttttaaagaaatttttttcccaacaaagagaaaaaaagggggggggggccccccaaaaaaagggggggggggggggagaaaaaattcctccccggcggggggattttttttttttcttcaaaaaaacaaaaaaaaaaaaaaaaggaggggcgcccccccacaaatttttttttttttttaaaaaaaaaaaaaaaaaaaaaaaaaaaaaccccctttttttttgtgtgggggaacaatatttgtggtggggggggggggccccccccccccccccccccccccccccccccccccccttcttctttttttaaaaaaaaaaaagaaaaaaacacacccccctttttttttttttttttttttcccccccccccccccccccccccccccttttttcttttttttttttttcttttctccccctctcttcctccttttttttttttttttttttttgacttttttggggagggaaaaaaaagaaaaaaacaaccccccccaccccccccccccccccccccccgcgcgggggggggggggggggggggggtggggggggtttttttcttcccccccccccccccccccccccacccaacaaaaaaaaaaaaaaaaaaaaaaaaaaaaaaaaa

SEQ ID NO: 36045 - DNA, 523 bp, Heterodera glycines
taaaagacaatacgccaaactcacatcggcaaatgtttgtcctccatcacccccaaacggtacacaaattgataatccagctcatcaattcgaatttgaacatcgttagccctgaaaaacgtgaaaagaaatcaagtgtatatttttaagccatgccttcgaaaaaaatttttttctaatttaaacacgtttagaagaaatagtaatttttaaaacaaagtctttcttccaacaaattctaaaaaaaatcttatgaattttttttatgacgaactactgtttttcaaaaaattcaagaaatccctgaaacggacgaccccctcataaaaaaaaaacaaatgatggtgttttttgtccaccactcaccagccaagcactttggcacctccaaaaatcggcacataaattgtctcgcaattggaacggtcaatgttgcccaaaaggttggccttccgcgcgaaagattcagaaatgaatgaggtggcacaacctgtaaaatagcggggaaaatcaaaaaaaacag

SEQ ID NO: 36046 - DNA, 1578 bp, Heterodera glycines
  misc_feature (1200)..(1200): n is a, c, g, or t
attaaatgtaattaaacaaatccaaatgcaatttgatttaattaacacgccctccgccgtttgggaacgggaaaggcaaacgaattccccccccccccctcaattcattaacaagtggcaaggattcgtgactaaatatgcttaaaatatgtattgtataatatttgaaaagcgcatataaaaggctgaatccctccttctcattgtttaattgatggcattcctcattattaattaattaattaattaattaactgaatcacatttattatttatttaaaattctatttcttattcgagcatttgctttatgaaaaaatatgcccattttagtgttctgttgagctctctatctctccattttagtgtaacatcacaacactttgtggataacaaatcatttcaaaatatttttcaaacctttgaatttaaatttacataataaatcgatcgccccccacaaggacatttggctgccaatcgctgcgctttttgttgggatgggacggtcgatttgcttcattctcaagcgggggggctcccccccccccttctcccgcttcatttgttccccgtccccgcacggttcgttcgatttcggcccgtccctccgccattcctttgccttctttttctccattcatttttcactatttttgcctccttttcaccttccgacaatcgtcgtccgttcgtccttcatcgtctcccccattttttcaattttgacaaatttggctgtacatggacagagagaccgtctcatcaacaaaaatcaacccattttcacatcgtttcccgttaaaactttccctcaaattctaaaatttcgaagacaactccaaaattttcttaatttttggggcattttcattaatttaaactttatgtataattgccttttataaaccaatcattgagtttttgatgccaaaattagagtttactgaagtagaactcggccaacaaattttttttaaatcgaaggaacataaatttgaaaaatttgaataaattaaataattgttaaaattccaaaagaagatggactaacttcgtaattgtacaaatttaaataaataaggaagggtccctgtgagctttctgatttaaaaagcacatttaaattaattcctctgtccattcattccgtcccccgtttcgttttgcccctccccgttttctgtcccctcccccccnccccccctccgatggtttgcttttcagcagcagttggcaatcgccattttccagtttatgatgcttcttcttcgtgttggttgggctgtgtgtcatcacttctgggaaagtgtcgttcattttgtactgtttgaggggggggggggggataataaagtaataaaaatgcataattatttttgtttttatgaaattgaaataactttttttttctacatttatcatcagcatttttcttctgcttttccgtccgcttttttgttttttcttcacgaatcagagaactgtttttccgccattatctctccgcttcatctccgccatcccccgggggcactgactgtccctattttcatggacatttcaaaaaatgaacgg

SEQ ID NO: 36047 - DNA, 1233 bp, Heterodera glycines
attacggcgcctccagcgcaactaaaaagtccgacagcatttcaactcaaacctcaacagccttctaaacctcaagctccgccgtcaggctctccaccccgttttgaagaaacagaacatcaacagccaccaccaccaccaccaccaacatcagcagctcaaatagatccatcgcgtttgattcacacgctcgacccaccaaaaatattttttagaactcctccagctaatcaaaaccctctgacatatgtgcccaattcagtgtttattctgtatgaaaccaatatggaacgattcaaggtggtgttcaatgaggagatcatcagccatttgtccttctcaccacagctcgggtatgtgcttggctttgaaaaccctcagcatgtggtgtcaaatgaagttgccaaatatgggtttgatctacgaggtggcatatcaagttttgcagtctactcaaaaggactaactgaaaatatgataattggcaattcattgagctccttgctccgggttgtgtctatcagcggtgctatccccggggagtataatgagaagatttacgactcgccaatatttgcgcgagtgttgccacgtgagatcaacgagattgagattgaactgcgcacaatggacaaaggtcgtctcgtgccattcgcctatgggacaacgatggctgtgttgatatttaagaaagtgataaatttttgatttcattcattttgtgttttatttgtcatacgttaataaaatggttcatattgtgtttgacccaagcattgcgcagtacgacgagtctgtgcagtacggtagcggattagaaaaggacgattttgactacttcagggggtcaagcccctttcagagggggtacggtattcaacgaggggcgggcgttggagatgtgtttcgtggactgtggcgctttttcctacccattcttcgccgcgttggcaccacggtagggtcggaggcgctaagcactgggcaacgcgtgctggagcgagtcgggaatgagggggtgccgtttaaagaggcgcttgtcggtgagggaaagcgaggaattgataccgtacttgacgaaggaggactaccgaaacggtttggaagcggaaaacggagtataaaaagaaagagaacacatctacctagtcatcagacactaattggacgaccttttgtaaaacaggcaaaaaagcgtattcgatcggacgcttttggactttattaattaaa

SEQ ID NO: 36048 - DNA, 1041 bp, Heterodera glycines
gaccaattcatacaaattgcaacttttttgtcatccgatcgcctttacgggttaggcgagaatacgcaccacgaattaaaggtaattacagtacgcacccgaattttaaaactaactacagtacgcaacaaacatatttcgaccaatgaaattaaatagttaaataaaatatgggttataataataatttttaaatttgaaatttagcatcgatttttccatctataaaacgtggagtgcattttcacgcgatcaaggaaatgaatattatgtaccgggctcatacaatggatacggtaatgtttttttttgtaaatttcttgaatctacaaaatttaggggtacatcccttttacgttggtttggagccaagcggaaaagcccatggtgttctgattttgaattcaaatgcacaagaatatgtcactgggccgggaccgcattttgtttacaggtgttttttttgtaattatgaaaaaatattttctgttttttgaattgcctttttcaataaaatttggaaaaattgattaacattaagaaaacatgaattattttggctgacattatatgtattattaaggaaatgccgattttctattctcctgttcattgagttaggcacgaaaaaaatacaaaatatgcacattaatttttaaaacattttttaaaacaaatttttttaatgaatatttttttttgcaatagaattgaaaaaaaaatctgtctttaaaaatttatgccaattttcatttttgtgcctatttaattccctatcgcgcggtatccgtgttcatccctgccttataaattatttatttaattgatttcctttaaaatatcttttttagaaaaattaaaaaatttacaacaaaggaaaactatctataaatttgcttagttttttttagcactatattatttttattaattgattttttagaacaatcggtggccaacttgagctgttcttttttcccggcccaacggcggaggaagtgatacgccaataccagcaaattatcggcacgcccctatttg

SEQ ID NO: 36049 - DNA, 1100 bp, Heterodera glycines
  misc_feature (43)..(44): n is a, c, g, or t
gggcttttaaactttaaaaacaccgtcctcttctggtccccannttttttgggaaaaatcctaaccgatttgccggcgaaattaggctttaaaagcagaatctgagcttcgagctttgggcaatcaaaaaaaaaatttacctttaaagatttgtgggtttgggaaaaatttatttaacttgaaagtttggtcaattttttaaaatcacttctcacaaaaaagcattaaattaaaggatttaaaacccttttaatacgaaataaaggttgggcaaaattgtagacctgtgagggaaccgaaccctcgacgggggtgcagccagcgatcagcttctcacccaaaccagtgctctcttaccgtctgagcggatccggacatttggacagaagcggacaattggacactgatgtattatgacagtgaatggaattttttaattattttaaattgtttttacattgaattaaaatttttagattataggtatattgaattttcttaaatacgaacatgtaataaaatagctaaatgattgagtgtttcgtgactttaaaagtgctttttgcattttgctatttgatgcggctttattaatcaacaaatgtttgcgcatccaccagcagcagaattattttcattcagctttaagcgatccgactactgtagagactctcgggactgtagtcggaactacggtaagacgcgcgaaagaaggcactgtagaaacggtcgttttgcaaatggtaatgattcgggaaggaataagtgccggtgcgagtgaaatatggcgaggaataattggggccaaattcgggaaaagggccaaaaagacacttttctggattttttagaaaataaaaattcatataactaaaaattttgcagttttgacaacagattctaggttaggccctaaaattaagaaaaaggtttggtttgtcggaagggaccatgacatttttagggggttcggcaaagcagaagagtaccagttttaatttctcttttcaaggacagataaagctaaaacatatttccgtttcaaaatttcacacatgggaagcatttgtcaactgaacaaattgggggattaacgaaaa

SEQ ID NO: 36050 - DNA, 1679 bp, Heterodera glycines
  misc_feature (10)..(10): n is a, c, g, or t
cgcgggggtncattcatgttcacgccacaatatccaatgtgggttatggaaaagcatcatttctatgacaattaagcttctattattggaattttttaccgattttccggaaaaaatgttttttcgaaaatttttgacataaatgatccaactttcggtgatttttaggaccaaattacgagtttcacttatcgaaagaatttttttgtaggcgacgcattacaaaaattgccattttttttggcgaagatttttttataccattagcaagatttttggtactttataagttcatgggaatgaacttttatttgtggtttttgcgaattttttaggaaattctgtgcacaaaatttttaaattcaaattgattttgccttaagaggaaagaaaatgttttccatttttaaggtatacggaatcgccatcacggctgcctcagcaattggaagcgaccaaagagacagtggccgaattggcgccagccgaccatcaattaccgccaaatgggacagcaattgtcagcgatgatggtggcggcattgtggtgccaaccgtgtccgaactcaccgaaacaacagtcacaacaaccaccgtacaccacacgcaacaacggcatgcggtagagacgacggaacaacaacagcaattagtgcccaacggtgcaaagccgtaccagcaccaacagcagcatcaacaggaggaaaacgaacaaaatcacgatgagcgtcaacagcaacaacaacagcctactgtattgacagatggtgagtgaatttgcatttaatgcatggtactgtaaagccataaattttgagatgttctaattgagaaattttaaattatacaattttgcgacctgaattttttttattttattttgtcaaatacaattttgcttgaatttcatttgaaatttttccgataatttttttcttaaatttaactgttaaatgtaattagaataatttttttttaatttaaatatattatacaaaaaactttttgtagaaatgcctcaacacaatgcgatcactcaaaatgggcatgcagaaccagcattaaatggagaactaaatggcgacatgcatcatccaaatgaacaggcacaaatatttttaaaaacccatacatattaaccaaaagtttaaattttctcgcaggaacatcacattctcgaggaaacgtatgagattgtcgagaatgaggacggcacaaagacaacaattcacaagagcatagaacggaattttcccataaatgacggaccaacagcggaggatgaggaggaggacaagacggatcagcaacaacagttgctgcacaatcaacagatggacgcatcaatgagtggataaacatgacatatttaatgatcattttctattaaaaaacccattctattgataagtttttggtgactttccgagcatcactttttcggcacgacattttttggatgttttgatttgaagatgatcaaattggaatgagttttgactgaatttttttcgatcaaaacgaatcagtaaagttcatttgatctaaaaaaattcgtctattttattagcatttgtcatttatatataagtattaccagatttatcacaattatatattgaattcattcattttcttgaactttcagttcatgtttggccttatacattaatctataa

SEQ ID NO: 36051 - DNA, 1046 bp, Heterodera glycines
gcgaacaccgtaagcacaaaagggggcgttgtgccaaggatgcaaattgcgtacagttgcattcgttcgcgcgaataattgtccaatgacggagaaaatgatggtggtaccacccgaagctgatcgttttcttgctgattttgttgatgaggtgtatcatgttgatgaccatttacagatacagtagcagttgtacggccaaacactgtcaaatttgacggataaggtcaaataaaaaacttgttcattcttagccaatttatcttttttttgcctccaaactgatatttctagattaacctggattcaaaccaaggttttttttttgatcgagagattatagtaaaaccatttcctggtttcgaatattccttttcaaattcataattcgaaactttttctgtctttcgatttccaataccttccagcacttttttgacaattagccaaataaaacaaattgcgtataatacggttggagtgtatgaagtcgttgtgagatttattaagttgactgcatcaattaatttaaaatgcaaattgttctccttaataggcgtcataaaaatgtattccaaataaataaataattatataaattgttttttatacctttattatagctggaggatatatggagactaatgagtaaatgcatgagtaaatacgcaaattcggcttccaattgacgaccactgaaaagacaatgccacaaaaccagcacatggcaaggcacagtctcgtaaagctattaacaaattgctttggtatttaagggacaaaggcactaattaggcaacccaccgtatggtaaagagatgacaatagaaaattggggccattattgcgatgatcctatttaatgctaacaaattataagcaacagcaaccgccatggcacaaatttggtacataatggcatccaaatcaagcggcaccgcaattcggtggccgacaaaatagccacacatagagctccatagtccaaaacataatcaaaatgtgcatgatattctgaaaaaataaacaattaaatataaatgcaa

SEQ ID NO: 36052 - DNA, 763 bp, Heterodera glycines
aatttattaaatagtatgcaatacgttccatgttaaaaaatcaattctgcataaaaaaaaattatgcaaaaaaaagtgaaaaaattttcaaaagagggcttctttaaactagcgcccaaaagttttaaattactcaatccaaagatccctaaaacgaattttggtgggcagcggacggtccggcaacggaaattccacaaaattgccatcgatccgttcagacagtttcggtgttggtccttcgtcctttttaattgatatttctttccaaattgtcaattccgtttttccatcgaaatgcgcgtccaccaaaacatcgaaacggtcggaaagcaatgccattttgaggccgagctgagcatggtcaaaagatggcagaatgtccatccacacgtcgctacaaatccaactgaaatgcgaacgtaaaactaattataaaaacaaaacaaaatggggagggagcaaatttttaaaaattttcaaatcaaaagccgaataactcgactcgtagagacaaatctctgattttttgacattacgagttggaaaaattagtaagagttggtgtaacagtacgagttgggtttttaccaaaaaaaagccctccttcaccccttgtgatttttttttctcgtaagggctcatgaaaatgcaaaagtgccgaaaaacatttcattttaaaatttctcacatttttttccttaaacgtcggttcattttgcggtaattagcagcacacaattattgtcgtaagttgtgattg

SEQ ID NO: 36053 - DNA, 1597 bp, Heterodera glycines
gaatttttaaaaaagcgtgtcacaaaaaaatgtggcgtgaaaggcaaaaaaagaggggtcatagccggggacggtgctccctccaagccgaaattctgggactgtccctggaatgacccagcaggtcgggagtcccgactcgaggcggaattataatttccaatttaaatttggattaaaaaagtaaattaattaaaagcaaaattttcaatcaactcttattctctcatataacgcgtgaccaatgttggtgtgggggcagagacgagataattacgtgggaaaagagtgtgtgtttgagagagactgtcgagagcagtgggaggaatgagaaatagttcatcattttctcttgtttccctttcccgttttgtaccccagtgcaaattatgcattaaaaattgctgcttctatttaagcaaattggctaacaccaagcaaatgtgggcgatttcacgggtcgacgccgtttctcgccacaacggtgcggcatgaaaggcgccgtcgaatcaagacggcaaaaggccgaaaaaatgtgccggcgggggaattcccgcgatgcctggccaaggcacaacgccaatgggcgattgcaaacggtcggagtgggcaagagaaatcgtcgctttttaaaccgggaaatcccggtatgttctcgtttaaatttggtagggacaggcttcaattttttaaaaacggtcaaaaacaaaagttgcttcatcataatggtttttcaatttttgacccttttgaggcgctttttcaaaaaattttttaacaattttgaatcgaaatttttcagaaaaatactattttccattaaaaaaattttgggttttgaggagtcttaggggtgagcagtaaaaagagaaaaataacaaaggtgtggtgcacccaaaattggcgttttgtttacggattttttaccaaaaaaaaaaatggcgtcatcgggaaaattcgtttctatttgtagaaggattgtccacataaattatagcaactattttgcggatttttttcgtattttaattagatttatgaattttcaaatagtgccgccctgccgttttttatttgttttgttgtgcaaattttgaccgatttccatgaaaatttacaccacccattcattcatcgccaccacctgcaggatgggtcggtgcggaagccgcatttgtggaaaaatgccagggaagggccattgaaggcgaacacggtggccatcaacagttccatctgtgtactgtacaaggaggggggggggatttaaaaaaaaaagattaatgcactataatagggaccaaataagtgaaaaaatgcatgaaaaggcacgaaaatcccgaaaaaggcataaaaataggcatttaaatttttttgattttttttacccttccgccaatcgttccaactgttcaatgagtcgtgctccgatgcccttctgctgatagtccggctccacctggatctcgtagcagtacagcacgggtcggccttcgtcctccacaaatctgcgatttttgaatttgtttttctatttttcttaaaaggaaatgaaaattaaatgttcgggagacaatcattttttttagactttcaa

SEQ ID NO: 36054 - DNA, 714 bp, Heterodera glycines
taattgatcaggggctcaccaaattttgcagggatacgtatcaggaacactacaaatgcttactaattttcctagattttttaaacccggtgaaaattttttgcagacaccaccacttttgcacttaaaaaaatttgaaaaaactttaaaaattcatagaaaatttaaattcataggtactactgctaaatcaacgctgagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtact

SEQ ID NO: 36055 - DNA, 866 bp, Heterodera glycines
tttaagtcatttttgaagggatttttcccttttggcagagttgagatgtccggtactccttttggcacttttatgagtctctcgattgggactttgattggttctgcctcctttttatcgattggcaccaattttgcggaagaatcaccaatttcagtgatcaaatacggaccaaaatttgaccaaagaagctttttgtggggagaacgacggtgcattcctgggaagattaccataactctttcaccagtagcaaatttttttgacgtgactttaggcagcgaatcgaaccaaagtttgctttcttttctggctgcttccgaatttgctcgtgcttcttccaacatattcaggaggttttcccggaaaagttggatgtagctttcacaatccacagtgtaaattgggtttttagggaaaatttctatgttttccgctgggaatcgggctggtcttccaaacataagtgaaaatggagaaaatcctgtcgagttggacggagttatgttgtaggcaaacactgcatatgccaaacgttcgtcccaagtccaattacttgccgtggattttttcaaaattttaatgagaattccattcactctttcagccaatccattcgcctgggggtcataaccagcagtgaatgaccttttaatgtctaacattttcgaaacttcagccaatgtcgaattcatgaattctttccctcggtcagaatggaactgtttcggggtgccataaaccaaaaccaatttttcaacaacaattttagcaactgaatctgctgattttttgagaattggctccgcaatcaagtatctgctgaagtggtcgacagttacgcagatgtacttaggatttgactg

SEQ ID NO: 36056 - DNA, 763 bp, Heterodera glycines
caacaattttttaatgtaaatcaataacatatgtacaagtatttagtgattttggcgttttcatataaatttatcaaactgattttggcattttcataagccgggcttgatcaaattgattttggcattttcatagaaatttaatttacattgcggcgatcaagggcagcctggcggcggtcaaagtgtgccaaattgggcactaattagggctatttatattaagtaattctcttaataagttatattaaaatttccaaacaattttctctgcggtgcctaacggcatcgccgtttcgggatttctaaaaatatacaccacctaaattttattttttaattcagcccccccccccccccgaagcagggctggacatatgatggataatgagggacactgtaggaagatatgtatttaaggcagaattattttaaaaattgcagaaatttaatcaaaatgaattggacatggtgattcatgagtttgagaattattagttgttttttttacaaatttcttttgtgctctaaaggaattgatgatgatcgacaaagcgatggttatccaagccaaaacgaaggtgaacttataaaaaaataaaatgaaataatttaataattaaattaatttaatttacgcattttaattttaatagtgcctcgaggcgacgacactgcacatgaccgccggtggtggtcacgaaaaaaattgtgaaaattcttttggaaaatggtgtcaacccggaggatgagaatgctgttg

SEQ ID NO: 36057 - DNA, 847 bp, Heterodera glycines
taaattaacagatattttttcaaaattcaatcagtcgaacttttttggatgaagtgagctaagttatgcatttatatatataattttttgttttcggacacattggcggatttaagaaacgctacagcacaccctcccttcacatggatattgtctaattacagtagtaatttgcactttctccctctcacttggacattgggtaatactgtgctttgtcccccccccttttttcgaaaaattttttatgttaccaaaagtcatgaaaacatgtttcgaagtcgggtctagaattcggaattgtcccaaaagaatgccggattcatgatcagcaactccgaaaaccttggaaacatgatttcatgacttttggaaacataaaaattttttcaaaaaaagggggataaagcacagtattaccggacattgaactacagtagtaattttcaccccctcctcctcacttgaacattgtattctccgcctctgcccggcctggctgcatccgctgaaatcttttcccacattttcttcccacaatttttgttgttctggtaaagtttgtaattggcggacacccacttttgagccaattcaaatgcttttcctttcattctaaatttttgtagttgttttttaaattaaattcatttccaaatattttttaaaacaataaaaaacttgctttttagtgcctgaccggcgcagaccctcaataagcatgtgttgtaaaggctgaagaaaattttgagattttttaaattcatgactaacactcatttggcatgaatactgtccaactttgtataaaaaaaatgtttaatatttttttattttcatgcttccc

SEQ ID NO: 36058 - DNA, 709 bp, Heterodera glycines
tttatttttgagggaatttttaaatttataccccaccccccggaaaatgtctatctctttttttgagaaatttctcccacaacaaaagcgcttgcgtatgagacggagggctgtgcacaatcgccattttatttcacagaggatttttatatttatactctatcccagaaaaatggctatctctttttttgagaaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaattttttaatttatactctatcccagaaaaatggctatctctttttttgagaaattttat

SEQ ID NO: 36059 - DNA, 979 bp, Heterodera glycines
attcaccgatcggatgctcaaccgattggcttttgacgaagtgatcaacgcgcgcataacactgccgctgaattatgtgctggacgaagagcgaaatttgttggccaaaatcaccaaatacaagttggccatgaaatagttggagggcatctttttggtgattatgcagacaaatcttcgacctgcccgtctcaatttccatccttcccgaccttttgccggcacttcttcggctgatggagcagcgtttctcgggccctctgaatttgatcagtccggaaccgatcagtctggccaaaatcctccgcctctacaaagaagtgatgattcattcatatttgatatgctccttaattcattcatttgtccttatttttgccagcatttcgacccgaatctgtcggattttgaggcgattacagccgaatcggagaagggaaaacagctgatggccaccaaagggaactgcgcactgagcaccgatctgttgacgaaactgtgccccgaggtgaagcgaagcagcgacgatttggtggccaatttcaaacggatgaaagagacgaaatgaaaggggggcaattaagaaaaacaaaaagacaatcgaattgggattggtaattatttatattcaaagtaaataaccaaggaaaaaatatattttaaatttcaatttttaattatttgaaataaaatagcggtcgctgcgaagaagaaaaaaactattagtcattcattattgtaatattcactacccaattgtccaattctgtccaaatgtccggtcgagtgacagacaaaattcaatttattattgcctttttttatcaagacacattgacatttgaattgaaaatctattgtacctgggacctgatcgggtacatattttatccggtgaatgatttgagctggtgcccatttttccggtgtccaccaattcgaacgataccccccccccccttcccccccctccccctca

SEQ ID NO: 36060 - DNA, 1259 bp, Heterodera glycines
  misc_feature (58)..(58): n is a, c, g, or t
  misc_feature (1117)..(1117): n is a, c, g, or t
  misc_feature (1190)..(1190): n is a, c, g, or t
aagatggaaaaattaaaaataaaacatggaatatgaaggaaatatgcaacacttttgntaagttttcaattttaaacgggcctgcttcggttgccataaaataatagtcaaaatttaaatcagtttaataacatcaaaatattttatataattccgagtaaatgagaaaaattcaattaataaaaatttgaaaaaaattataatcacccttacataataattattttttcatttcctttcttcattaatagggttcgaagttgtatgcactaaaaaatgccaaatatgcactgaaatatgccctaaaattttaacgtagaaatgaatataaaaattcgtcacttataatgttattttaaaaactaaaaattttaatcttcatttttgtcgtactattatacctaatcaaaaattttttgcaaatgatcagaaattataaataattgctcatttttgtagtccaaaaagcatttctatttggaaagaatatatttcagaaatgagaccaattgaaaaaatgcaaaaatttaatagatgagattaaagcagattaaaaattaattttataaatcaaaaaagttgactaataaatgatcttaaacaaaattaattaaattatttgtcgaaattttaagaactccaaatcagaaattaattgttaatttcgcttaaaaagaattccacaaataaggtacataaaattctttaagttttatttagtaaactaatatgcaaaaaaccctatcagttgttctaaatatttattatcgtttggttcaaaatttcaccattcgaaaattaataaaaaataaaaaagtgaaaaaacagaaaaatttaaaattgagaatatgtaatcttcttttactttgaaaagaaaattttcatttcgttgtgaagtggacatgataaaaactatggagaagaaattaaattttaaaagttaaatataaaaaacaagtggcctgcctacccaaacacaatttataaaattataataaataaatttttcttaaattcagtttctgttttatactaaatgtatttgctaatttatataattcatataatttataccacataaaaaaagaaaaaaagttaatttgtttggttttattanatatcctatcattttcttttagctgcttcatgataattatattctattaatattaagattactattttattanaaaatatattcatgaaaatgtataaattatagaaatttttcaaactggtaacatttatcaaaaaatttc

SEQ ID NO: 36061 - DNA, 393 bp, Heterodera glycines
caactgtcaaagtgtcggagaggggggggggtgggcacgacgacggacaaactgtcaaaagtgtcagggagggggggggggcacgacgacggacaaactgtcaaaagtgtcggggagggggaagaacgacggacaaactgtctaaagtgtcggggaggggaaagaacgatggacaaactgtcaaaagtgtcggggggaagaacaatggacaaactgtcaaaagtgtcggggagggggaagaacgacggacaaactgtctaaagtgtcggggagggggaagaacgatggacaaactgtcaaaagtgtcggggggaagaacaatggacaaactgtcaaaagtgtcgggggaagaacaatggacaaactgtcaaaagtgtcggagagggggggggg

SEQ ID NO: 36062 - DNA, 337 bp, Heterodera glycines
  misc_feature (271)..(271): n is a, c, g, or t
  misc_feature (315)..(317): n is a, c, g, or t
  misc_feature (323)..(323): n is a, c, g, or t
  misc_feature (331)..(331): n is a, c, g, or t
caacccaccaacatttcaatcactgggactcaacccaacagcattctaatcactgggactcaacccaccagcatttcaatcactgggactcaacccaccagcattccaatcactggcactcaacccaccagcatttcaatcactgggactcaattctcctgcatttcaatcactgggactcaatccaccaacattccaatcactgggactgcattccaatcaccaggactgaacccaccagcatttcaatcactgggactcaattctcctncatttcaatcactaccactcaaaccaccaccatttcaatcactnnnactcanccctccancattcc

SEQ ID NO: 36063 - DNA, 511 bp, Heterodera glycines
ccccttctgtctccccattcgcttcccgcctcccccgtttttttctccagttcatccatcttcttctacatcattcctctttttgtttataaaaatcacttcttttcttctcccttcctatcacttctgcctattccatttctccgtcctctttcacttcctcttccgccccatcgtccgtttcttcttcttccatctctctcccttttcttttccccttcatttcctcctacctctgttcttcctcttcctcctccaattccttttcatcctttcttcactcccccccccttttcagttgaacaacgttcttccgtcctctccctgtggatgatcgtcctcatcttctgttccgtcgcttttctctccttcttccttctgctcacccttttgtgctgtcgtcgacgcgttcaacaaaagatcaacgccactgtaaggcgatcagcgacagcgaacggaataatcaggccgacaaagaagaagctgaatctgaacgggggagtggtggtgg

SEQ ID NO: 36064 - DNA, 1298 bp, Heterodera glycines
  misc_feature (9)..(9): n is a, c, g, or t
taaataaanatttggtgcgtttcagaaccctttctgaaaatatatttatgaattaattatgcaaaaaacaaataaataatgaactctcttccttaataattttcctgcaccgaaggtactcactcggccgcttcgcggcctcgtggtgggccttcccccccgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattcccactgttccaagcaccccaccaaaagcaaaacgatataaccaaaatataaggaaaaatttttaaaaaaattttttctccctcccccttttttgaaaaaaaaagcatcaaagggcctaaactacatggtaaaaaaaatttgggggcctttaaagccactttctgaaaaaaattttatgaaaaaaaaaatccatttttcaaggggccgttggggggaccccaacaaattttggggggaaaaatcccaacccaaaattaaaaaaggggttatagggaagttttttccggaaggttttggccccccccaaaattgggggccactggtcggggggggcggccccaaaaaaaaaaaaaaaacatttttttatgggggccttttggggggcccccaaaattttggggggggaaaaaacccccccccaaaaaaaaaaagcgcggggttaaggggaaattttttctccagaggatggttcgccccaccaaaaaaattggggggcgaaagcggggggggggggggcgggccccaaaaaaaaaaaaaaaaaaaaattttttttttttgggggggggtgggggggggcgcccccacttttttttgggggggggagaacaacccccccccccacaaaaaaaaaaaaaaaaaaaacaaaaaggaggaaatatttcttccccccggggggggggggcccccccccccaccaaaaaataggggggggggggcggggggggggggggggggggcgggcccccccccccaaaaaaaaaaaaaaaaaaaaattaattttttttttttgtgtttggtgggaaaagaagcccccccccccccccccccccctccccccatcacaggggggggggggggggggggggccccgccccccccccaccccccc

SEQ ID NO: 36065 - DNA, 849 bp, Heterodera glycines
gccgtgggcaggtgccaaatcgtagcaggttaaagactgcaagaaaagaagggattcattcagctgcagaagaaggtgctttctatttgacccatcgctaattgcgttaattacccccccccgccaataattaaaaccgcgacagtaaatggttgctgtttacctgcaaaaaatggcgatatgcttcggaatggaagcgatctgtggggaaaatggagttttcgcggcaaagggacgaaaagcattacggaatgctccgaccacctcaaaccgatccacacttttgcgcaatatggcatagttctgcaaatggacaaaattaaccccacaaaaattcgaaatcttctcagccattcgtcacctacagtaattatacgtgtacggtatttttctcctcgtgtactgtattgtttacaatttcccccccccccccaattgtttctctccccaaacgcaccgcactgagcagtgaccgttccgggaaggagagtcgtcgtccgtccccgctgctcagtaccatcgcggacagtgcctcctccgccgccgccgctgccgcactgctcgccgaccgttcctccgccgagtgtctttggtggcccatcgacagtttgcgcagtgccctttggggacggcggtaaatttgcgggtggtggtgcgtctgcggatgctcactgcttctgacgccgttgccattggttgggaactgaaaaagggagcggcgatcattgatgctttgctaattggccaattagcaattagtctatcgataagtggctaattaattactcgcttgacttgttactttttgactaatttagttgacgggtccctttcccttacttttttttg

SEQ ID NO: 36066 - DNA, 1047 bp, Heterodera glycines
tattcaactgtggaaaattaaaaaaaccttttacgctcaggaaatttgcatcaattagagaaaaataaaaaacaaagaacatagagaagtaatggaacaaagcgagtaaatgatgctcactcatatgctgcgaaaattcttcctatttttgcaacaaaataaagaaatatttgctcaaaaatattagttactggaacgatataaataaaaatgctataatatgcaataaataaatatatttgtaataaagaaaaagtttgaaaaacaaacaacactgttatgacaatttatcaaaaagaatacgccaactttgtgaccatgtgccataaaatcggcaattcagttgatacattattatgtaatataattttaaaacatttaaactaatttagcttaatatttaacataatcgctaaatgaagctgcacgtttgtatgacttggtttgcgattaaaccaaccacaaatttataaccaataaaaacaaattttttcccatttaaaatgaaaatgaacaactagcgaaaataatcaacaagtttccaaaatcactattaagaaatcaaatttgtatgctaaaaattcacaaaaattaatccaaaaatcatatgtatttatgttttacaatatttattcacacaaagaaatgccaacaataattttctaatataaaacaaattcaacaaataattatagtaaattgcaagtgaaatcaaatcgtaaaatgttaagaattttatagcaagtcaaatcattcatacaaaatctatgaatggaccataccatcgccaggagataagaaaatttatagctttcatacatcaataacatgtagcttaattaaaaaagcagacaaaaaatttaaatgaagctaaaatgcattaattctataaattaaaagcagttttttgttagcctaattaataaaaatatatcttattactttacaattaacaaattaaaagtttatttcaaaatagcatcagaatggacgttatttaaaaatttcattattggtaaaaaataattttctagcaacatgttacaa

SEQ ID NO: 36067 - DNA, 866 bp, Heterodera glycines
tctgcccagaaattttccaatataattttttaagaataaagcgccgcaaattttccattatagcctttctccaaacaaaaatggtttcgcaatggtgtcaagtcaatacgaacttttgaaaccaaatattatggggtatattcacaatgtctcatcaatcacatttttttaaacgggggaaacgacggacgacccatgccgaataatataaaaaaaccacgtacggatgaaaactgatgggcgccacaagcacattgtccaccattttcatggcaatgccctcctccgccgttttcccgtcattcctccgccgtttcacatcccggcagccctcattttcgtcttccatttgttttcctccctcctcctcctccgtccattgaccatgcctggtggtggtggtggtgctgttgttgccgccgctagtgtccacatcccaaatgttgtaaatttgacggactgttgacgcagagacagtgagacgaccgcgcggatcaaattcctgacattttttacagggaaatcctgcggttgtcattgttgtaggaaacgcggaacaggacaaactttcgccgccaaataataagaaatttttaaactttcattaaagcaattttttgtgaaaaattttcaaacgatgagtaatataattctcataaaaaatttcgaaaaacgctgctattaaaatttttcaattttttcttgaaatctttaaaaaattttctaacaataaaattttttcttgaaatttccttttaaattttttccaatattttttttcttaaaaacttgcagtttgaaatttttttaaaaagaaatttcggtggcgaaattttggggtgtacccagctaatggcaggtattac

SEQ ID NO: 36068 - DNA, 833 bp, Heterodera glycines
gagttagagccatttttcgtggtttttcaaaaaaaattgggcaaagttgggggaacccggaacattttagaccagtttccaaaccaaacactcatagtaaaaatttattttgttggaattcggaggaataaatttgaaacgaaacactggttactaattggcatatatctctgggaaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcattt

SEQ ID NO: 36069 - DNA, 537 bp, Heterodera glycines
atattcattaaattaaattaatttttatattctagaaaaatgtttattcgaaatatgtaaaagtgttgtaatgtattcgttaaatatctgtatgtctaattattgcaagttttttgtgtatgtatgatatgggggctaattgttgtgacaatttatgaaccaattatttttgattgaagtgttttatatagggattttttatagtatgtgtgatgtttttaaaacttatgtgattaattatttcaaattaccgagaatgacttgtaatatttttattagttgtaaaagaattttaattaataatgagtcgtaaattattttttgtgtaatatagctaaaaatcaattaattatttcaaaggcggaacaatgtttggtgagatgcttttacaattatttagtatggttaagtattatgataaattactaagattttctggtagtgtatgtatggtatctgtattaattgtaattttagacctaattgttccttaattttttaccaattgaagattttatgcagaaagaagggttataa

SEQ ID NO: 36070 - DNA, 551 bp, Heterodera glycines
  misc_feature (463)..(463): n is a, c, g, or t
  misc_feature (474)..(474): n is a, c, g, or t
  misc_feature (485)..(485): n is a, c, g, or t
  misc_feature (492)..(492): n is a, c, g, or t
catcacaattttgcttagggggcacagaaatgggaatttctggtgatgtttgcttagtcttgttgcgatgaactcaaaaagaccgataacgttcaatttcgttacttctacgacaaatggcgaccagttgaatattcaggattttttggttcacaaaaacaggtactttcaccatttggtgaatagggcccagaaatgacaattcttggtgtttttggcttaatcccatcaagacgagcttaatggtaccaaatatatttagttctgcttactattggtcaaactgtgatcatgtcaaagttcggattttttcggattttcaccaaaattggtaccaatacaattttgcttagtgggcacagaaatgggaatttcttgtgtttttagcttagtcttgttgctatgaacttaaaaagaccgacaacgttcagtttcgttacttctacgacaaatggcgaccagntgaatattcangattttttggntcacaanaacaggtactttcaccatttggtgaatagggcccagaaatgacaattcttggtgttttt

SEQ ID NO: 36071 - DNA, 438 bp, Heterodera glycines
gcggaaatggacagcgggaggaaaagcgtcctaaaaaggggcaaataataattagtataatttgtaaatttgtaccaatttcgggtagcttttgtttggggcgagaaattgctttgtgacggcctccacttcagcgggatttctaaaaatgaaaaaattttgtcgatttggacactgtttatatgatgcatctaaaacgcaaaattcttctgatgaaatctaccggaatcagcggttacattagaatttacggctctaatgcactttatgagtccaatcgacttttatgagtccaatcgacctttatgagtccaatcaattgacaatcccgcgtttttatacaataactttgttcatgttcgaacaaaccctatctttttggtatcattcgaaagcgcaaagtctgaataatgtaataatacgagaaaacaagagaat

SEQ ID NO: 36072 - DNA, 261 bp, Heterodera glycines
tcaataaaattccaatgcctactttcttacatttctttgagaaaagtgtttaatggtgtacgaagaaaacgaaattggctgttgattgtctttccacacccttcagtactaatggcacattgtttgatttttagggtaattacaaaaaatcatcaatttatttgcctattttgctttttttgatacggcacaatcggtcccttcggcgacgccattttattatcttttagtgtaatttactgacggattgtccactgtccg

SEQ ID NO: 36073 - DNA, 798 bp, Heterodera glycines
atatgcagttaggcaaccattatttccaaaactatattcccatagctattataataaattttctaaacccatgctgatatatttttatatacctgatatccataaaaaatatatatgcagttaggcaaccattatttccaaaactatattcccatacctattataataatttttccaaacccatggtgatatatttttatattcctgatatccatcaaaaaatatatatgcagttaggcaaccattatttccaaaactatattcccatagctattataataaattttctaaacccatgctgatatatttttatattcctgatatccataaaaaatatatatgcagttaggcaaccattatttccaaaactatattcccataccctattattataatttttccaaacccatggtgatatatttttatattcctgatatccatcaaaaaatatatatgcagttaggcaaccattatttccaaaactatattcccatagctattataataaattttctaaacccatgctgatatatttttatattcctgatatccataaaaaatatatatgcaggtaggcaaccattatttccaaaactatatttccatacctattataataattttgcaaacccatggtgatatatttttatattcctgatatccatcaaaaaatatatatgcagttaggcaaccattattttccaaaactatattcccatagctattataataaatttttctaaacccattgctgatatatttttatatttcctgatatccataaaaaatatatatgca

SEQ ID NO: 36074 - DNA, 736 bp, Heterodera glycines
tgatgctgaattggaaagcgccgcctttgtaaaggcccacgttcggcttaaccgtcagctccatttcgttgcagcgccgacgttgaggggaaaatcaatttgcaagtgggcaaatcgcgaaggttctgttccaactctttggtctctgaaaaaacaacattaaatgggcaacgcttagaaagtgagttgtcgagtttctattaataataattgccttggctgagcaatttgtcccgaattgaaatgcgagtcgcgtggtaatcgcggtcctggtcaacgcccttacaacggtcttgcaggttaaacataatattgaatatcgaaccgggaggacaaagtggaattaaatggcaaaaggaaataaagcgactgacttttttgaaattgtaaaaattaatgaaattttacgaaatcaaaagtaatgagagaatatgaattatctaatcgtttataaatatatttaaaaatgtgggcaatcgtaaagaatggtggtccccaatttcacttttttttattttaggtttaaaatcagtttccggggtttttcgagggtgctgattacgaatttggtctcgaatttgcccaattccgaacctcggacccgaattcgaacaaaaaatttgaatttttttttcaaaatacgcattaaaatcgatctaatttggcgtaaattgcatgttttttatgcaattaatagatgaagcattatttgtaccaaaataaatagttattaaat

SEQ ID NO: 36075 - DNA, 416 bp, Heterodera glycines
tgaatttaccacaaaaaaataaaatgcagcatccgtcaaggggagtcgaacccatgacaaaaaaaaaaaaaaaaaaaattcagccgtgaaaactcgcaaaaaacagggcatgggttcgggcactaatggcgacggatggcgatatttgtttatttttttttcattccagggatgtgtcggcatgccgatttccgacattttttggctcggaattcctaatttttttgagtgcgtcggcacagacctgacccactcacaaaaaaaaatttgttttttttagtaaaaattgcatttttttttttgccgcccggtgccaccccccttggtgggttcgtttgttcgttacccatctattctatcggagcccaactcactggcaaatgttccaatcgccatagttggccgaactatggatc

SEQ ID NO: 36076 - DNA, 574 bp, Heterodera glycines
caccagcacggcagcaccgccggggacgaggcggacgggggcgggcagaatcagtccctggccagcgcggaatcggacagtttccgtcccgacctctgttaaggcagaggtttggcggtggacaaaatattacacctctttgcgagagggggaggggatgaaacaattttaaacggcccagggttaaaacatggacatggccgagttggcggcaacccatacatatatttgttggcactggaagaaaccagaaattggccgagactcgagaccaaggccctaggaacgtacggatttccgccccattgccagaaggaaattccgcttaaaatttgagctaaattttctgctttcagcaagaggggaaggggcaaggggttgtgcgcgcttccaaataacaacaacatatttattggtgggacaaaagcggcgtcccgccggccggcgggggatggaaccgcctgcgcaattcgcccgaccgacggcgccaccggtggcggtgctgactaacttgctcactaatgtgtgtttcagcctgatgatgatgatggtaatgatgatgctgatcagggat

SEQ ID NO: 36077 - DNA, 968 bp, Heterodera glycines
atgcaaagaaaaaaagaactgaacattatgggcagtctgcatatttaatcaacaaaagatacattgagaatatttaaattagtaattggactattcccaaggattataattctccaaaaaatcttataattaaattaattttttaaaggaaattaattaaagttgataaacgaccggaaataaattgagtgtccaaaagcaaaaaaacatctcggtcgtttacaaataatttctttcatttgtttatcagttaaaaaattaaaatccggtagaaaaataaaaaataaagtttcatccgcaatcaaagaataatcaaaaaaaatttccaatatccttttacgtatattaaatctaaattctacattgatgtaaaaaatttattttaaataattataaagatcatcaataaaattttgaataattcgaaaaacagaaattttcataatataattattcttttagtgtgtgtattgggctacgtatatatggtaataagccccaaaaatttttcgcattaatgtaattgcgcgaataaatataattggagaccgatggaaaatttacacttaaaactttaatgactatgatcacatttgtctaattcacgaaaggaagcgagctaaaaataaattaattcttttataaaaatctaatcagggtgcgagcgtactcttctgctcctgtaccgtaacagctatacaaattaaaaatatctgatgaaacaaacgcatttatttctaatagttttaaattttaaattgtaaaagaaaaaacattaaaaattttaaaaatataaattttaaaaatcatcaaagtccctactcgagatttgggtttttataaaaaaaatatttccgaatgttagataaaaaattattgaaattgattaaaattttcccaattcataattccccgaaaaaaataataaagatcaatggaaaatttacaaaaaatatatatattaaaaa

SEQ ID NO: 36078 - DNA, 969 bp, Heterodera glycines
gccgacaataaattgtcattgtgctgttcacgagatgcagtgggtcggatgattggatgacgaattgctcttcagctgacgttggtttttgacatcgttgagctaaaattaaatgaattttaaataattcaaaagaaagagtttacttatgcaggaatatgcggagagaagcgattggcgggagggaatgaccaattgcttaattaaccagaggcaaacagtttagtaatttagcttcctttttacactttctgttgcttttttgtcgtcgtacaaagtgtgagtgccctcggggcaaaggcactcaaaagggggaaaagcccccgggggatgggccgttcttttgcaagtgccagccgaacaaggccaaaggtcagcggagcataagtcaatttctaattgaaaataaaattaatatttattattatttattttttgacgttcccttttcatttaattcgcttttttgtcataaattttatttttgccattttttcttatttaaaagttggaccttcgcattgttggccaaaaatggcttttctgttgaaccgatatgttggcgttgtacaattgcatgtgtaagttccattcagcggaatacaaattccattgcttccgcacggattttcgtcaaattgttcgcataagttttcaactataatttatataattcgtttaatttatttttgggctttcatttgtaaaatctcacattggcatttaatcccttccgatgggattccgtcccattttgccatgccatttccatccaaaatgcattttggcaaagttttagtcgccatttttgcgccttgcacacaatcaatttctgcaaaattgcctagaggtgcccaaaaatgagaaaaattgcccatttccacactcatcgaataacagccgatttctataaataaattaattatatatatttaagaatggtttttaggtttgttcagaggcatgttt

SEQ ID NO: 36079 - DNA, 1283 bp, Heterodera glycines
  misc_feature (1148)..(1148): n is a, c, g, or t
  misc_feature (1224)..(1224): n is a, c, g, or t
  misc_feature (1253)..(1253): n is a, c, g, or t
  misc_feature (1259)..(1259): n is a, c, g, or t
  misc_feature (1274)..(1275): n is a, c, g, or t
aaaatacatcgattttgaacttcgccgtctaagcaccgattttccggttgtacgagaccaattaaggatttcatttgcaacgagatttgaaggcaaaactgctaattatttcattcgttctaaatatactttaagggtgcgaatacagcgaaaaattattaatcgcaacactgcttgaccctgcgtacaagggagcgtttttcaaagatgctgtcatttttgagcgtgccaaagacatgttgcttaatgaagcggaaagaattgccataaaatgtgttgaggtaacataacaaacaattttttattttgatttttactattaagtttgatacgagtgaattattagcgatgcctgaaattgaagcgtcggaagatccatttttggcttttggaaatcacacaacagaaaatgacaatagttttatgcttccaatcactccaacaccatcaccatcattagctagcgccaaggctatggcagctggggtgaatattttttgttttattttaaatattttttcatattttagcaagtggctgattatttaaatagccaaactgtcgactgtgaatcacacaatttttgggcaaatcaaattcaaacagccaaatatccattacttattccattagtcaaaaaatatcattcggctccatgtacatcagccgagagtgaacggatgttttctgcggctaaacttattgtgacagatttgagaaaaaatttagcaggagaaacgttgaaagaactcctttttcttcaacagaatttgcctctttatggatttaaattcgaaatttaattttttactatctggataaattttttggattaaaaaattgaaaaacttcgtgcttcgagcttcgaaagcttcgaaacttcgcggtttttgggcttcgaacttcgaacttcgtgcttcgaaaaaaattgggcttcgccttcggcttcgagtgccgagccgagcttcgcccgtccctggttctgatgtaaattttttacaaatgtgatcatagtcattaaagtttttaagtgtaattttttatatatatatttttttgtaaattttccattgatctttaattatatttttcgcggaattactgaatgcgaaaatttttaatcaatttcaattaattttttatcttanaattccgaaatattttttcttataaaacccaaatctcgagtagggactttaatgattttaaaatttatatttttanaattttaatgttttttcttttacaattanatttanaactattagaaatannatgcgttt

SEQ ID NO: 36080 - DNA, 1507 bp, Heterodera glycines
ctcatcatcctttcactcaaaacatctttgtttcctgcccgaaggcttgggatgtaccaaaggggaactcatttgacgagccccctgatgtagacattcgaagtcgttcagttcgtaataagatttttgttttattttgctaaaaaaaaaaaaatttatttggtaatcccattatgcattaattgagagggaagaaaaaaaaattaatgaatgatagcgggtaatcgaatggatgcgaacgccttccaggaatgggcttatctgctccatctccgtttaaacttcgcctaacaagaacaattaacaattctcaggcgccgcaaaaatgtgtaaagtgaatgatctcgcccaatgaaaaatgcggcggcacgtgattacgtgaatattcttatggcgtgaaaacgagagaaaacaaagagataaaatgaactttggaacttgtaaaaactgtaacttgatagggcctaattttcatttttattggtccctctttttaattagctaaaatagtgcccctttgattggttatcagcccgggcctttttgctctcctcaaaaaaaattgttctattttttttgtcccacttcttccctctctctctttttttttttttttgcttcacattcgttcaaatatttttataaattagtccttattcgtttgttaccaggactttttttttggctatttttggcttccttcactctctttccttattctctctctctcctacaaataattgtcaaatttgtcaattttcgatgcagtcagcccctttagcatttagactagcccgggcaaatttcgttcttctttttttgcatttttaaaatccctttagcttttcgctagcccggacaaatgatctcacctcttttctcttcgtcattaatgtccctttagttttctactagtccggacagatattctcacctcttctcttttaagtgtacctataatcttctactacacacgacggaattgtgatatgggaaagttcttaactagcgcgtacacttcatcagatgcggaaccgccatttttaaatgccaacccaatctaatttgcaacgaaataatgctttaaactgccattcgcacttttttatttgcctgtttttttcttcttgatatatggcacaatcggtcccttttggcgatggcattttattatctttttgtgtaggttactgaccgtgagaataacaactagtattaaatcccccatatcaaaattattatagcacttctacataagttattaaaaaaacttaaatttgatttttatatagaactgattaggaaataattataataccaattaatataattaatatttttaaaatataatattccatgaaaattatatttcaaatgttaaacaaagaaataataaatttctataaatttatagatagaaattattattattataatgatttctaaaaatgaacatttactataattcctgaagatgtttgaaaaccctttatatattaataaaaaa

SEQ ID NO: 36081 - DNA, 1336 bp, Heterodera glycines
ttatgaattcgaattttattgccagaattctcgctgaaactatcaagaaaacgcattcaaaaaccataatttatgtaggagtattcctttgagtaaaaaggtttcttacattgttagcttaaaaaataaaccaaagaaaatcacttcatatgggtgctgtaattttatgaagaaaaatgttccaaaaaaaatctttctttataaaaacctagcaaattcaggaaaaaattattcaaagcaaacctttgtttcttagaatggaactggaattttattactaaaaccctcgctgcaattttcaaggaaatctgctaaatacgaatacattcaacacgcatatttaaaaaatcatataataatctattttattatctttagagaaagagggtgtaaaaataaattttatagtaatgtttgaattttctacagaaaaaagttaagaaaacacaattgttcataaaagccaggccaaattaaaaaatagcaaacctttgtaaacctttacttctcttttctcgtttcacaagttattgccagaatcctcctgaggttgccaaggaaatgcatttgatttaccaaaatacgaccgtgttttctcaaaatgtatttcgtatttttttatttctttcttcagaacagaagtttaaatgataaattttttaaattttctgctagttattaaacataaaatattttaataaaaagaattatttaatgcaaaccctacttttcaacaagttctcttctaaaagtgtttcgtcctgtctgggattgagaaattataaccgaaattctgcaatgtcttttttaactattctttgtttttccgaaaaccatgacgggctacagccaacgtgttgttgcggaatgctgaaaagtttaaaataatttttttattgttggccgtctgatactgataaaaagtatttcttattattcgttgtcgcctgaatatcgtttttcttgtaaaagcatgctaatgaacgaaatttgttcgtttttattaatttaatgaagagattcatgttgtttaaggttcaaataacggctccgaaataaattttgtaataggactgtttttctcagaaagaaaaatgtgagaaaaaatgatttcgttagaaaggatcggctaatttagaaataaactactcaatgcaaacattcttttctcaattatgaattcgaattttattgccagaattctcgctgaaactatcaagaaaacgcattcaaaaaccataatttatgtaggagtattcctttgagtaaaaaggtttcttacattgttagcttaaaaagtaaaccaaagaaaatcacttcatatgggtgctgtaat

SEQ ID NO: 36082 - DNA, 791 bp, Heterodera glycines
atcacatttttgcccattttgtagcatcacactgtacgctttggtcattggcaatgtcccattttgggataaatatgtgatcggtaaagcaaaaaaggcataaatgggcattttttgatgcttaacattttaagcattgcacaaaaagaccaaaacacagaaaattgttttctcggaaagtgccgaaatcagtgaaaagctcaaagaattaattctcgggtaagcaaaaatgtttaaaattcaaaatccgtgccatttttacagaatgctaatgaaagaccccggcttgcgcttcgacatcactcaggtgaaatgccacaaaatataccctcttaattagtgccctctttttgaggggtttgaaaatataaacccctcgggctcccggaaaatgcgtcggttaaattttaaaaaagtactaaaagatccataaaatacaaccatactgtaattgggtttattgtaaatatgttctcctatattttgttcacatacctattgaactttacaatctcaatcatcacaatattctgtattttatttcgtttttctgtttcactgacgcatttttccgccgatcacacccctcgggcgattaatagggaaaacagaattataatttaatttaaaaatgacacgaagaaaataatatatatatatatatattttcagccatttggtggaggtgacggagcaggaagtgaccgagtccattcgcatgatgccgcacctcggcacgctgatcctcgtaaaagcgatgggccgcaaaaaacatttggcaatccgtaaaa

SEQ ID NO: 36083 - DNA, 1172 bp, Heterodera glycines
atatgcaaatgtgaaacttatatactgaactaaataacaaatgaaaagccatttttccgaaacagtacaaaacaagaaattttaaatttcataagatccgacacacccatattctttaacctaccaaaatattattacaataatcatttctcttaatactttttaattttattataaattaatttttaaatgaatattttgtgaatttttcaattatataatctatttttgtatttagcatagacaatattcattattccatttattttgatttttaaaaataacggccctgaactcggaggatcgtttgcgctttttaagccatttgaattaccttttatttaatagtagttcataattaataaataagtaaaatataaatccaaagactcaccaattataaaaaattgcttttatataatgcattctgtaaataattttttcttattttaattgtttgcttaatattcaagaataagctttaattactactgtctacgattaaactaaaaattagatgatgtcaaaaatagaaaaacgattaatttgtataagaatttgaaaatctatcctgaacacttaataaaactacggaagaaaaataaaattttgtaaatacttgggaattatgtcatataaaataattttttaactgaaaaattttaaaacataaattattttaatgataaaataattcataaacaatgcatgataagagacaattgttctatttctaggcttcaattctctatgtctgttctcgatgattttttcaaattaaataaaatgtaatatagcaatttaatatttgtttttaacatacgttcctctaatggttgcctttgtacgaggtaccttttgtacgagttaccatgacacaatttttttattagattttacaaaaattcgttttcttcaaatatttcacttttatcgtttattatgtttgtattaattaatatatttgtttaataattatcaaatgttttgcatgtggtaattttgtatattatttattgattttgtactattttaaacgattttaatatcgatattactttaatgaagtgagaaatatctaaaatcattttactttttgctaaggtttgaattaacggatcgtctagcaaaattcaacaaaagccaggtaggctcgacaagttcttcaaaag

SEQ ID NO: 36084 - DNA, 138 bp, Heterodera glycines
taggcaaaatttacgcaacaaacaggcagtgcctactttctctgggattcaccccactcaccacgcactgtatatttgggaaaagaaaaagatgtgggaaactaatggaaaaatagtagaaaaaattaaatataggag

SEQ ID NO: 36085 - DNA, 861 bp, Heterodera glycines
aacatgttaagctttcgattgataccaagattgctggatttggttaacaacaaaaaaagttataacccaaaaacttgggctggcgccaaaacgtcggcgccaaaacgatacggaccccaactgggtactatattatgcgttgggtcatcattaatattctggcataaattcttaggcagtaaatttcggaaatttgaaaagctgattttcttgctcagtagttgtcaaaatgatttgaaataatttgttcggtctggagtgtagtccacttggccgtcagtttcaaggaaaatatttaaaacaaaattttatataaaaataattgaaaaaatttactaatttcacatttattcaattatatccttttaaataaattttgatcatcaaagattaaataaaaagacggccggtttctgagttttcgagttggttcaaagttttattcctgggaaagcctgcacctagattctttattggaagttgatttttggacaaaaactcggaaaagtccaggccaagaaaaatccaggttcctctaggcttgaaccaggcctggatctggatttttgcaaaaatttgtagaaaaataaattagaaagttgaaaagaaaatttattgtttaaagaaaatttaaaaaacgtgggttctgaatacattttgctaaaagaatttccaccaaaaatggtcaaattttttgggtttgcccaatttttgaaaaattttgagaattttttgcctgttgtgcccttatgcggcggcattaatgtatttcgagtctttgatcgcaaaaattatttgatgcagtggtaacatttatactttatgttcagaatgtgtgcaaagaataagaatatgttatta

SEQ ID NO: 36086 - DNA, 914 bp, Heterodera glycines
aaaagacatttgaaaatggcatttttggggacactgtgatcagagaatggcgcaatgagatcaatggcacgccgtttcaaaatgcttttcagttttttttcataaatcgaagtccccccccccctcacaaactttgtttgtttttgcattcttcatcatacatactttataacacggtacatttggaaaccaaacaattatactgttttttagtactgtaaatttattggcatctgtaatgaattcaaaattgggcaaaaaaatgccaacaattacaaattccaattgttttacataagttacctatcttaggatttaagaactttactttccattcaattttgatttctgttaattgtcatttggctacacattttacgggtttttctcataatcgctgaatcccatcagtcgaaataaaaagttaattatttcaatttaaaaatttattacgtgttttaccatatgctaattaagcatggggtggacgggtccacttaatagttacaaggaggcataagcgcttaatattgcggattgagtaattgctttatcttatacaagtaataagtatggatggcactttccagcacaaaaaccgcaaaagaaaaacactaaaaattacaaactagcaagatctggagatggttcgattttttgttggaaccgaagaaacatccccgtccaaaacgtagttggggaaaacattgtcgaggtatacaatgacgtcgctgagaaaactcaactaatcaaagttacaaattttgttttaagaaaaattttttgaaattttctgactggaataatttttaaccggcgatgtttatctcgaatacgttttggatgacgatgttttgggtcacaccatgttaaaataaactatctctcgtttttaaattacaggacattaaaac

SEQ ID NO: 36087 - DNA, 880 bp, Heterodera glycines
ttattgcaaatgcgaagcattaggcttgtgcttatgatttggcaccaaaatacttgacaagattttttggaatgctccctactggcaaaatgtttgatccagatgctgctagtcttggcaattcattgggcggcggaattggcctgtcgttgggtatttaacaaagtgaagaatgaagacgatttgggcaaattcagcccgacggaaaaaataaatttataaaaagaaatatcaattaatcggtcttcgaaatttttttgagagatcttcttaatcggaccgagtcagtttagtctggccggtttagtctgggggtcgttttagtctggttagctgttttcacccacaaattaattacttttataaaatatcattttttgtcgagcatatacatacatataactttaaaatttctgttcacctacaaagaagtgtttgcgttgtgagtttttcggacctaataacaaatgcaaaggtgtatgcaaaaataaaacaaagaatatttttttaaattcagcctacacattgacattaatagggacgtgaattttagtgaagaaaaatcccgaaatagttaactaaaatagtgagtaaaaatgccaaaatagtgagaaaatagtgaaaaaaagtccgaaatagtgacgaatagtgacataattttcagccaaaaattaagcaaaaataatttttattcactgattgcattgcaaatgagtagggctgggatttgtaagggcaaaaaaacacaataggtacataaaaaaataatttttaaaattaaaattcttgccacgaaaatacctttttgagaaaatttttttcatttcttaggagtgctttttgaaattttttttgtcgattcttaggggcgtattttttg

SEQ ID NO: 36088 - DNA, 125 bp, Heterodera glycines
tttttgtagagggattgaaccaggggaaagaagaacggaaaagtcaaggagactagccactaaagtcgtgaaaactcgttttatgggtttttagggttgatgctcaccaatatgacgtccttttc

SEQ ID NO: 36089 - DNA, 221 bp, Heterodera glycines
aaatccgcttaaactttattcccccactcaaaaaatgctaaaaaattcaaaaatttatacttgaggcgactgttgcaacggtggttgttcaggcgaatgttcgcccgacgacgaaaccatcggaggcggcggccaatgctgcggggaccatccgccaccgccgcccgcgttacagtcgatgaactgaacgccgccgccgcccatgggaccagcgccgcccg

SEQ ID NO: 36090 - DNA, 791 bp, Heterodera glycines
tctgatttcgaattcagattgagcactttccaatggtccgtgccgacttcgtcaccaaaatggtgcgccattttgaaggtgccattgtaccaactgcaatcgcttgtttctttgtggagaacagttttggggacaagttgcagaaaagtgagtcggtcgcgttgactttgtactttatttttgcactttccaattcgacagttgctccttcgtttaatcagtcattttggtacaaaatggcgattcccattcaatgccgaggccgtcgtctgaagcaggcttatgtttctgagcagttgcgtgagcacttcaaactgtacaacgaactgatgtgtcagtaccagagccaatacccggaactgcttaccggactcaaactcacccaggtctttttgttagcatttggtgtcctgtttcaaaaacaacccctttttccagcaagctcgccatattctgttggaacgttctgagcaggaacagctcgtcgagtgccttgtctgctttgaacgggtcgcattacgtcggatggtctgttgcaccgcacccatcgaaagtccatcaacgggcggtgcctctcaccagcacatcgcccaggagagtgagggtgaagtgctgctgattgaattgccttccgattcgtcacgggtccaattgctatcgaatgaacgagaaagtacgactattcttctgcaatttgcacttacaagggaaccacccgaactgtaagtcggaaaatgcatatatatatatatatatattatatatatatatatatatatatatatattatc

SEQ ID NO: 36091 - DNA, 169 bp, Heterodera glycines
aagaaatttaaaattcatcgccacagggtgaaaaaacggctgtccactgccgctaaacgcggggagggggggggggggggggcgtaggacaacggacggatgggaaaggggggggggcggaggggcggaaggggggggggggaatgtacatccccacaggggccaaatg

SEQ ID NO: 36092 - DNA, 571 bp, Heterodera glycines
ttttgataattaatacttctaactttgctctatccattgatctaaaatttatttaaaaatttttatgtttcacgtaattatgaaatgttaaaaatttgtacttttttttgcatggctttgattcctttcgtcagttaatgaatagaaaaattcaaataaattttattatttaaaaataccattaaatttaataaaaactaattttaatgctacccgcagaaaaagaaccgggtaaacgggtaaccttacccgcagcttggggttggctaatggagaaccgggtaacattcatttgctacgaatttacccgcagctgggggtaaggttacccgggtaagggtacctgggtaacagggatgtgcctaggtttcgcttttcccatttcgcattttttggcatttcgcatttcgcctttcgcattattcgcattttttggcgtttcgcatttcgcctttcgcattttttggcgagtcgcaaatttcgcttttcgcatttcgctttttattttttcaatttggcccatccctgctgagaaaccttacccgggtagacttacctcggttctttttct

SEQ ID NO: 36093 - DNA, 704 bp, Heterodera glycines
caattaaatgccccttttgggaggggttgaacaatacagtgcccgggcattcaaatagcggatttacggtatgttttttatgtgctaaaagtaactaatgttatttttttctaataataaaagatataaatatttgaatttaatagtaattttgttccagaaaattttaaagaaattgggagggatgagaggaagtaaaaacaaaaaatagaatttttataaacgattataaattttaaatatttaaattacttagacctaggaaagttataatttataatgactaattttgaaaatttttataagcttagaacaaaatattaattaaatataaatttaaataattaatgaaaaaaggtaaaagtaaagaattaataatttaatgtgttgcaaatttttaggacaacttgccattccgataaaaaaatttttataaatttttccttattgctttacattattacaaagataatccaagtaataaaataaaataattcagatttaaaattttattatatcataatataaatgtaaaatataattttaaaattctaaaataataaaataattatatactttgttaaattaaataataaaaataatttaaagaataattataattttttattagaataaaatcgaaaaataaatagtatagtaaaatattttttcttaaatgtttttttattatttaatatcaatta

SEQ ID NO: 36094 - DNA, 1228 bp, Heterodera glycines
agagaaatgagaagcaaaaaacaatagggggaccaacacaagggaaggcctgcctagcgcttttcacagctccgaaataagcattgaaggggggaccaacacgagggaaggcctgcccatcaacacccagatattaggaaatgtgaaagagagagagagagagaaatgagaagcaaaaacaatagggggaccaacacaagggaaggcctgcctaccgcttttcacagctccgaaataagcattgaaggggggaccaacacgagggaaggcctgcccatcaacacccagactttatgaaatgcgagagagaaagagagtgagatagagaaatgagaaagaccaatccacctttgccctttgcgctggtgtgacgtcgacagaagatgagaacacaaatggcaattgttgcttgaccacttgcagaccattttgctgctgctgacgcactaattaataaaaatttcaaaaattttaaatttagaaaaattttttattacgttgatgaaaaagtgggcgagcattaagccgttgttgtagaaatggcgccaccggtcggcccacaatggcatgaagcgtggagtccatgggcgagtcaatgtcgtggaagtgcgtcagctccagggcatcgcttttcgttgataaacaccaatcctcttgcccttgataatctgaaaatttaaaaattaaatcgaaatttaaattgatattttaaatgtaaaaattcaaaaaaatttggtcgggttccgggcggcgtggacggaccttctttggcgttttgcccttaggaatgcggattgatgggggcggcggctgtaaaaaaaaatctttggaagatatgataaaaataattaaaacaatttttataataatttaaaaagacagtgaaaggttaatatttttaattatttaaatgctatgaaatttaaactttttattaaagcttgcctgttttttgttgaatttgtttttgttgtttttgtcccttttttttgtcgtgcgattgcttcggcggaaagtgacgaaaacgacggttgacggacatttgctgctgttgatgatgatgagcagccggcattttgggtggcgacgacttttgcagctgttgttgatgggcagaccttttgtcgtgcggtgaatttgacttttgttgttgtggcatttggttcgacgacgacttcggcatttgatggtggcattggcaacggcaaaccatcttcaatttgtggtg

SEQ ID NO: 36095 - DNA, 906 bp, Heterodera glycines
gggcttcttctccaaccttcgaggagaaaagtcggggataggggaaaaaattctccgaaaatgtgtcgaggatggctagagaaattttagaaaaagtccgggaacgataccctagtcagaaaggaagatttcataaaaacttgaaaaaataacagaaagttcttggaaaattccttttaagacatctattccaatttggaatgtaattgaggacattcgtaattcccgaatcgcgtcggctaggaaccctaactgaaacttcagcacaatttggtaaagtctaaactaatggggatcagttaatgccacgaatagtaaggccttaatattttaacataatccaatttatacgtaaattttctgcaaaatacataagattatgcagtctagacatctcgtagatagtgcagtcgttggcggaggggggggggagtgagagatgccccggaaaatcgacaaaatgccacccaattcaaactttcaaaaagtttcccagataagaaatccccatcctccgtcaacccatctttggagcacacacatattcaaataactgtgtgcccatttccattggattttgccctcctttgtctccccctccccctcaaaaaatgtcatttttgcccgtttgataaaattacgaaaaatttttagtgcggcataaattcaaatatgccaccatcatttccatcaatcaactgagtgagtcacatttctgcatcctctgctgaatggggacaatagaagataagtgaatttgttgtactaaattggggcatataaaagtccaccataaattagtcatattcattaatatttcattttcttacaaaaaaaaatattaaaattcccacaaattcttaaatctattaaaatttgactttttaattcctgtcatgaaccgcc

SEQ ID NO: 36096 - DNA, 798 bp, Heterodera glycines
ctcagaataattacgccgatactaattgttctggaatttttttctctgcgcgaatgattgggaaaaatttggaaaattgtctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctatctcattttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctatctctttttctgctcaacagtaataggaattccaaccgtcttctcccaataattacgccggatactaattgatctggaatttgtttctcggcgcgtttgtttgggaaaaatttggaaaattggctatctctttttctgctgaacaggaataggaattcccactgcattctcagaataaataacgcgaatactaattggtttgggaattgtttctccgcgcgtttgttttgggaaaaatttggaaaattgg

SEQ ID NO: 36097 - DNA, 146 bp, Heterodera glycines
ttttcaaggtacttttagttatgattaaaattataagtactttcatttttcatgaaaatttcaagaattaaaaattaaaaatttttttagcgattttttttgcggcgcgcttttttcaaaaaattttggggacaggagggttcggc

SEQ ID NO: 36098 - DNA, 781 bp, Heterodera glycines
aaaggaattaaaaatttttaaaaattttattcatctccctttttgatagaaaaagcatcagagtgcctaaactaacatgtaaataaaatctggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgccccccccccgcccttcaaaattttgaaaaaaaaataaaataataggagacgcagaattttgaaaattttttataaaaactgatgacaagctaatgtgataaaacaggttaattcttttcctttcagtatccctacaaagtttggggcgcttctgatcagtttctgaaaaaaaagttaagcctaaactttttggcctgtttaaaaaggaattaaaaatttttaaaaattttattcatctcccttttcgatagaaaaagcatcagagtgcctaaactaacatgtaaataaaattttggtgcgtttcagagcatttttctgaaaaatatttatgaaataaaaaaatcgattttt

SEQ ID NO: 36099 - DNA, 880 bp, Heterodera glycines
cgaatttccgaaaatgagcagcaaaatggcgcagaaagcggcgaagaggaatttgtagagaacggcacggaccggcgaaggcattgaaaaggatgaaacaccgccgggggaacggcggcgtttgtttttgttggcattgtttaatttggcgtcggaagattcactttccccattggcatcaaccttttgcgaaataaattaacaaaagtccaagaaatacccacctttttcaacgctttgctaaagttttctccgctgacaaattccataaattccgagtaaaaaaccattggccccgtgagaaccgtttggaattggaaagtgtacgccaaaaagttgagaattggcggcactttgctgaacaattagtgtttttggctgttccgagtgaatcaccgcacctcaatgattctttggacagaattcggctgagttcctccgacttttttgatccgtcatgaagtgaaaaggcgagaacggtcactttttggaccataatcatcattggaccctgaaattgaagagagttgaaaccgacccgtggcacaaataaaattgggaaattcgaattttgacagaaacttacagtgacatcgaggtgataatcgcgaagaataaaccaacggtacctaagaagaaagtcacaattgtaatgatcagcaacgaataccaatttatttatttatttttgggtggcgcccagattctccagttttatcatttttaagcatcaaaatatccagatgtgaatttgtcctacaatcctctgtttcaatatcttctttcgtaaatctttaaaatctcgaaaaatggaaattctaaatatccaaaacgatttattaatttggagataataaattataatttgtcattctgctag

SEQ ID NO: 36100 - DNA, 215 bp, Heterodera glycines
ccccccgggcaatggcggcgatgagtaaaaacgctataaatgtggcgatgaaaaatgggtagcgatggggctgacgaggcggtgggtgaagaaatttttgccaccgctcgaccacctcctcctcatcatcatcatcatcatcagcagcaggaggaggaggaggacgaggacggaagaggacgagaagagaacgacctcttgaggggggggggggg

SEQ ID NO: 36101 - DNA, 541 bp, Heterodera glycines
cttttcgagggcgctgaccacgaatctgtaactcggatttgcccaattccggacacccgacctgaattcgaatgcttcaagtattagaataaaaaatacgcaattgcgcgaaatttgttcgattttaactcgtattttggaagaaaatttcaacttttttgctcgaattcgggtacggaattcggaattgggaaaatccaagttcatattcgtgatcagcaccctcgaaaaccccggaaactgattttgagccccaaaaaaagttaaattagaaaccccaattcttcaggagtgccaaaatttcctacaattaattatttatattacagataaaattcccatatttatgacacttgacgataaattaacttttcctccattagaagaacaaactgctcgcaagaggtgcgaacgaaaacatcaaaaagttatttcgtcaggccgtttaaatggattatttacatattataaaaaggcgaaatgagaggaccagcttcactcctttcttttctcggtgcctatactgcaaaaacagtttttg

SEQ ID NO: 36102 - DNA, 1506 bp, Heterodera glycines
  misc_feature (1498)..(1498): n is a, c, g, or t
ttgctgctgatcagagacaaattgccgaagagatttgagaggagaggaaaagtttagtgccgacgtcgacaattctaaaacgagtaaaaaatatttaaaaatatatctatttaataaaaaacgaaaatagaataagaattaattaaaaacaagaaaaggtcaaaaaaacatttttaaaaagcgattcaaaaactttaaataccattttattcaacaaaatcaattttctgtggcatatttgtttcgccagcaattttctactagaaattttaaaatgaaaatatcctgataatttttaaaaaatccacaaagaaaacaattctcagttgtgacaatacttatacaatatccttatatgagatcttccccgagaggaagattaatggatcaataatgcctacggtaacgatgcttgttcattgtgtgctgtgtctgtcttaatgtattcccgtgcccttccaccgtacttggctgtctttgctgcttcattttagtcatatttcgctgctccttccattctttgagccagtccgtttcgagttcgctcaacggcaccgaatggttgtgggccgatcggtagaaaatcgaattctgtccccggacgaacacggcacggaatcggcagctggagaaaggcacaaaaacggaaggacaattaatatttttcaaaatttaaatacccaccgaaaaggcggctgatatcttttgcagacgtaattgtactgaattgtgccgtccttacaattcttaatcgtctgacgagtgatcgaccattgcaaacaaatggagcccaaattggactcattctcatcaacatgggccaaaaagtgccattctttggttgacttttgggaggaagtgccaaaagaaattgtctctaaattattttaaaattggccaaataattcaaaggggttctttggtcaccgtttttgccaacacctgaagagacggaagagactgggccagaaacattgatgataattgggcaagcctttccaattaatgtactgataggaagttgagaatggcactttaattggaaatggagagagattggagcaaaacgacattataggagaaacacaccgattgatcagtgatctgagaagagacgtcgattgacctttgaggggacagaagaggatgagagcggtcgggagtgatcggagcgttttgaacggtcaatccctggggagataacagcggggagtgggcgtggccttggctttgataaacggccgaacgctcgcgcacccaaacggcacggaagggacagagcttatcaatggcacagtcgaagaacagtctcttcagaaagcaaaggtaaaacatgggatattttgccaaacaaacgaacttcctccgattcgttgccgatcaatcgcttctcatggccatcggtcgcctgcttttcgtttttggcggcgtgcaaccaatgccaaggcacggaatgttcgtcgacataaatgggaaacacccgttcgggtagttcaangcagtgcg

SEQ ID NO: 36103 - DNA, 930 bp, Heterodera glycines
  misc_feature (873)..(873): n is a, c, g, or t
gtgaaattaaataacgattgcgcaccgcacttcctatcatgctcgagagcatttgtaacgtataaaatttctcaaaataacagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaattaaataacgattgcgcaccgcacttcctatcatgctcgagagcatttgtaacgtataaaatttctcaaaataacagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaattagatggcgattgcgcaccgcacttcctatcatgctcgagagcatttgtaacgtataaaatttctcaaaataagagatagtcatttttcttggatataaagataatttanaaattctctgagaaataaaatggcgattgcgcaccgccctccctctcacgctcgagc

SEQ ID NO: 36104 - DNA, 1065 bp, Heterodera glycines
cggtgatcacaaattgtattatatatatgtgtgggtatatgcctttaggataaattagagatttcctgaaatcccaggctcattcttttgatctaatgataaagtcggtagtcactgttccttcggtttttattttattttttgttatggtaatttttggtgctgaaaacgaatctgagattattttaagctaatatccattttatgttgagttacatgaaagtttacgtattagcggtaacgggagaagcggctcaaaatcggtggcattttactaaaaatgaaaaacaatgccatgtcaacagtaaaataaatgtcaccgagtttcaagtacgtacttgacattcaagtactaatccccccgtccctggtttaagcatttaatcgttaagaataatttttattgttaattgatggctacggatttctcaattgatgagccaaccgtagaacagccgaaagcagtgaaatgttcagtttaatacatttaatgatcacgtcaaaaccgaatttcatcttccaattttacactgcaattgatcgatcacttcttaacaaatcattcattgctacttttcgagttattaatgcctattttctaggcttttatttttagcgcctaaaaagcctaaaaaaattttgaaagagcctatttttgcctattttggcgttttgcccaaaatttgtttacaaaaatgcaataaaaacaaaaaaatacacccctaagaatcgattttttggaattttaaaaatacacccctaagaatcaactcgaaaattttcaaaaatacacccctaagaaatgaaaaatttttcaaaaattcttctccaaaatttatttatttttgacaagaatttgtgattttgaaaatattatcttaatactagagactaaaaaaaattttccgggagcgggagtcccgaacgggaatcccgtaaaaatcccgctcccgttaaaatcccgtccaattttaacgggagtcccgggcgggagtaattcgaaaatttaattaaatactcactaaaatattttaatgcacgaaatttgaaggacaatccttttat

SEQ ID NO: 36105 - DNA, 1058 bp, Heterodera glycines
ttttttgagccagctagctcggcgctcatttcagtgtaagttagtcctttaccggggagtatccctgcatagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgccccccccctcccacgcccttcagagcacgacaaatatttcaacaaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaatattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccgctttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtcgttttttcccccaataaacttttcaaacgccatttttcgcagcatgaatgttatttttattgaattct

SEQ ID NO: 36106 - DNA, 777 bp, Heterodera glycines
tgcgctaaaattgtttgagaagctttttgagcgtaattacgattttacttacaccattttttgctaggcttagatcacatgcgattttcggcactctgataattttagcgctcataatgggatgtataaaggcgattgtagaaggaattggatgcgctaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggatgcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgttcataatgggatgtataaaagcgattgtagaaggaattggaaagcgctaaaattg

SEQ ID NO: 36107 - DNA, 1285 bp, Heterodera glycines
  misc_feature (467)..(467): n is a, c, g, or t
tgagctcaaaacttggtgagcaaaaaaaaacgaacggactgacaataaacaatgcgcacgaagagacaaaaatggagccgattgaagaagcgaatttgaaaataattgacacggacatcggatattgtcgctacggaaagggcccagtcaattttctgttcatttgcggtggcgtcggtccgttttcgcgtcctcaaattttaaattccccccccccccctcctcactttggcaggctgttacaaaaaagattatccggagtgtgtactgcgtgcctttgaccccaactttgccaccataatttgcatcgacccgccaggatacggcaccagtcgtccgcccgatcggaagcaggaggtgaaccgttgcaaaatggacgccaaatactgcttgaaactgatggaggtcagtcagtttggaagtatacatccgtaccgttttaatgtgccacttcccccgttaatccnataaattccgtttattgtggtacttttgccttgctgcaattccctcatttcagaccctcaaattgacgccgtttgttgtgttgggatggagcgaagggggcagaacatcgatacacgtggcaggccaagggaagggcctggtcagccacatggtactgctttcgtccggctcccaagtggacatgcggggagacttggcattcaaaggtgttggaattcccatttaaaggaaacgtattcttgactttaactcattgaaaggcatgcgaaacacggaccaatggatgcccgcggcaaaggcaccctatttggagcattattccaacgaatttctcaaggaacaatgggccggactttgcgatgttgtagcaaagtgtgtgcacatgaatttttgaaattcgacctaatagtcaattaatttatcaaattcctttttatttttgaattaaaagggaagaaataatcgaaacaaaaaagcggttaaatctttttaaatctgctcatttagagtgtacaaggacctcggaggaagttttccatgcgaccgcgttctaaacacactgaagatccccgttttgatcgtcaacggtaacatggaccggttcgtccttgacccgagcttgatgagcaagaaattggaaaatgccaggttttcgccatttcatttcttacaattagcaggaatgtaatttttaggattgaaatacatgcccagggagggcacgaccttcacatcaaatacccacgttggtttgctttaaaagtgactagttttgtgaaggaatcggcgaaaagtgatgtgaaagcgaataggaaat

SEQ ID NO: 36108 - DNA, 1364 bp, Heterodera glycines
tcttgtcggcacaccactccaaaacatccataacccatagttcccaaacgtttcgccaaatcattttttggaaaaagtatccgcgaaaaaagtggtttaaaaagcaaaaaaaaaaaccatttaaaatcagggctcctaagttttttttcaaaaaaaggacaaacgatacccgacccaaagacccttttttaaagaaaatggagctctggtggtgccgataggcgccgccaagaaaaagaaaaaattttgaaattgggagttttgttagcatttatatcagcgaaataaatcattaagcacaaaaaatttaaaaagtttggggaagcctaaaataaaggacaatcttagaaaaaaggacactcgggagccctgtttaaaatgattgacaaacattcgaccggtcggtcacctttattgtccgatcaccgctggccgacacaatgtatttgtgatcaaagtccaccacgttgaccgccgcccggtggccaacgagcacccgacgcacttcaatgtcacgaggcgatgccatgtcccaaaccgcgatggaccggtccttggagctaaattcgccagtaataaatttattttaaaaagacaaaaattatttcaaatttaatttgtgagaacgggggtacgtacccttcagctaaaaattttacgagaaaattacaagaaaaaacttgaaaattttaatttttaagtttgaaaatatattttttaaatttgtgatggaaaataaataaatatgtgaaatggcggcaccatgtgaccagcatgccgtcctgaaatctcaggtggagaacagcttcacaatggtggaccagcgtcttcagttgctcacccgtgttcacgtcccatattctggaaaaattggaaaataaaaataatatttggttttttttaaaataaacaaagcgttttttcgccagcccccaaaatttagcattttgggcgaaatttgttaattaatggcgtaaaaactgtgttcggtaaatgcatttgctcccaaaactcggattttcgcggtcagattttcctagaaaaatcctttctttggaatcacatggcccctcggcttcccttttggtcccattttggcatgccattgaaaattgagtttcatcctccacctgactgtcgcgtcactgctgccactggcgatcatctggttgtcgtactgcaggcacagcacggagccggtgtgcccgctcaatgtttgcacacagccgaggctgggccgggaccaaatctgaggggggaatttttaaagttagaggtttaaatagaatttacagcataatttggctaccttggctcattttttggctgaataaacccatagattagagacgtttttaataaaa

SEQ ID NO: 36109 - DNA, 656 bp, Heterodera glycines
gagagatcgaaaagaggaacgagacagagcgatagaaaagaggcgagagagagcgaaagaaaaaaggagagagagagaaaagaggagggagagaagaggagagagagagaaagaaaaaaggagagagaggaagagagagagaaaacgagaagagggagaaagaaagaaaaaaggagagagagagaaagaaaaaaggagagagagagagagaaagaggagggaaagaagagagagaaagagagaaaggaaaagagagagagaggaagagagagagagaaagagagaagagggagaaagaaagagagaaaaagagaagagggagaaagaaagagaggagagaagggagagagagagagagagaagaggagggagagaagaggagatagatagaaaagaggagagagagagaaagaaaaaaggaaagagaggaagagagagagagaaaaagaggagagaggagagagagaaagagaagagggagaaagaaagagaggagagaagaggagagagatagaaaagaggaaagagagagagagagagatagaaaagaggagagagagagagaaagaaaaaaggagagagagagagaaaagaggagggagagaagaggagagagagagaaagaaaaaaggagagagaggaagagagagagaaaa

SEQ ID NO: 36110 - DNA, 2051 bp, Heterodera glycines
cgtttttataattattgataaattagcagattcaatttttaacagttattcagtgttataacagcagacagcagtttattgttttatttcagtttattttgaatttttcatggacagaaggccagttatgaaacatggtgcatggcaagaatcgtttcaattgtttttatgtcaagacactttaaacatagttttctttccttcgaaattaataattttgttaaattagcaaaattctttttaatctattgatttatcgaatatattttttctaatctttaaatgtcatttacccggtgagaaattagtcccacacaaccacgcatttattatttttttaattaaaaattacatttattttagtggaaatcttttttttaatttaaataattctttgtcagaagatgtatcaatgaaatttataaatttttcgaaaaggagtaaatgaatttgcgaacatcaaatattttgaaatttaaaaaggtttacccttttttcatcccccatttttctttaaaaaaaaatttcctttttttttcttaaaaattaccgggataaatgggtaattttggcaagaattttaaacccgaattttttattcccattttcaaattttttccctttattttggcctttttcatttaaaattttgtttttaaatgggaaaaatttttttgtgcccttttttttcaaaaaaaaccacaaaacaaaaaattttttcccaaatttttttttttggggacccttaaaaatttttgggaaaatttttcttttttgtttttttaaaaaaaccccccccaaaaaaaaaaaaaaaaaaaatttttttttttcttttaaaaaaagaaaaaaacttttttttccccccccaaaatttttttttttttttttttttaaaaatttttttttttttttccccccccccccggggggggttttttttttttttttccccccagggggggagtttttttttacaaaaaaaaaaaaagaggggggaggaaagaagaagttttttttttttttctcccccccacaccaaaacaaacacccaaaaacaaaaaattatttatttttttttttttttttttttttttttttttttttttttttatttaaaaaaaaaaaaaaaaaaaaaaaaaaaaaaaaaaaaaaaacccccccccccccccgcggggttgtgtttttgttttttttttttttttttttttattaaaaaaaaaaacaaacttttcttttttttttttggacaaaaaaaaaaaaaaaaaattcttttttttttttttttaaaaaaaaaactctaaaaaaaaagaaaaaaaaaattttttttttttttgggaaaaatttttttgccaagaataaaataaaacacttaaggctattgaatgaaataaaattttaaaatttggttgtttttgagcaatatatatcaaaaaaaatattctcatttgatggttttttgactaacttccagggctgggacgcgaccgcaatttgcggcgttttttttccgcgatccgcgaccgcggcaatttgaatccgcgatgcgcgatccgcgactcacaaaataggtcattttttacaaactcttttaccaaattgcactcaaattttcaaaaaattttccggcggcgcctatcggcccagagcagaaaacaatgatattcttcatgaaataaacagccaaaaacttttaaattaaactaaaaatgtcattttctttcgttttttgaaaaagaaaattgcataaatattttaaaaaatgtaatttttaaggaaaaactgttttattttaaaaaaaactttaaaaaccatctttatttcaaaaaagtttttgtttatttatttattcatttaaattaaactcaaaattatttgttttttggcttagtgtttaatcgtcactttcttttctccacagacgcgagggctacggcggctacaacagctccgacgggcgagaatgaaaatgaagtgagtaaatgactcgacggtgctgggaagttgcagggttggggcgcgcacagaaaaaccccgcggatcgcgcatttaaa

SEQ ID NO: 36111 - DNA, 628 bp, Heterodera glycines
  misc_feature (419)..(419): n is a, c, g, or t
ttctgtcctcccaattggttgctgctgatcatcatccgcttattcttccggcactgattaccttcgtcattttgctggtctcttctgtcttcttttttatttaccgcagattccgacagaagccaaatattattttgttcgttgggttgtcgggttcaggaaaaacgacactgttcaccaagttgataaactcgagtcagtttatattccattttctcggttttaataattcgtttttcaaagccgatttcgggaatttatgaaaaatttttaaacaatttctaaaaatgtttgtttggcggtgcctacaaaaactcactaatttttctttaaaaaaattgctcattgttagattcgcaaaatttggtcattttttggacgacatctgttaacaaaccacataaaaaattacaacattnttctccggcgtcgcctatctgcaccgcccggaccctttataccccaagtttaaaaaaaaacacacgcgggagtaaagtctcgaaaacagactaaaaactcgagaccgagactctcgagagtcactcacataggccatttcggttaggctttcgacacgcatgtcaagaatgttaaaaatgaattctgtgtaaattgtccagtctgattt

SEQ ID NO: 36112 - DNA, 1054 bp, Heterodera glycines
attgaagtttgttcacagaatttgtgcaaaataaattccgatatatttttatgttttgagacttgatcatgatccgattacatgaatttgtggcccggaattttttgcggcaactgccacttctgctgtcaattttattattgtttttacggtggctcttggtgtcactgtgccgccttttgaaattgttacgaacggacaagggaaaaatgatcctttcaagaatcgaaaaatggcgaatgaagcctgttggttctcctcgcagaatgctcattatctgctgcccgattaggtaagcataatcagaacaaatgtgaattggcaaaaggaggcgttgactggcaaattaatgagatggaacaaaatttttcaatgaaatgagctagacgacgcttaaattctattgaattttgggtgctttacataattgaatattttgatgcttcaaattttatacacagcggcccaattttgggctccaagtacaaatatgctggatttttcgtcttagtggtctgtgagttagtcaccaaaaggggggtctcaagttcaattcctccttgtgtttgtgtataaatttcaattttttaaagcaaataaataaaataataataaatacagaacgccaaaagaacaaatacaaacagtaaaaggtacacactatattttacccttgattttatgaaatttttttagcttataacttggtgaatactagagcaaataaaaccattttatgctcattttgaagggaaaattctggagaatatttctaagttagtcaaaagtttaaaaaaattgtttattggcaaataaatgattcatgtgttattttatatgtcagagacatggaaatagtatgcccaaatgagagaaaaagaaaaaactttgccctgcgaaaaaattttttcctgtgggtaactttttttgaaattttgcataggcccatattttgaccccctctatcgaatcccctgttattttttccaagttatgttttttactcgagatcggctcctccatttttgcaagggaaaatctcccgaaaatttta

SEQ ID NO: 36113 - DNA, 1069 bp, Heterodera glycines
  misc_feature (963)..(963): n is a, c, g, or t
  misc_feature (1050)..(1050): n is a, c, g, or t
ccctcccatacgcaatctgttccttctttccttctctctctcatagtgccaagagtggcgatttggagggacacattccgcaaggcctccgcccccccccccattatcccttccttcggatgacccctctcgggacagtgcgacaggtcatttcccctcctccctgtgttctccactcgccctttcattcattcattcgtccataccctcactcgcattatcggacggataatgggcaatgggaggggataaaaggaccattttatccctttaatttacaacatttcgcgacaaaaggacaaaaaacgacagaatttggaaaaggtgacattttgagggatttgaggcgtactttttgagtattgtgagcaaaaatgggaaattaaagcaagttcaaaaagagacaatgagaaggaaagaattaggggaagtcacaatgacacaatgatgagaatggcatggcataatggaggagagagagagagagggggcgagagagagagggggagaaagagagggggaagagagagggaagagagagaggggagagagagagagagaagaggagcgtgggggagagaaggaggaaaaagaaagaaaccgttgaccggaagggataaaacacagtaagacacaatgaacaatgttttagcattttgatttgccaaaatatttttggattagggagttattcgattataggacggtgcatattacgaacgccgtcgcaagaacaatgacgcggcaaaacgttcgcgtgacacgcgccggcagaaggaggaacagacggcacagagggcggcatatctcgaacaggtgccaaagtgaagagcaaagacgggaatggcaccgaagggattggcattttcaggagaatatccaactgcggaagcgcgtggacatgctcaatgccgaattggcaaggcacagggccattctcttctcattagccgctcccacggncaacgcgtcacttttgccgaacactccgccgccacaggcatcggccgaagagcgacggcacagccacgtgttggcatcgccaacttncacgacgacagcgaacggc

SEQ ID NO: 36114 - DNA, 1481 bp, Heterodera glycines
ttaataattttcctgcgccgaaggcccaccacgaggccgcgaagcggccgagtgagtaccttcggtgcaggaaaattattaaggaagagagttcattatttatttgttttttgcataattaatttataaatatttttttcagaaagggttctgaaacgcaccaaattttatttacatgttagtttaggcactctgatgctttttctatcaaattgggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaatggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaattttaaacgcaccaaaattttatttacaagttattttaggcattcagatgctttctctatcaaaaagggagatgataaaaaatctaaaaatttttaattcctttttaaacaggccaaaaagtttaggcttaactttttttttcagaaactgatcagaagcgcaccaaactttgcagggaaactccccggtaaaggactaacttacactgaaatgagcgccgagctagctgggtttaaaaattttttcaaaaatcaaagtctttcgtttttatttaattatttattattttttgcaaaattaattcataattattttttcagaaagtgctctgaaacgcaccaaattttatttacaagctattttaggcactctgatgctttttctatcaaaaagggagatgaataaatttttaaaaatttttaattcctttttaaacaggccaaaaagtttaggcttaactttttttttcagaaactgatcagaagcgcaccaaactttgcagggaaactccccggtaaaggactaacttacactgaaatgagcgccgagctagctgggtttaaaaattttttcaaaaatcaaagtctttcgtttttatttaattatttattattttttgcaaaattaattcataattattttttcagaaagtgctctgaaacgcaccaaattttatttacaagctattttaggcactctgatgctttttctatcaaaaagggagatgaataaatttttaaaaatttttaattcctttttaaacaggccaaaaagtttaggcttaactttttttttcagaaactgatcagaagcgcaccaaactttgcagggaaactccccggtaaaggactaacttacactgaaatgagcgccgagctagctggg

SEQ ID NO: 36115 - DNA, 256 bp, Heterodera glycines
cccgagccccccgacccgacccgagacgttttttggacctattccccgacccgacccccgacatgtcgtcccccgaggtccccgactttttgccctcgaccccccgacactaattcgggggattgtggactccgagcgttttaaaaaattcatccatgaaggcgggaaatattgaaaatttttgagattttgtacaaattttcttaataaaattcattaaaaattacgaaaaactttccggcggcgcctatcggca

SEQ ID NO: 36116 - DNA, 545 bp, Heterodera glycines
tggcctaccaccaaatggccaatatggcccaggacagttcggacccccgccgtccaatagctacgaccttccaccgccggatagcagctcagacgcttcgtcccataagaagcgcagtccgttaagcttccgtgcccacggcccactaccaaatggccaacatggcccaggaaagttcggacccccaccgcccaacagctccgaccttccaccgccggaaagcagctctgacgcttcggcccgtaagaagcgcagtccgttaagcttccgtccacatggcctaccaccaaatggccaacatggcccaggaaagttcggtcccgcgccctgcaacagttctgaccttccgccactctcatcgacggacagtgaatgagcaatgaatgtttggatgatcaaaatgcacattatcattggaaaaaaatgcttgaattatggcatcgtttaagtgagaatatattctgaagtgttgattatttgacgcattttgtggaaatttcccgagagtcctctttttcagatttttctaatgtgcgagtttgaaa

SEQ ID NO: 36117 - DNA, 613 bp, Heterodera glycines
aaagcggcgcaaatgtcgattttgctgggcggcgcaaaaatcgcagcgcaaatgtcgcatcacggtaattaaagcgaattaggggaaaaaagaattaaaaagctaattaatgcaaatttatgggaaaaataaaaattgcaaatttaggggaaaaacaaaaattaaaaaagtaattaatgcgatttggaaaaataaataaagcgaattagggaaaaagattaattaatgcaaatttgggtggggaggggggaacggaggcattgtttgttacacaaatatatatttattttaattatgtataagtatgtatgatctcttttaagtatgccattgcaatacaaagcaaagtttgtcaaaatgaaagctaccctatttaattttgatgatctttgaccatcaaattaaggatggcatcattttgccggattatcaccgctcatcgaccacactcattcagtttatgatgggcaaatgatgaagagtttaatcataagatggaacaaagcgtccattagaagctaatggccagggaaattaatggcgaaggattaagtggagaaaaaaaaggctaattagcaaaagcatttgcatttttgaaaatctgtgttttaat

SEQ ID NO: 36118 - DNA, 413 bp, Heterodera glycines
ccctggcaaatccgccctttgtctcggacaaaaggcgttccctcgttccctcccctccgcttttgccaccccttttgctccccatttaccccttacccccgcctttgtgctgactccgccccgtctcttctgttgttggggaagtccttcatcttcatcttcgtcctccgtccgtgcaacaacagcttcccccgccccatttccttctcatttcaccgtcaaacatgcgcgaaatcgctccctccccccctctttccctatttgcatccaaaaagtgctcctccctctgtccgctcagttgcgctgatttactccctcccccccccctatttccccatttgtctctcccccctcccctctttttttttgtttgcctttccattcctttggaagtgagtgaagagcttccccct

SEQ ID NO: 36119 - DNA, 975 bp, Heterodera glycines
cgatgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcaccgccctccctatcatgctcgagagcatttgtatgtgtataaaatttatcaaaaaaagagatagccatttttctgggatagagtataaatttaaaaattccctcaaaaataaaatggctattgcgcaccgccctccctatcatgcgcaagagcatttgtaagtgtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggataaactctaaatataaaaattccctcaaaaataaaagggcgattgcgcacagccctccctatcatacgcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggata

SEQ ID NO: 36120 - DNA, 1650 bp, Heterodera glycines
  misc_feature (722)..(722): n is a, c, g, or t
  misc_feature (777)..(777): n is a, c, g, or t
ttcattatttatttgttttttgcataattaatttataaatatttttttcagaaagggttctgaaacgcaccaaattttatttacatgttagtttaggcactctgatgctttttctatcaaattgggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaatggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaaattcctttttaaacagcccaaaaagtttaggctttacttttttttcaaaaactgatcagnaagcgcaccatactttgccagggatactgaagggaagagagataacctatttatnaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctcccccataattgtttgagtacccccaaacggacactgaaaaaatcga

SEQ ID NO: 36121 - DNA, 384 bp, Heterodera glycines
aaagtgagttaatgaagagtctgtcataaggttttttatttattgttttggtgtgacatttctctttcgtcccttttgtgaatgccttcgattaatttcgctttattggcaaaaatttaacagtttgaaacaacaattgatggttggttggtgttggttcaccgttgaacaattgtggcaatggttggctgagaatgttttggcgattttggcctgcattggagcagaagagagaggagaagggcaaaggcagcggaagttgcgatcagaaaggcgaccaacagcataaatacgaagaaggtggtggaccagcgcgagttcagttcgttggttctgtgggcgaatcattcggcttttgttggccaaagaattgccttttcactc

SEQ ID NO: 36122 - DNA, 621 bp, Heterodera glycines
acaccatctttgttgtttctctttggattgacaagcccgatgataaatatctcgagcgcaaaacgcgtgcatgtttggaaagtatcgttcataccaataattgagggtttatttttaaatgaaattttatgataaaccttattatctcagaagctatttaattgattcaaatgtttttatcgcggttaattaaagcaacgaaaattggtttgaatcgggaagtttatcatttctaacttacttctcaaaattgttgataaattgcaaatatatttttccaaaagtctggggacactttctgaaaataaattctatactcatggattttccacttattaaattttgcaggcttattgatgcatgttctttgacacttcttcaaaataacctatgccctttattcgctcaaaacaccatctttgttgtttcgctttggattgacaaggccaatgataaatatctcgagcgcaaaacgcgtgcatgtctggaaagtatcgttcacaccaataattgagggcttatttttaaatgaaattgtatgataaaccttataaagtatcgttcataccaataattgagggtatatttttaaatgaaattttatgataaaccttattatct

SEQ ID NO: 36123 - DNA, 1497 bp, Heterodera glycines
  misc_feature (120)..(120): n is a, c, g, or t
  misc_feature (137)..(137): n is a, c, g, or t
cgatgtcaaaagtaaaatctgatcacgtattcgtgatcagcggcctaaattggccctaaagacatgtttttgaaggtttttgatgaaaaaatttttccactcaaaaatcctacactcacncctttggtcccgattcncaaaatcacttttatttctataacttttttcaaaaaagtgataaaaagctaaaataaaatttataaaatagagcaaaaaattgcggatttttgtattattttacttttccaatacatcttttcagaaccgagttcagaatttttttctgaaaattcgaatttttccagaacttccggaataactttttttagattcatgatagagaatctaaataaaacccataaaattctcctgatttttctccatttttaatgctttatttaatcaaaattggtcaaaccttaggccagatatgaattttcaaatattaggccaaaatcccgagggccaaaaaattgccaaaaaataaagaatttttaaaaaattccaaaaattctgaaacgtaaaacaaacatcatattcgtgctcagcacctcaaaataacccaggaaaaaaattttcacccccattttcaaccaaaaaaaaatttcctaaaatttctagggggcctagctcgaaaatttttgaaattttccgggcatatatcccaccgttcgatagagcttaaaaagctctacaattttgctcttaggcaatttttcgctaaaaccaacccccgacgagttatgggcccgggactcaaatgtcccgcttaggccaaaaaatttttctatttcctggaaaaaatcgaaaattttctaaaaacatcactaatcgatagagctcaaaaaacgatgttttggaagtggtcttcgttttccctggaaaaatcgttaaaaaatcataaaattcaaaaaccgaaaaaccgaattttaggcctaactcgaaaaattttgaaaattttcgaaattttaaaatttggaaaaatcgagctcattgagctctacaataagtccgctggcgaccccctgctccgagcaaacccttacgagctattcgcctggtactgaagtgtccaaaaaaagtgattcttacgttgcctaacctacaggtcaggcctttgatctgatcaaaaattttttgctggcaaagttgtaggccatagttaaggcatttcgcttttggggtccgctaagctctgaaagcaaaagcaaaaaatttcgtaacactgagactgacggcaaagtcagttttcgagccgctgggactcagttgtccctcggagaaaaaaacctatagttttcccgaattctcctcaaaaagttgtaagacccttccaccactttcagaccccggccggccttcggccggccggaattagtttttgaaacgaaactcaaaacctatataacatatatataactagcgtgtgggaattgacgggggtccggtgcaggcagattgcttttggatgaagagaaaatggacatgcacatttgt

SEQ ID NO: 36124 - DNA, 1110 bp, Heterodera glycines
gccagatcggacgggatggcgtgcttctaacgtggtatggtcgtaagcgaaaggacagcaattaaagtcatttaaataggcatatttaaaagagcctttttttgccttttcacaagagaatttattaaaaaaggcaaaattcgccttaaattaataaggtgaaagtttgaaaatgtttattaaaaaatttcaggatgaaatacatttaaaataataaaaagaaaaaaaataaatttatttttctaaataaataaaaaacattgtcagaggcagtgcctgccgaaaaaatagacaaaattttttgaaaaaagcctaaaaaaattgaaaatttaaataaatttaaaagtgaaaaaagtaaaaaagcttacaacaccttcgattcccaggacgtctccgttccaagtactaagaaggcccaacgttgcttaacttgccagatcggacgggatggcgtgctttcaacgtggtatggtcgtaagcgaaaggacagcaattaaagtcatttaaataggcatatttaaaagagcctttttttgccttttcacaagagaatttattaaaaaaggcaaaattcgccttaaattaataaggtgaaagtttgaaaatgtttattaaaaaatttcaggatgaaatacaattaaaataattaaaaagaaaaaaaataaatttatttttataaataaataaaaaacattgtcagaggcagtgcctgccgaaaaaatagacaaaattttttgaaaaaagccaaaaaaaatttgaaaatttaaataaatttaaaagtgaaataagtaaaaaagcttacaacaccttcgattcacaggacgtctccgttccaagtactaagaaggcccaacgttgcttaacttgccagatcggacgggatggcgtgctttcaacgtggtatgggcgtaagcgaaaaggacagcaattaaagtcatttaaataggcatatttaaaaagagcttttttgccttttcccagaaaaatttttaaaaaaaggaaaaatcgcccttaattaataaggtggaagtttgaaaaaggttattaataaaatttcagggtggaaaaacattaaaaaaaataaaaaagaaaaaaaaaaaattttttttt

SEQ ID NO: 36125 - DNA, 964 bp, Heterodera glycines
tttccactatagcttttttctttgtaatccaaatccaacattgtaggtatcattcgaaatagaaaaagttttattaaaaaaaacatcaaaatttcgacttttttgcaagtatcatgttataacttttttggtaattgtctaatcgaatagcagctttcgatgataccaaaaaaatgttggatttggttgacaaagttaaaaaagttatagccaaaaaagttctggagcccaaacgtgccggtccaatcgtgccggcccattgaggtgtaccgatcgctggacctcagcatcgttccgaaaccaaattttgcgatttgggccaatttcccatcgggattgaaagaatatttgcgcttgtttgaaaacattctaaaataaaaattagttattgcaaaagatataacaaatacgcctcgaccatgaggaaaatactattatttaaaaattatgacataatgccataatttaaccaaaatattggtataaaattccaaaaaattgtaaaattttggatattttttcatccttgaaacttaggaagccttcaatatcggaaccgctggggccccaaaaatctcgttaaatttttttggagtgtctcaaaaaccgcaaaagaatcaagaattgacaaaatttttacgaattgaaaaatataattttattaaaaagttcattgcagtgtttttttctcgcctttctcttgttactgattgtttatgattagcatttttattatatttttattacaaataattttttacacccattaaaattttaaagggaaattgacttttgaaaacttcggacttcgccttcgagcaaaaattgggcttcgcctttggcctcgagtgctaaaaaataagccgagcttcgcccgtccctggcagtgagttcagcctaagaacagcttgccccaccgtttgcgctaccaaaaatatatatgtaggaagaagaaagataaaaa

SEQ ID NO: 36126 - DNA, 839 bp, Heterodera glycines
ccgcattcggacccccgtacgggggaacgcctcacgcattcggcccactgtacgtgggaacgcctcccgcattgggaccaccatacgggggaacgcctcccgcattcggaccccgtacgggggaacgcctcccgcattcggacccccgtacgggggaacgcctcacgcattcggcccactgtacgtgggaacgcctcccgcattgggaccaccgtatggggcgacccactaaagtgacctccataaggatggccgtactgatacgggggtacgctaataaaaatttttatttatctatttttctgcctattttgggatttttgtacctattaataactaacttttttgtacctatttaaatacctatttcgtgatttttcttacctaagtttcccagccctaatgataaaaaaaatataccgtatttgctctttttatgtgccatggtatattatttttcaacctcctcagaaaggagtagataattggagactggtagactaatggagactgggaaattatttttcggctgatttatttagtggaaaatttttgaaatttttttgaacatgtcgccaaaaaatgtcatcttgtcaaaaaaaatcatttttattgcatttctgttaaataacttctgaaaattgaccccaaaatggcaaaaatgtgtcattttcttgcatccaatatgcataaaaattgaaatttttaatggtgaaagatggacgaaacgatcacgaagaaacctttttttattttttattttattttaaaagtttttagtttttttttttggcttatctgatggatagtgtcgctacttttagtgattaacgaatttt

SEQ ID NO: 36127 - DNA, 859 bp, Heterodera glycines
aaaaagggacaaaatattttagccatgcaaagccaaattatgaaatatctcaatttatcaaaagctaaatcaataattagtagatgagtgagttaagaatgagcattgtgcttacatttaaaagattattgaattaagtcaaagtcgagtgaaagcggcgaaccgcctgcaaatggagcagaagtggcgcaaagtcgcaagaaacgtcaggccgaagaagtgaccactgaagagccaccatcagaaacaaacgatgccgaaggtgccgaggatcaccaatctgcggcagcgggaaatggaaaagcaccaaaaaataagggcaaaaagaacaagagcgacagcagcgactcgtcaagttcgtcgagttcgtcgagcgaaagtgacgagaagaagaagctgaagaagaagaacaagcactgagcatcggtcgactcactaatgaggccgcttaattggattggggtcattagcgaagagtggactgtcacaattaatgttgtcaaaattgtaaagcttttattctttgatgggaataaattttattagtggaattgcgcagttagtattggaaatttggagattgggtttcataataaaaatgttaaatatatttaagtctacttgaggattgatattttacgagaaaatccaaacttttttaaaggttttcttattttaacttctaataattttttaaattaaaattaatttcatttccctgcaaaaaaaaaatatttaatcataaaatattttcgaataaaaaaatgattttttggcatttgatgatttttatatttttcattgctaataaaattaaatcaggcaaaaccgaccaaagtttgatgaaatatttggcagc

SEQ ID NO: 36128 - DNA, 1065 bp, Heterodera glycines
  misc_feature (50)..(50): n is a, c, g, or t
ccgtttcaactcacgttcgctgtcgtcgcggtcactgtcggcgactgtcncgctgtccgatggttcggcttgttccgctttcttggcaggacgtccgcgcttcttggtggaggtttttgcacggcgaggagcaggtgacttcttcgttgacggtttcttcacgcgtcgaccaggagtgcgactgcgcgggcccggcgccttcttcttcagcggttgtttcttcttgtgcggcgtctgagaacgtcctcctccacgaccggcgggcgagcgacgactcttcgggcctgacttcttcggcgagcgactaggacgaccacgaccagcagacttcgttgacgcggtggagccgtcacgagctttctgctgaaaaaaggggaaatgaatgacgacggaggaggaatgctgtccgaaaacgtcactttggctgccttttccttcgccgctttctgtgccgcaatccgtgccgagcgtcgcagtggtttggtctcgccagcgctggccgcacgtttcttcgtcttgcgactgcgagcacggcgttgtgatgttgttggcgattccgcagacattttgaaccttttgttgttgatcttgttgtacggacgatgctgacgatgaggaagatgcttcggtagacatatggcgaaatatgtgcactctaaatgttatcggtgtgcccaattagaagacaaaagtatggttcaaatcatttgcgaaagtaaaagagggattcggtatccctctccaaaagcgatccatattcctcctcccagttcagacgtacggtccgttcccaaggcaacggtcaatttagggggggggggagatgggtacggtacatctaccgttgccaagacggtgggccatggaagggggtgggtacggtccattgccaagacggtgggtaatttgggggggggatgggtacggtacatctaccgtctcgagtgaaattgtacggtacatctaatttttttgcaagttccgcacctcagtgagtatttagcctgggcattacaggccacaagagcaatgaatggcatcaattttattcgaatccccggaaaa

SEQ ID NO: 36129 - DNA, 786 bp, Heterodera glycines
tatctacaaatatattaataaatttacaaaaaattttgaacaaattcactctattaattacgagaaccgaactattttttgatgattacttaaaagcagaaatttttgcaaaaattttccaagaatccttttcaaattcagatgttccacaaattagcagttgtccttccaatcccaatggaccatttattacttatgttgaatttaatgccaatgaaatctctaacattctaaaaagcctaccaaatcgagaatccacatcccccgatgaaatttcctttaaaatcttatgtaattgccaccttacgctttcacctgtaatttccgaacttttcagaatctcaatggacacgggcaaaattcctgaaatttggaaaaagtttattgttatacctctctttaaaaaaggtgaccgaaatgacccacataattacagacctatttctcttacgtgctgtctatgttgagttatggaaaaaattattgcaaaaagcatttataacttccttcatcagaataatttaatatccgaacatcagttcggttttgttaaacaccgatctactaatactcaactaattacagtattagaagattggtacgacagcatatacggtaagaaaatatcgactgtatttatgtggactttcggaaagcttttgattcccttcctataaacattttaataaataaacttcataacattggcattaagggaaaactgctaagttggttatctgaatttttaagggataggtcttacagagttaaaattaacaataaatc

SEQ ID NO: 36130 - DNA, 1269 bp, Heterodera glycines
cattgactccgagactcaagatgaagacccgcaaaaaaccgaggaattttcgagatcgagaatctcgagcagtggaaacacccgtttttgagggttctttagtgatgcaatccagaaaatgtctgtccaaacactgactcatcattattatccataattacctgagtaacaattccaaatgtacctaaaccgcatgtgacagcattgaattccggactgtttgcgtcaaaatgtgcaatttttccattggctaacaccatttgcaaggaacgcacttgggacggcaaattttgaaggccaatgccactgccatggacaccagtttggatggcaccgccaacagtgatttcggcagtcgctgccaaatttggcaaagcaaaattgttggcatctgttaaaatacgcaaataaataaattttatttaaaaaatagaatataatttgaaaaattaaagaaatttggaatttttaaacgaattcggtaagaaggacagataggcctaaatttattatataatgtttggcctatatgtaaatatataaatcaaatttttgatttttaatttaatatatttactctcaaaaaatttaaagtctacctttgatcggaaaaaagaaaatcaacctttgatcggaaaaaagaatcatctggggtcaaaatgctcatttttgtgaaaaaagctttgaagaaaaaacactatgcctattttaagaatttgcaaattaaacaatctgtctttgtcattaatcttctatcaaaaaactataaaaaattcttaaattcccaaaaatatcactcaaaagaaagtctttgacccttcaaagaccacaaagtcctggaaaacccgtaaaaccagtctcaaaatatttcattttgccctgccactaattgacacttttgccagaatgaattgtccagtgaaaaaatctgcatgtactgacatagagtgggcataaggtcagtgtacgtgatgccagcttgtacagtgacggtggatgctttggtgttaaatccgatcaccgaattcatgcccaatgttgacaaaatggtgtcacagctgtcaccaattttgctgaaactgtgccgtctgccaattacgcgcagccgtgccgcgtgcgtgacgacgtgttgcacttgtgccgtggtgcgcgggtataggacgttttgggtgctgaagttgaaattgccgccccagttgtgcagcctagaaatcttgggtttttgggatcaagatttttctggttttcctaatactgaaaattataaaa

SEQ ID NO: 36131 - DNA, 934 bp, Heterodera glycines
tgtgatctaagcctagaaaaaaatggtcaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacagtcgcctttatacatcccattatgagcgctaaaattatcagagtgccgaaaatcgcatgtgatctaagcctagaaaaaatggtctaagtaaaaatcgtaattacgctcaaaaagcttcgctaccaattttagcgcttccaattccttctcctttctcctttcatacttaccattatgaactctaaacttatctaagtgccgaaaatcgcatgtgatctcctctttgcaacaagtcgtgcaagtagtaatcgttattcccctcataaagctcctttcctaattttcgtgaaaaaaaatcattcttcaatattttatatacatcccattatatatgatcttattattaaacttcatatttgtgctcagtcctccaaatttacccctgaaatatatttttcaccctctttttcaccccaaaaaaaatttttgaaaatttctagggggcctagctcgaaaatttttgaaaatttccctacatatagtataccattagatagagcttaaaaagctctacaatttggctctaaggcattttttgtctaaacccgacgcctgacgagttatggccccgggactcaaatgtccccctcagaggcaaaatctttttctatttccggaaaaaaatcgcccgggtgagtaaaaaataccagtcgatagagcacgaaaaactatgactctagaggtccc

SEQ ID NO: 36132 - DNA, 980 bp, Heterodera glycines
  misc_feature (17)..(17): n is a, c, g, or t
  misc_feature (114)..(114): n is a, c, g, or t
cagtccttttcgcctancctgttaagagaattcttaatttcactaataatttctcaatttttttctataacagattactctttctatggtgagttttcaaatttctatgtactntattaagtatacaataataatcaaacatttttctatgattgcaaagcatttaaaaaatcataggcttgtttattttcattatgttttggaaaaggtcaattaaataaacaattttttttttgtaattttattaattgtaaaaaatcttatgcaattttctataagcaatcgatagtgtaacaaatagagaagataacttctgatcaagcacacacctttcattatttccggttaaatatgtgttcatattttaacaaaaagcagtcttgaatgtcgtcgaaatttgtggtaattccatggcttatagcccgaccaattgcgctggaattttgccatgaggcttattttttgtgctggtttcgaatttacaggcgcccatgcaattggagcgcattaaattttttgtcgatttttcttcaatacccactttaaacgataagcatttcctcgcacaccgctctatttgctctgttttaaacaacaaaattttcccaagcattcatacctactttcttaattgcactgggatcacatctaaacgactatgctaaaaacggggaactaaactgtattaatatttttaacaaattgcagcccttttcgcctaccctgttaagagaaatcttaatttcactaataatttctcaattttcttctataacagattatctcttctatggtgagtttttcaatttctatgtactttattaagtaaataataataatcaaacatttttctatgattgaaaagcatttaaaaaatcataggcttgtttattttcattatgttttggaaaaggtcaattaaataaacaatttttaaaggaattttattaattgtataaatcttatgcaattttctataa

SEQ ID NO: 36133 - DNA, 233 bp, Heterodera glycines
tgatgctgccatgcatatattatgcaggcagagaacaacatgtagaaaagaataaatgagagagagagaaaaaacaaatgagattgtgcacataataacatgcgagtttgtgctatggtacaaaataatatttttagaaagcgttcgggatcggaaaagaatatgaaattggtcataaacccgttcattgatgtgtttgaaaagaaacaaaaatatggctagcagagatcttg

SEQ ID NO: 36134 - DNA, 1083 bp, Heterodera glycines
  misc_feature (1080)..(1080): n is a, c, g, or t
aaaaccaataattttttatccttttcaggacaatttctcgtacatggttttcgagtatgtggagaaacggtatgtgcgagttgaatttgaacacacaaattttttggcatttttcgaaatagtctccgaaaaaggctaaaatttaaaaaattgcccaatccgttttctttcagctcattgatggaccttcctacggacaatccgttgtgcgaatttacggcatggaaatatttccgagacgcgctcaaagggctcgaatattgtgggccaattaccatttcaaaaaatgccgtaattaatgacctctctctggttttggtttttcagtgcatttccaaaaaattgtgcacagagatttgaagccgtccaatttgttgttgtccgacacagaaaatgtcaaagtgagtcgccaaaaaattgccaaagattgagagaaatttcaaaaatgagaaattttctaattataagtgcaaaattcaaatttttgaaagtttaattaggggagcagaattgaaaatgttacaaatccttattttacgaaacattgaaattttttataatttaaatttttgcaaaagcaaattctaaattaattctttaaatatttttttctaaaataaaattgttatttaatttttaaaattttaattttttaaaataattttgccaatatttttcacagattgccgactttggagtttcctgtgaatttgaaggtgattttacgacaataaaaagttaggtaattaatttattgcatcattttccttaaggaattgatgcctttttgacggtgaattgtggcggcaaaattttgaataaaaatttaaaaaattttccattcatttttcagggtacggccggcactcccgcattcatggcacccgaggtaaatgccaaataaaattttagaaatttgatcatagtttctgaaaggaaaatttcacgcaatttttgttggtttcactttttccaaatcctgatcagaaaatagtcagggtaatataaattcgtgacaattaaattaatttacaaaataaaaaatgttaaggaaatttttattaaaaaaaactgtgaganttt

SEQ ID NO: 36135 - DNA, 977 bp, Heterodera glycines
  misc_feature (36)..(36): n is a, c, g, or t
cctaacattttcggcggcttttagaacataaaaatntggagccttaataaatctaaaaaattattataatcagattatttatatcattttttaccctttttagcaatgcttagtgttgtgaagggtttaagactgcttgacaaagtccgtacatggtatgcaccttaagcaataacaaatgatcatttagttaatgctgctgttgctgttatctcacatgagtgctgtagaaacaatgataaaattatgaaaaatttcattagaattattctagaaaaataaataattgttttgaattttcttaaaattttattttggccaacaaattgactagcattttattcattaataaagggaagtgaaatctctcagttacacgtcagaaatcgtttgaaaaaattggatgcgacattgattaattttgcattttaaaaagtaaaaagatgaaaagaaattataaaaaatgacttctataagatatgcaataattagggctgggaatttaagtcaaatgacttttttttgctgattcaaaatagtcttaaaatgacttaaaagggttctacactttgtttgaacatgtttttttgtgacttttttatactttttgggatttttatgacttacttgcacttttcgtggcttttttaatgttcttaagtagggttgctccccacccctcggggggcaaaatgtcgggggcaggggacctcggggggcgacatgtcgagggtcggagcggggaggtgctcaattgtcgggggtcgggggccccgatcggggaatgaccaaattttattttaaccccaaaaaaaccaatttttctttttaaatgctcgtcaatcttcttttttcactttaatcatcttatttcatagcgccagtaagagtgagtccaagctggcgcctttaaacctgggcttccatttgttctaatgtataagaatgttctgattttggggtagcgactaaaatta

SEQ ID NO: 36136 - DNA, 798 bp, Heterodera glycines
caagcgtcaaatgttcaattgggtaaaaaagccaatgatgtaatcattttggcattcatttgaaagaccgggtcagaattgtagcgctaaaattggaatggaaattaaaagtgacagcgttgaaggaaaaacctcaacaaggtgttcagtagcaagacgctttttgaaattacggacaagatgaaaaaagcatcctgacagttcacaattcgaaaacacttcttttacagcaccgatgattcctgcttcaaagtcaaccgaaattgagtcaggacgaaaattaggccagaaagacacaaccatccgaaaaaagcgggcataggtctcctttgtttttgtagtaagtagcccgtacaaaactgggaaaacccattgttcacgcctaaaatcattaaaaaataattgtttacaaattaaaatgtacctcgcaagaactgcgaacacctgttaaaaaagcggtggtgcgattgtaaaagtgccatcaacgtacacagttcgcatttgctgtgcccaactgccatttgactcttttccgaaaattagaattctaaatttttaaattataaacggataatgggttttgtttccttaccgttcagttgtctgtcgtcctgcttctctgtaaatccctgaatcagcgagcaaaaaatgttcctcccgctcatcacttcttttgtagcgcgtgtagtcgtcacgaatctgtaaagcggcaacattgtctggaatgaccggtggagtgtgttccttgtgccggacacgcttcacaacctaaaacattgattgaaaatgacaaaattc

SEQ ID NO: 36137 - DNA, 688 bp, Heterodera glycines
tgggttgagtcccagtgattgaaatgttggtgggtcgtgtcccagtgattggaatgctggtgggttgagtcccagtgattgaaatgctggtgggttgagtcccagtgattgaaatgatgttgggttgagtcccagtgattggaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattggaatgctggtgggttgagtcccagtgattgaaatgttggtgggttgagtcccagtgattggaatgctggtgggttgagtcccagtcattgaaatgttggtgggttgagtcccagtgattgaaatgctggtgggttgagtcccagtgattgaaatgatgttgggttgagtcccagtgattggaatgctggtgggttgagtcccagtgattggaatgctggtgggttgagtcccagtgattggaatgctggtgggttgagtcccagtgattgtaatgctggtgggttgagtcccagtgattgaaatgttggtgggttgagtcccagcgattgaaatgctggtgggttgagtcccagtgattgaaatgctgatgggttgagtcccagtgattggaatgct

SEQ ID NO: 36138 - DNA, 947 bp, Heterodera glycines
ttttattgtttccatgcattttctgggaaatcttttcgcgaaaagtgaaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaagtgtctaaaaatttttgttgttaatattcagaaaacgtgttttttttagtgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgtttaaagcaaacccgaaactgataggaaagttaaattgatcataatagaagtttaatttttat

SEQ ID NO: 36139 - DNA, 470 bp, Heterodera glycines
tccgggcccggcctctcaaaaaccggtcaaaccggaaaaacggtcaaaccggatttttccaaaaatcaccggttccggtttccgggcccggtaaaaaccggtaccgggcccggcccggctcggtctctaatatttatgcgcatattttggtcagttttcgtgcatattttttgcacgggccatgacgttttcgcgtggttgcatataaaagagaattcataactcacatattttttgttatactatttatgtgtttttataaaattttaattattttttccatttgacgcacatccgaccaaactgacaaattactgtagaagatactagccgcaagaaataaaaaaattaaaaagttaagaaatttgtccgaattcgggttcgggattcgaaacatggatgttttgcacaaatccgaccaatttcagtcctaaacaggtactcacgcgaaaacctaccccacgcgaaaa

SEQ ID NO: 36140 - DNA, 1106 bp, Heterodera glycines
gggaaaaataaaaaaataataatttattatattcttaaaaagtaacattgcccaagtgtgcaaatgccctaatgtctagtctccttgactttcccttcttctttcccttggttcaatccctctacagaaattaaattattttgaattttctttttgtatactcgtgggtttcctatagagaaaatatgattactcatagttttttttaaattgatacatattttatcattttttaaatgaaaatccatagtaaattgttgagcctattaatcccaaaaaccaaccttttttgttgaaaatctgttaacaaattgcacccaaatttttaaaatttcccccggcggcgcctatcggcaccgccggaccccttctttcccaaaagttttttgaaaaagcgctccgaaaaaaagtgatgtgaaaatcaaatctgaatttctattaatattcgatgatttaatccaaaaatgattaattgtttgaaataattgaagaaaatttgtttgaaaattttcattaatttaatttattaaataaaaaaccaaataattttgtattattttcacttgatataaattaaaatttgaatttttttttaaatttttaaaatttttttgaatttttaaaatttcccggttggtcccggttcccggtttttcttgcggtcccggtcccgaaaaaaaatcgaggtcccggtcccggtcccggcttctcaggtcccggcaagtcccggtcccggttttggcaaaaattcccggtcccgtggcactctactttttatttattagcatttcttagtataaataaaatactgatattatttttctttaaacctaccgtactttattgctaccgtatccccccttttctgttgattctttggcaaaatgttttttacaattcatcatcatcatcatccatcaccttctcaattgacaccacatctgctgtcattttcttttcattctgccgattgtcgtcgtccattcctttccccgtctgtccgtcccattttttgtcccatcgttttttgttgtttatccgatcggtcggtctttgccctctcaattaggaaatctgaccatttccattggctttttgtttatttc

SEQ ID NO: 36141 - DNA, 1061 bp, Heterodera glycines
tttttctaaaattttagccaaatattttaataatatttaaaaaattatataaaataattattgtagtttgtttttttatattctttaataaatgttttgagatatcttctattcataattaattttttttgcattttaaaaaagaaatccaatgaatacaaatacaaaataaataaataaactgaaaattaaaatatttatgcgttaaatttatgttcgagaaaacaatttcaatattgcacaaaaacaatttgtcaaatgatcaaaacattattaggcccaggaaatttcaaatttgcgcgtctcgctgcgagaatgaaaactcaattttaattttgggtacaaaaagcgaatctgaattctaaattttttgagatatccttatattcttaatttctttttttacctttaaaaagtaaatttttaaatgccctaacacaattttatagaaggaattaatcaatttaattgctcgttgatctgaatcattataaataatatgcaatttaattcgatttgattttcaaatgacaaataatttgcaataaaaacattgtaaattttcaaattgtgaatcgtttacatgtttttcttcattcctttttagattttccagtctttcttttgctttatcgtcaatatgttgcctttgtctaaatttggttaaattcaaaaaatttatcaactgaaatgtttgtaaaaccatttttaaatttaaaaaaaaattaaaaattaatgtattttattacattttgtaaagaatatattatttaaacgggaaaattaagtgtgaaacattaaaaactttaacaaaattttgataaaataaaaaatcaattttataatcaaattatgggactaaggctgtgcagcagcgaaattcaaattttctagcaaaatactcttgctagttaaaaaacttaattgctaaatgaaatctctaaagatgggttaattaatccatatttgcgtattctgcatatcccatagttgctgcaatatttggggccgaaactgcgacatggagaaatgaggatcgatggtgctatgtccttataaaa

SEQ ID NO: 36142 - DNA, 1487 bp, Heterodera glycines
ctgaaaaatttattatttgaatttacaattattaggaacagaacagaaatgttcatgcgatggatgctaggtcgaaccgcaataagtattaatgttaataaaaataattaaatttaattatattagtatttatatataaactaataaagagtaatacaaattccacatttttattctaaatttttgcataaatttattttcatttcattgtggaagtccctgcaattgtgtgacactatgcaagaataaaatggaatgggttgaaattttgggactaaaaattgcttcatttatggacaacaatgtaaaaaaaggataaacaaaaaatgatgacatggaatttaaaataaaaataataaaataaatttagatttacgtggtgtccaaggttgctaacacgtaaaatttgtatgttgaaattattactatttcacaagttaaaattgctatcgaaaatcattgaatcgtaaaattaaatttaattatttttattgacactgagattttttgcggttcatctcagcacgtgttcatgttattgttaaatacgacctcaatgttatactttttgccaaatttttttccattttttatatcatattcctgatgtcgtaaatatgatatgacgacagaaaacatttataatttgaaacagaaatttcaaaatatgacaccagatcagtgataagacggaaattgaaagaagccccagggaaactctctcattttgggctttttaaaaatttaccaccttttttgctttgattttcttcggtttgaatgttgtgctgtcttcccgttggcttcccaacaatgtctccagtgcatattgaaaatccttctcgccaggtccttccgtttcgtctttaagccgtgccaacaaatcattgccatacattgtatggtacacactccaaatttctcggttatttttgcgtgttgtcaaaatctatgtaattaatttaaaagcatgatcgggagggatggggaattcgtccagacatttgcgccccgccggacatttgcgcctcggacatttgtgcctatgtccaaaatcggactcaaacatacattttttcaatcttagagatcctaaacagcttaaatttaataaaactcgttctttcggtttattaggaacataattatgatttttgaaagattatagttattctttcaaaaattatacaataactttaaatcgtttatttaaagctgtttaggctgggaaagggtcattttggcgccgacgttttggcgccagggtcgttttggcgcccacgttttggcgccaagccatataccttaaaagggtaaatttttgatcaaaaattttacagattaaaattttaccttccaatgggcttactctaattttcaaaaaaaaaaaattcccaaccccataaatttttttttggtaaaatcctaattttgattttttatataaattatatatatcattcgattcgtctcgatgagacaaatcg

SEQ ID NO: 36143 - DNA, 670 bp, Heterodera glycines
aacaaattctaaaaaaaggtaaacagtaagcttcattagcaaagggacagtgaaattttcataatatttaagctaacaatttattctaaagggaaatctcatttttcgcagttgctgggggggggggggaggggagcacaatgaatgggaaatggaaataaatggaaaaaaagaatggggtaggggggggggggacagatggatcacccgccgatgacaaaatctttgtttatgtgttgatgatggatgttacaaatagggttcgagcctggcccccgtcacccccgcctccccgggcgcgggacatggtttttggcctcaccccgcccccgtgactcagacccccgcccccgcgaccttcaccctcgcggggctgaaaatacacccctaagaatggcatattcgtgggataaaagacaaaaaacttattcaattttgaattttttaaccaccttgaaccagaaatccaagcccaggcatgaaaaaatgtatttttttaatcaatttttcatcatttatggtgaaaaactgataaattttatatggaaatcggatattccgacagcaatgagcaaaattaaaaaacaagcagcttttttgaacatggatgacattctcgacactaaaattgccggtactaattataacgattggagtgtgcaaatcgaat

SEQ ID NO: 36144 - DNA, 1251 bp, Heterodera glycines
  misc_feature (388)..(388): n is a, c, g, or t
cctttcccaaattaaatcatcaattttgtgctacgaatcctattcttaccagtgcaaatttttatcggcggtgccagtaccggtctactcaaaacttactagttttagcgaaaaatcaacctgaaaaacgaaattctcgcttttcattttttacctctttctttacacaattatatgacttatagaacttttcaatatttaaaagcgacaaatttatgtattacaaatttcagaattttaaacaaatacccaatcaatgaccaaatttatgaaaataaatagggggagttctaaaaagtttttttttcggaatataaatagcaaatgccatcgctaaagatcgtcgtaacatctgagttccttgcttatcataattttttatactaancctttaataagtttttaaacaaaatttaaatgtacgtttaagcgatttttatgcgccaaattacacattgaattaattattgaacaaatttatttttacaatttattgtattaacaatttacttcattaataatttcttctatatttggaactgtcaattatttatgagtttatttatatttcttaaatcatatttaatgaaaatttaaaaatacattttgttttattttggttaaattttcaatcggtgtctccatgcatataggtataatctacatcataagatcaaatagcaaagaattaaaaagttaaaaaaaacacttgaaagagtatttcggtggtagaatagatctaatctgccgattagtcaaaatgttttattattttgttttactactcttacttttaatataattatgatatgcttaaataatgattatattttaaaaattcgataattatcctcgatattttgaaaataaataatgtgataattaaatatgaaacgaaatgctgggatgttctagttaatttattaaatattagtacaaatgaaacaatcaataatccaaaattaatatattcaaaaaataatgaataaaatattaaaattaattggtttttatttatttaaaacaaagagaaaattgagctaatactgaaatagttaaacatttaagtgcttatgattaataattcgttctttttttattttatacaaaaaaatgtataacatttataccttataaatataagaatacaacagaaaaaaaaaaatctaattattaatatgaaaaacttcaaataattgatattaaaataaatatacttacaaataaattttaaaggtcgacaaagcggca

SEQ ID NO: 36145 - DNA, 781 bp, Heterodera glycines
cataatgtccgcacattttcgagctcaaattaaattggcatttgaagaggccgaagaaatccttgatgatcccaaatatttcccagttcctgtacaaccccatggacaatccgaatccgcttatgttagaattgtaaaggcactaattaaaaccctggatgaaagggcaaatgatacgaattctattttgtccgaattgaatggcccttccgacagatggatgtcccttcgttccagtatgacagccgcagagagagctgtagatacccctctttatgatacctttgtggcagaaaccccatatctaaagtctatctcatcccttcgcaaatatgcccgaacccttcgtgaccaaaggagcagtttggaagccgttctactccgtcctaccaatcaacccaatcctaactccaatccgtcctcttccctaatccatttaccaaaaacggaccttcccgtattttcgggtgattgtactacctatacatcattttggaacacgttcaaagcaggcgtacatgaccttaacatccctgaatccctgaagtttacttatttgaaacagtgtttgtcaggccctcccttaactctaattaattccctccctgtcactgacgattcatatgttgccgcagttggcctattatcccagcattatgataaccccgaagaagttgcccgtgctttacacaattcgttgcgaaaacttccacgggtccatggtggcgaatcattttgtgatgacttacgttcactcattgaccaattagaagactctaga

SEQ ID NO: 36146 - DNA, 877 bp, Heterodera glycines
ttaaaaaaaattaaatagtgcctttcattttacatgtaattaatcctttatttatttctttttatttccaggtgcttcctgccgatttgatgcccattccgatggaatttgcattacccgaccacacccgtttgtccttggttgatttccctctacatctgccgcttgaactgcttcaaattgatgccatccttcaaatactcactgcaataatgcttgaatacaaagtaaattagtttgaaaaatattcaaaaattcttttgtttttgtgtaaaattttaatttttaaattattatcataaattattcattgcctttttaagtctaacaaaaaatttcaattctaatattatttacccttcaaatatgtgggtaccaaacagggacggcgttccgaggcccctaatatttcggaaattgaatgcttgaacccaaaatatggaaaagccggttttcgccaaaaaaattactaccttattttgttaagaaatgtgctaattttcaataaatttgcccatttttcatgaaactttttacaaattctttataaaatacgcaaattccaggtcattttgcagtcgcgcaactgtaacgcagtcagtgtttgcgtgatggcattggtggcacttttatatccgttagagtatgtacaataaaaattagggttgcgtccccgaccccgaaccccgacatttttggccattttcggggaaaaccccgaaccccaacccccgacgcttccaacccccgacaaccccgacccttaaaccccgatcggggtcggggttaaatatacacccctaagaatggcatttttgtgggggaaaaagcaaaacatttatacaaaaatgatttttttaacatcttgacaaatttt

SEQ ID NO: 36147 - DNA, 915 bp, Heterodera glycines
cgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggggcgaaggcccaccacgaggccgcgaagaggccgagtgagtaccttcggcgcaggaaaattattaaattttaaaattttttaattgcctttttaaatatgccaaaaagtgtaggcttaacttttttagtgaaaattcgatcactcatattttttgctaactgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttatttgaaaaaaagactttacaaaataatacccctgggagaagggagtggaaa

SEQ ID NO: 36148 - DNA, 1214 bp, Heterodera glycines
  misc_feature (543)..(543): n is a, c, g, or t
  misc_feature (569)..(569): n is a, c, g, or t
  misc_feature (592)..(592): n is a, c, g, or t
  misc_feature (601)..(601): n is a, c, g, or t
  misc_feature (638)..(638): n is a, c, g, or t
ttgaacaagttgtaatcattgccctttgtcagttccatcgaattttccaatatttcctaaatcaaatcatattgtcggacactttcaaatgtcgccgataatttgagagggcagtaaaaagccaaaaaatgaaagcagagaaaagcaaagtaaaaatgacaattagaagaaacattgtgaataggtatttgaataaatattagcaattaaataatatattttctaaattttagaaatattttattgagtgaatgcaaatcccgtgaacgatttacatttcagccatttttggccaatgatttcaaaaagcgcttttttgttgacctttgcacaaattcacgtgctttgccgttgaaaatgtccgtgtactgcttcaacttagcaaagtgaaaagttggcgtcagaatgcgtcgctgtcttttccattttgcatcggtgctcagcagcaaaccctcgcccagccactgcttgaacaagttgtaatcattgccctttgtcagttccatcgaattttccaatatttcctaaatcaaatcatattcnccttgaaatttcatttaattttactntggcactctctgaatccaatgcncaaatgtgnagctcagaggcaaaccaccagcacatcgcattgtgcncatcgcgaagtgcccgatttgcatggccaattagaaactccggcacatctgctcattttgaagattaattaaaaatgaaatattgtcatataaatgtgagaccatatctagattttgggaacaggtggagatgaccgatcagcggaaccctggcaatttgccaaaaattgtcggacactttcaaaagtcgccgataatttgaaaaggcagtaaaaagccaaaaaatgaaagcagagaaaagcaaagtaaaaagggcaatcagcagaaacattatgaatatttgaataatattaacaattaaataatatttttatctaaattttttaaatatttcatttaattgattattttggaataaaacggaaaggtaaaggaataaaaataatcgaatcgaaacaattcgcccgagtccggtcgatcattcatcatttgcacctgaactgcaattatctatctcttttattatttgttttggtatttagcaattttataatttattttggtgtttttttattaattacaaaaacgggacgaaaatggagaacaaaaaggatagagaaaaaaacggacgaaaaa

SEQ ID NO: 36149 - DNA, 719 bp, Heterodera glycines
attagaacattttagaaaattaaatttttttttgcatatattgctaaagcattgactatttataaaactcatcaaattcattatagactcaaaagctctgccggatttaatctattttattttattttcatcggcattttgcacccatttaattttaatttttatccgagaaaaatgtggatgagatgccttgtggatgagttgccttgtggacgacttgactgtgggatgacctgaccccaatttttttgtgccttatttctttttataatttcatgccttttatttaatgtttttcacctttttcgtgcctatttttagtgaaaaatttcgtgccaaaaattcgggctcactgcattaattagttttagagtagggcgctttttgtttaatcaattattcattaaccagctgttgttagccacagtgagttgtgcttacttcctcggcataatcaattaattttttatttttttggtgcccaattaagcattttattttactgcacacggctgtcattaaaaggagtaaaaataatttatactccaattattacaatggaaaaagaaataaattaatggggaaaaatttgggagtgtacaaaatttgaagaaaaaaatctcaaggattatttaatttttttgatctttttttcagttttgtatcgaaaaaatcaattgaacggcccaatgtccagtctctagcaagatttaactttt

SEQ ID NO: 36150 - DNA, 1055 bp, Heterodera glycines
gagagagagagagagagagagctgtttgatattccccatcctttccgaggcaatccctccattgttctcttcctccctctccatgtccactctagcgcaccattgtgcggaaagctatcgacggcaatcataggattggattgcactggtcaggggggagggggcggcaagtggggcgcggggggcgacttgccatgtccgccggaagaggcggggccaagccgacggccggcgatttaagagagcccggagactgcgcactttgcatcggaggagtggccaagcaaagaatgcgtaggactgtgtctggcaaaacaattcccaaccaaaagaacactcggcccagcacaaattccatcagaatgtcactgggaaggaacaaatcatttgccccggggcttttgctgataattcttccgctgatcagtttcaacggacaaatcgcgatcgcttcacccattcccaacgccaaagaaagaaacaacgaaatacaagcacaggcatatgatccatcagcagggaagttggcagagtttggagcgagagaaagacgccaaaacgcgatgctttgctgctgtcagatgggcgcaggcgggggacctcaaatgccaccaccgatgggaccacagatgcctcctcaaatgcccttaggaccacaaatgccaccacctatgggacaacaaatgccattgggaccacaattggcaccaccgatgggatcacagatgccacctcaaatgccattaggaccacaaatggctccaccgatgggaccatcgctgggacctcaaatgccaccacctatgggacaacaaatgccattgggaccacaattggcaccaccgatgggaccacagatgccacctcaaatgccattaggaccacaaatggctccaccgatgggaccacaaatgccaccaccaccaccaggccaagcgaatatgggtaaggaaagcattgtcagtgatgaaaacagctcaaatgttctacgaagaccaatgttgctgctgttggggtggtccgccgggccctcccccgcaaatggcgccgccggg

SEQ ID NO: 36151 - DNA, 1340 bp, Heterodera glycines
caacaaaaatttttagacagtttataaagaggaaggaaaaaaatttttcatttgcctaatatttatttatactgttgaactgttggaaatgcagctgatgccgtcggaaaagctccgattttttggggaagtttttttctttcagtttcaccactgattgttgaggcaattttttcgccaatttcttttgtctacaaacattatttattgcgtttcatcctgtagtgtgtaaaaaattttcagtaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggccatcagcgggttgtttcgtgacaaaaacaaaccagtttgatgttattcgaatgagctagacgcgctctacattgtcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcactaaaaaaaacacgttttctgaatattaacaacaaaaatttttagacagtttctaaagaggaaggaaaaaaatttttcatttgcctaatatttatttatactgttgaa

SEQ ID NO: 36152 - DNA, 884 bp, Heterodera glycines
tagaatttttcttttaaacatttttcggcggggggaaacaagctctcccattttcccaaccacgaaaaatttttctaacggagtttggcgccaactcctaattactcccataggcgtcattagtttcttttcctaattcggattgctgttttcatttttcagcggatgatgttgacgatttggcaccggtgccgccgaatgcgcgcagcacactgtacgagccgaagatgtccagcgtggacttggacctgtaccagccgagccgggcaaaggacgtgcagacgctgtaccgggagtacgcactgttgcgcgagacggagcccgactgtcccagcctggacatcagcgacatcacactgtgtgtacactgtacagtacacccaaggggggtgaggtgcacaattcatcccctccctcccctcccgccgtttcccccgtaaaatcttaagaaaattttcaaaaatttgggggaaaaattagaaaaattttcagctattttttgggcaaacgttagaaaaagttatagaaagtctttaaattttctcatataaaattttataattttttaaaaatttaaaaattggggagggaacgagctgctcccagtgggacctgaggctccaagaaagccggaaccaaatttcacctaacaataagcgcttggttgatctcgcaaaaattcgactcatcgaaaaatttaaatttgcctaatcatcactctgatttgctgaaataaaatgttttttaaatttactaaaaatttcatcaattttctcggacaatgcattcaaagccaccaaattgtcagatggaacttcgtgctgaaaataataaaaccaaacattttttcagtgaagaagtgtacgaacggggcgggcattctc

SEQ ID NO: 36153 - DNA, 881 bp, Heterodera glycines
aaaaaaaaaataataggttgggactcccataataattagaatttttaaaatgtgtctgataaaagcaaaactgttgtgaaaaattgttatatcccctctcagagaagagatagaaaaaaaataaaaataggtttagagagcccgtgaacagctgcatcggatgcaagtgcccccgttgctgtacccctaacatttggtgagcaatgagggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagactagtcaaaaaaaataataataggcttggactactatactaattagaaattttagaatgtgtctgttaaatgcaaaactgttgtgaaaaattgttataactcctttcagagaagagatagaaaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagactagtcaaaaaaaaaaataataggcttggactaccatactaattataaattttacaatgtgtctgttaaatgcaaaaactgttgttgaaaaattgttataagtcctttcagagaagagatagaaaaaaaa

SEQ ID NO: 36154 - DNA, 551 bp, Heterodera glycines
aaaagttatccaatttaaaataatccaggtgccaaaatttcattaaatatttttgctgctgcgtataaaaaaaaaattaaaaaacaaatttatggtggacaaaagcattgcagcaaacaaaatttttttgttttttttgaaaaacgtgttttcaaagggatgagtttttgatgcaatacttttgtcttagactgtaccatcaaaaaaataataatgagaaattggaaaaccgaaaaagatatttagagcatgggttgaaattgaaaatcattcttatcatgttgagcatgtgccaaccttcgtcttttttgaccatctcccaaaactgatcaaaaaaaaaattggtcaaacttcgggaaaataattttcatttttaaaattcataaaaaattttaaaataaagttttaaccaataaactttttttttaatatcaaaagtatgataaaacaaaaatgatatggtagtatatatggaagataaaaacctataagcaattcaccatcattagtgaaggggatctcgaaccccatgacagagttatcatcaaaat

SEQ ID NO: 36155 - DNA, 829 bp, Heterodera glycines
  misc_feature (777)..(777): n is a, c, g, or t
ttggaacgccgcgcacgcgttgaattggcattgttttttgggtttgtctgttggtgacgagcggaagaatgctttcgtttgctgtccatgccaaattcgaattgcgaatgagtcggcgtctgctgagaatgaagtttagtttttataagattgcacaataattttgagaattgccaaaaaagaattttaaattaaattagaattttggtccaataattgtaaatcgaaaaaactttttctctaaaactaaaagtccgttccattcgatttccaaacgcacctccttctcctcctccttctcaacctcttccttctccttttcttcccgctgttcttcgccttcgttctgctgaatgccctcgtcgaatgctttgcccaaattcgccacaagtgtcacttgttgtgagattttctcgtccgtctctttctttctgtccaataattcaatgcatttgttccactcagaaggctcttcggtgttctaaaattaatattcataaaaaccaaaatttattttagttaaaatgccaattagaaaatagttaagatggagggtcccgtttttcaaaaaaaaaattgcaactttttttacagttttcagtcagagaatccgaaactgacaccccattccgaagcccgaactcgaacagaaagtcacaaattattttcaacaaattcgcatttcaacgaaaccggcctaaatgcacgaaagtaggcaaccctggtgtcataacaactcgtacaatttctaaggttaggcctaggttttgggcttangcttgctttcgtgtttaggctttattttgaaatatgagttgccttttgtacg

SEQ ID NO: 36156 - DNA, 945 bp, Heterodera glycines
atagaaaaagcatcagagtgcctaaactaacatgtaaatatatttggtgcgtttcagagcattttctgaaaaaatatttatgaaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggaataaaaattatttaaatgaactgactagataatatttaaaataggttatttctcttcctttcagtatccctgcaaagtttgctgcgcttctgatcagtttctgaaaaaaaagttaagcctaaactttttggcctgccgaaaaaggaaaaaaaaatttttaaaaattttattcatctccctttttgatagaaaaaacatcagagtgcctaaactaacatgtaaataaaatttggtgcgcttctgatcagtttctgaaaaaaagttaagcctaaactttttgggctgtttaaaaaggaattaaaaattttttaaaaattattcatctccctttttgatagaaaagcatc

SEQ ID NO: 36157 - DNA, 964 bp, Heterodera glycines
attaaatgggtaagtttctaaaaattttgagcaattatttcagaaatcatttgtaaaatggatccaaaaataatcaaaaatgttattttagcccccaaaaaataaaccacccccaaaaaagtgccaccaacatgggagttgatcaacagggtcttcagcaagttcatctgatagtggcgaatgtaatggtcgtacagcactcgccggtggtccctcagttggacttgttcgggtgaactgaagtaaccatctgaagattgaggattttgaaaacaaaaattgtttatagaattttaaattagataaataaatgtttttggaattatttttccttccaaatttttttttctaaatttatacgtaaatttcctcccacaatgtgaaaccattgaaccttagctttttctctagggcccaattttcaaaactcttccatctttgttcgccttacttcgaatgcgcgcaaaaaatttggccaacggattgccaaagcaaaaatttgggtcgctggtgaatgcgcaactgagcaactcgtcgagcggggcgccacaattgcgacgagcgacagaaactgacgatgatttaatggcggacgaaatggaagggaggggaagaaaatgctgaaaaggaagcaaaaatgggaaaatttaacgaaaaaaggagggaaaatttaagggtccaaggatgttttccggtatctgtttgcatgttccgcagctaaaattttgaaattgctaacttcgagcacaattccgaatgtttttgatgggttttgccacaatttaaaaaggaaaatttggtgaaattcgtcccggattttttgaaattccgtaagcaaacctcgaggtggtcgcgcgacgcctgcgaaagagaccaaaacgattttggacagagcacagaacgaaagattttctcctaaatggaggaaatatcttaattgcatataaaatttaagagcaatgga

SEQ ID NO: 36158 - DNA, 830 bp, Heterodera glycines
  misc_feature (38)..(38): n is a, c, g, or t
tttgttttcgggggcagtccccccgaacccgatgcgcncagatttatggggagaccgaatcctttcgggaatagcttccctatagcctgtactataattctgcgttggatttttgctccccataattgtttgagtaccccaaacggacacttgaaaaaatcgatttttttgttttcggggcagtccccccgaaccgatgcgcccagatttatggggagaccgaatccttccggaatagtttccctatagcctgtactttaattctgcgttggattgttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgatttttttgttt

SEQ ID NO: 36159 - DNA, 707 bp, Heterodera glycines
gtccattttatcttcatccaaaacccaacggcctacgccgcccccgtcaattcccacacgctagtttatatatatatagaataaaaggggaactcactaaaaaaattaaggctcccggccgaaggccgggagcgccctgaaagtagtggaagggtcttacaactttttgaggcgcatctgggaaaactataggttttttgctccggtggccaactgagtcccggcggctaatttctcacttttgcttgcgtttgaaggcccgtaactttttttaaaggacagggagcggaaaattcttgctggtaggattttaagttgaagtgttttctaattttcaaaaaaaattccaggcctctacctatacttggaagggctgcagaaattggcaacttttcagtaccaactttttccagttcagtccccgttgaataactcattaggctttgacctgagcgcagggtggccagcagacttattgtagagttttggaacctcgattttctgaaatttaaaaatttcgaaaattttcaaaatttttcgagctaggtctacaaaacggttttccgggtttttggattttaggattttttaacgatttttcccagaaaaacgaagcccccttccaaacataatttttcaagctttttcgctggaatttttttcgaaaaatttcaattttttccccgaaataaaaaaaaattttggcc

SEQ ID NO: 36160 - DNA, 609 bp, Heterodera glycines
cgttaattttatattttatattttcttttttcattaaaaatatttatttaccataccttcaacaggactctcgtgctgttagaccgaaacggaaaaatttgtaatttgagttttgtccaaaattttgaatcccggacccgaactcgaacaaaattcgaaattttaaataccaagttatccttacatgaaaaatttatttaaaactctcgttacttgatggaaaatcatagacaaaatcaaagattttccgaattctggactcagactcgtaatcagggtatttttaacactagaaaccccgaaagaaaaatttttaaatttttttttcgccgggacaccaattctccagtattaccaagcatcatgtgctgaaaatgctaatgcgcagagttaattaatcgattatttttttaaatgttaagtatatatatatataacgcacttattctatgaatttatacaggaattgcggtccattttattggatccaaactcacaaatgccgactgaaacaacggaatccaacgaaaagaaagaaaatcccgaagacatttcgagcactgtgttctttgagcatcagcaggaattattgaacgagacagtttcgag

SEQ ID NO: 36161 - DNA, 439 bp, Heterodera glycines
ttttaattggaaaaccaagttttcaaggagccaaatcttttttctttttcctgaatatgtttgccgtttttcagggcaacggaaaacataaaaaaacaaaaaagttttggaaaaattgaagtataggcctagtagcctgctgggcaatgagccttatttttcaaaataaaagaaaatatttggtgagtgttttgtcgcgacagacaccacattttcaggaaatgaccataccgaacaaaacttagccaaaatgatgtccaatttccccttgaaagagggacgcccccctccaaaaactctcagaaaaattttcgatttagaaaaaaggcgctagttaaaagaaggtacatttttaacattttttcgcactttttttggtctatttttaaaaaaaaaaaatttcgcattaaaagtcctctatctgagtatccgatggtta

SEQ ID NO: 36162 - DNA, 1436 bp, Heterodera glycines
  misc_feature (1364)..(1364): n is a, c, g, or t
aaatccgattccgattaaatcgccgattccgattatggccaaaaatccgattaattgcgattccgattacgattccgatttttttttaataattttttcccaaaaattttattcataatcaaaaccataaattttaagattgtgatgcaaaaataaaagtttgtacacattctcaggcaataaacgttttctcagatctgtcacaatcaacccagcggtggagaattttcccagatatttgacatttttgctaaataacaaaaaacttgattatatcggggagaattaatccggcactgctttgtgagaaagatttaatttcagtcattatgttaaaataagattaaaacattcgtttcagtaaacatttttttcaaaattcattggtattctcactaaaaaaattccttcaaaaggtcaattcttaggggtgtaataatcggatttcaaggcaaaatccgattacgattatccgattccgattatggcccaaaatccgattaattgcgattccgattacgattccgattcggcacatccctggtatgtgccgtcccccccccctttccccgcttttcctccttattcgccctttatattaagttttgcaaagttttggcgttctgattactaaataataaacctatttgcactgagagcccaaaattgggccgctgtgtatattacaaaaagagcactatttagagaagggtcgaaaaaatcaaagtggggttcgagaaccaaacgatggatcctttttaaggaacaaaaatggataggctaaatgccttcgagactgaaccgtcgagtgggtaaaacatataatgttcaacaaaatctaaaacggttcccctcatttggagtttacccatcttttgtctaaaaaattctttcgaatttggcatttacagaccgagagacgtcaaatgatatatcatttatagaattgaatgaggcacacttttattagaatggcagattggatgcttcgaaaataaatttacaaacaataattatgacttctctctttctctatcaccctccgttattcgtgcgcacaatcagctgctcccgtcccttcccaactccgatgtattcgacgggtacgcccagttgattttgtatgaactccaaataggcacggcatttgtccggcaactgttcccactgacgggcactggtcgttggcgactgctccgcctccttctccttctccgcctcctcctgcgtctcctcctccatcttctccgtcgtcgtcaccaccgcctgtttcggtggcttcgaaaataccaagcattccgctcacaatgctcgcctggctgtggcgatggcggtcgagcctccttcggctttttcgaccctgnggtggacagggggaggagggaattacgatgaacataaatgggaaaattacactcatttctcccttctctccc

SEQ ID NO: 36163 - DNA, 989 bp, Heterodera glycines
tttaagccaagttatgaatttatatgtcttacattttttgtttttctaccccttggcggatttaaaaaacgccctggcggatttaagaaacgcccaatgtggcggaatttaagaaacgacctagcaccctcactgcagcgttgaaaaatgtttgttgaataaagcttaaaaaataaagaaaagtcaggagaatttttccattttattatgtttttcaaagctaaagatgaaaaaagtttccagaaatcctggaaattcgatttttcagaaaaaaattcaaggtgcacttcgttggtgctaggtcgtttcgtttcctaaaactgccaagttggtgtttcctaaaaactgtctagttgtaaaaaataaaaaatgtaaaacaaataaattcgtatcttaggtcaatttcaaccaaattaatatttcatggtatcattcaatagctctatgtattttatatattttttctttgattttcttataaaaactttctaagatttttttcgaaaaatttttgtttgtaaattataaaaaattttctcggagtggaaacgatgcgaggggtggggacggcggagggaaacgagctgctcccaaaattcgaagtcctttctggagagagttttcacaaattaaaatagttgaaaaactcgtaatttgttgttttataagagatattttatttatattttatctctttttttgaagaattttaaaaataaaactcttttggggtttggaaccattgaccaaaacaatgttcttatgaaaaaacacatttttatttgtcaattaggaattcaactagtttattgtttcaatttagaattaattaatttcctattaaaatatcaaaaaaaaaatttctcgaaaaattaaaaattccatttatcccccggggggataaatggagacggaggattatttttcaaactccccagaaaggggtggggggtaattggagaccagtgtgattaatggagacagagggg

SEQ ID NO: 36164 - DNA, 1377 bp, Heterodera glycines
tttattaactcaaaaaagatttctgagtcggataatgttcgtgacttgggcattataattgactcgaaacttaatttttcagaacacataagcaaaattgtacgaaacgcatatcttagaagctttcagattttgagagtgttgaaaagcagggaaataaagactctaacagcagcttataaaacttttgtacgacctcaattacaatacgctaccgaagtttggaaccctaatttaaaaaaagatatagacaaaattgagcgggtacaaaaatttttcacaagaaaagtttttcgaaaatgtggatttgtgtacaaaaaatatgtggaaagacttaaaatcgcgggtttacataaattagaagaaagaagaaaaattaatgatttgacaacagcttttaaaattattaaagggttcgccagcctagaggctgagcaaaatttctttttctcagaaaggcccaggaggcctttacttttacgagtaaagcgccacacggccaaaacacaaaataattttttcataggatagtaagaaactggaataaccttccagtggtagcggtgcaaattaataaggcaaaggaattcaggggtttactaaaagcaatgagttctgagtaggaaattttctgtgccacatatacactatattttaatcacctgtgaatttttaacatttgatttatttttattagagttgagcggtaatcggtaattgcaaaaaaaccggtaccggtactgaccggtactgcaaaaaccggtaccggtaccggtaccaactttttcaaccggtaccggtaccggtaccggtaaaaaccggtaattttagaacataaaaatttttggacaaaatttttcaaatacaaaatttttattcagttttcgcgcgagtgcctgttttttagcattagaattgttcagaagtatatgtatattcaggttgaccaagtttttttgatcaaaatataggtggtcaaaagtgttgtcccatttcatttttaaaatattgcttctctggatcagcattaaaaaaatctaaaaaaattcaggtaagcataactttggatgctgatcaaaaaaggtagcaacaccaagttgatcagatcactccttcatggtgatctgatcagcccattttggctgggaacgaggggtaaatttcaaaaaaaatttctagggggttgggaaaatttttctgggaaattctgagtaggcccattttatagagcacaaaattggctaccgaattgcctttggaatagtggggctacaatttaagcccgctgagatacctcaacttttaatttcggtgcctataaaaagtaactgtatttcttaaaaaaaaaatggatttttacactacgtcaaaattgaa

SEQ ID NO: 36165 - DNA, 733 bp, Heterodera glycines
cgatttcaacaatggttcgggaattactatcgaacatttgactccacagattaccaggtttagatttgtgttttgaaacgggaaaatctccaagtgtcatttctccttttgtccttcccgcccgggttcaaattttgaagaattacgaatggaactcaccctctgtacctcccccttttaaggttataacgactgttgacaccaaaaaacctcttttggatttctgtgctggttacaccgacaatttcgttggcctcattgaaattggacgatctgatgacgacacaaacttctttaaactttacgagattggacgtcgaagggacttcgatgaggaagaagaagaccaggatgaacaagtgaggggattaacagtcatttattattactgttaaagtaagtatcttaaaatgaatattaagaatccggaagaagaggaggacttttcactgggaagcagttcgccgagcagtagtagcagcagttccaacaattccgacacagaatctcattatccacatgaaaacggaagtataagagacattgaggagggagcagaagaccaggacggacaggtgggagaaatcttcctatttaaaccttaatattctttagtaagatattttaaaaaacaaaaaaaatcatgttgtgtaaaggtttttttaacttgcagatgaaaaaagcttaatttccacagtaaaaccgatttaaatcggtaagactgccttgaccc

SEQ ID NO: 36166 - DNA, 1088 bp, Heterodera glycines
ttttttctaaatttgaaaaaattttctgattatttaaatgtgccatttgcagtttatttttcattatgtgcattaattttagtatgaattttacaattccaaaaatatttttatcagtagcgaattcacatgttttgttggcttttggactggaattctaatttttcaatttactggagatttttttaggcattggaatttcaattttcttacaaaattttaggtatttaggcaaatttttatgttccaattagcagtgattgtgcattttgaatttttatattctcgtaagaattattttggttttctcacatgaaaaaatttaacaaaatgccataaatttgtggaggtgcctctttggcattttgaaatggcaggtgaaaattttaaaaaaacgaccatttattccaaaaataaaaccaacgaacgtcagtcacaacacttattttatttaatatgtatttatttctgccatttcattttttttctcttttatttttccgattgtaaattaaaaaaaaataaatacaaaagattagctaaaaacccgaaaatggcaaaatatggattaagaactgccaaaagttttcggaaaatcatccaattgacgtcagaacagaatttagaaaaggtcaaattccaagaataattgcgcgaagagaattattcacacgcaaccaattccccgccgccagtttattatcaataaaggataaatcattaaaaatatttgatcagcctttttatcagcagcagcggccacacattccaattattaatcattaattagttaattaattggtttaattaattaattggtcattggtgctgagtgctaagctgttctgctggcgggcccgaaatgatcgatgtgttcttgcagcaggagatgacgacgaggagttttgggcaagccggctgcttataatgcaggagaaaatgcatcagcaggggatgtaaggagaaagaaagattttaacttgtgagggcgatggaaatggaaagtagttattgatggggagagaaaaagtgatgaatagtaatacagtgatcaagtaagaataatgagctgttttaaatggaaaaag

SEQ ID NO: 36167 - DNA, 820 bp, Heterodera glycines
aaagtgttcataaagccttcctgctgctcgtttcccacgtccgccagcaccaaaccgtaggcggacagaacgccgtggtggcgatggaccaaaactcggccaatacctcaaatgcgacttttttttctttcctccgccgttttaagaattttccgatatttgcgggcggatataatgaccaatcaaatttcgcattaaaattatatgcttggcatttaaaaaagcaaaagtacaaattgaaatccagaaattattggtcgcaaaacctggaccgcgaaaatttgattttaactgtgtgtaaatgctgccgaatgccgtcccggcccccccccccccccaaaaaaataaatatataaataaacatggcaaatgctcgactcgtcccttttccacaattgaaaatgctttcccaagtgtgctcccccctcaccaagtgtccttgctattgcgcatgcgtgctgtcctcccgcaccgccgaaacagctcaacaaatgttgcgaagtgtcgaagcctttggccttaaccgaaaatgccattctctcgagcctttggcccgacttcagttagtcttcggatgggtctgctcatcgcctcattggccacttggataaagccaagcgccgcttcggacaccgaaatgcgcggccgtcccttttgtgccaattgcgcgttgatttgttctgtcatttcgccaaatgctttcaccgatccctcccttaaatagccaaatcaaaatttaattaatttcgattgtgccaattaaagaaattgtcaatcgttcacttgttcaagcgttggcactcgtcatttccaaaaatgt

SEQ ID NO: 36168 - DNA, 503 bp, Heterodera glycines
tacattaaccaaagggaaaaaagggaattgacaaattaaagtgcacaaatcaaataaaacaataaagcaacgaatgtgaattatgtaattgataaatatgtgagaatatcatttatccggtaaaatccaaaatatttggtgtagctatatgcttacattaacgaataattccttatttgtcataaatagacacagctaatttgccaaaaatttcatcatcaaatgaggcaaggcaattaaacatgtaattatacaatttggcatatttgcatacacaacaacaaacatatgcatgtgtacgtatagcactttttcatcatgctcttcttttatggaagtaaaaatagggagggtggggggaagggatgataaaaaattgtatgtgtggaaaaaagaatggcaaagaaagtgctgaagggggcgggggatttttccgctgctgccactgtcccccgccgttgttgacaacaaaaattgccaaaacacgcgccaccaccacagca

SEQ ID NO: 36169 - DNA, 569 bp, Heterodera glycines
cgtaccattggttccgagacaatttccctaagattttatggccaacatccaacaagtactggaaaagatgagaaaattttataatattgaagaaaatttcactattttgtgccaaaagaaattagcgatgtgcaaatcttccgcagaaaaaagggcgctacaaaatgttttcagctgatttttcactttctgaagattttgccccctggactgcatccactgcagcaccgaaacatcccttcacgagtttggtggaccgtctccgacgacaagccgatcaatacgtcgggttgccatcgtggtaaggaaaagccgacgggaaaaggacgaaaagcacattttccattccacaaattgaggtgccaatgtcacccggttaaaccgcaatgccctccgggcccaccgggactgccgggagagccaggccaagacggacagccgggccaaattggccctccgggggaggacaacacgcaaatgcacagctcccaacaacgcccggggacaacggaaacggcgagcacgaagggcccagcaggaacgccagaggacgcagaaaacaaataaaa

SEQ ID NO: 36170 - DNA, 439 bp, Heterodera glycines
acaattatttcagttggccccgagaaatatatttttctttatagaaaccgggaataattttaaacgattgcgggaccaacaattgacgattttctgtacacattttcggcatttttttttttgcagggccaccgaacggttgacagtcaaatttcacttggacgaggaggtgacgacgacggatggacatcgacggaagcgaaaatacgcggaagccacgggtttatttatttttttaaatttttgctaaaaacatttattttgcaattcttatatttcttttatacactaattgaaaaaaatatatattgttatgttggtttgaacccggaccacccaaaaaatgcaaatttaacaaatctatttgtgagcggcgggtgtcgactgaccgccaaccaactgggcgccagctcgatttttggagcataactattttcat

SEQ ID NO: 36171 - DNA, 827 bp, Heterodera glycines
  misc_feature (774)..(774): n is a, c, g, or t
ggcattgccttttccgaagggattagccgttcatttcattgccccttgggcgcatcattcgcggcacaaaacctcctcccctcgcgcgggttgcactccctccacgaaaaacggacgaagaagccgagggcggcgacggggtgatggcgaaagttgctgaaattaacaaattatgacggattgttaaactcctttgaagttaaaattataccagccccggccgatgtgtctccaccgttctgtcgtcgctctgttccgttaacttaaaatatcaaattttcatttgaaataatttaagatagataggttttttagaaatcatcgatttacatgacatgaaccgtggaattagtcatcattaatcccctcccgttgaccccttcgcattcgttcgtaaatggcaggccccacccccttaacgtatgatgccattgaccgttcttcgctcaccccatggcatcttcgcgcccatttgtcggtaattttgtcgtccatccgtccgacttttcgtatttgcctcatcaaattcggtctcccaacggcgctcctcctccgcccaccgctgcattttctcacttttggactttgatttctcttaaatttaaggcgtaaaaaatgataaaaattaatgactgacctctgttgtcacttaagtcaacgtcggctaattctgcgtcaacgtcgaaatcgcgattctaagggaaagcaatttttagaaaaagggatttatgctcagattttataatcaatttgtatgttttgaacacaaattanaaaaatcattaattaagcagataccttttttggcggtgcacccaaactcagcc

SEQ ID NO: 36172 - DNA, 506 bp, Heterodera glycines
tctgaatatcgatacccaaaaattaacattttgaattttgtttgatttttgtataatgtaattttgtgcctatactgaaaaacaatttatcagtttgtttcgtcgttaaagcttcaactactgacttatactctgtgtactccattttgttaattgaaattgcttatttattccaccacaagttttcctcccggcctcgcatcatccgccgatcgtatgtttcccaattgagagaaatgtccattcattgaattatgcattttattcattagctattttggtgttgaattcctgggaaagcttcagaccaagaagttcatcgagttctctttttggagagttaggattgcgggtgaaatccaatagtcaatctttaaaacgctaatggaaaaaatagaagtcgtacaagtgattcgatcgatattttccaataaaattcgttaaaaaatcgataccgaaacataatgaacaacgtgaaatttctttatctatttttcgataagatc

SEQ ID NO: 36173 - DNA, 750 bp, Heterodera glycines
gccgacactaccatgcccaccacatctttcgggaaaatcgataactaaattggcaaatgtccaattggcgcattacccccccccccatcctttcggaaaaaaccgatttttgagtttggcaaatgtccaatgtttacccccattttggcgcacgccttctccccgggtcaatgcgtccccggttctccccgggtcaatgcgtccccggttacgggaaccgatacgccccgggcgcgcacgcccgcccaagcatacgcgtcactgttagcagcgtgcgcgtcgatgggacataccccccccctcacccacatacacaccggcgaccgtcagtccgcccagaaattacttaagggtttgtatgaatcgagaaagctacacttagaatctcgcaaaattcccacaaaaatttcagagatggaaaaaaacgttcagtctgttgatgggagttttattgagcttcacgagtaataaagaataaaaactgacaactggtgaccaacaaattaattttatataggatcaaattgtcagatgaatggaagagataaagaaaaatggttaaagaggcagataggtaacttagctactgtaataaaattcctaaatatgcaaaaatattaacaatttattgcctttcagggaaccaggaataaatttattatatgaaaattattttagattcaagcagccaaaatttcggatgctatattataaaaacttctgacaaatataaaaacattttccaattca

SEQ ID NO: 36174 - DNA, 792 bp, Heterodera glycines
aaaaatttggtgtttcgggcagttagccccaattgacaacaacaattacaattaaatattgtaattaccaattgacgtggctgcaattgcaccgacagcagtgccttagagaaaaggaaaacaaaaattattattatcaaatgagtcacaaattgtttttaattatataaacagcaatttagtttttttgttttttgtttacccggctccgccgttgctcgacatattcgcattgcacaaatgtccaaaaattggcgcatttggccaagactgaaatttaaaaaacgtatttttcgttctttttttgaaataaaaaaattttataatgtaattcaaaaaataaaattttaaaatgtctcaaagatttcaaaaaaaaattaaaccaatttttcagtttctgggatttaaaaaaaatgcggggagagggcaaatgaaattcacccctaacaaaatggcaccaccaacaccacctgaaccccgtggcattcaaaagggccctccgccgggcggcgatcggctcgcagtcgcggcaacgcgtggaatggccgcctctggaacgagttctgtcaccaaaatgcaaaattaataaattaaatttgtttctgtttttttgctcacgtcggtgacccaatgccaatgtgccgttggcattggcccggcacagagtgcaaaagacgcaaattggctttgaacagatcagcgaagaatctgtgaaggaaaattggaatagaaaaatttaagtcattcaggagatttaaatttaaatggaagggcactgaaaatctcaaattt

SEQ ID NO: 36175 - DNA, 767 bp, Heterodera glycines
ttttacctgaataatcaaattgattatgatttgtcggttaatttgttgtcttcttgctgagcttttgtccaaatttttatgtacaaatctggccattttgtatccacaaattacaattatcgtataacatattttcgacaaaagaagcccacattgaaattttcacgggaaaataatcctaaaattaagtaaaacctaaaatatttaaatttttgaatcagctcacatttcgttcacaatatgtcacaaagtcgttgagattgccacccaaaagttgttcaatttgaaatatttcttcggctttaagcaaggaaagatttatatagtcatttccaacaataagagtatatatcacggttacaattccgatagaaacacaaatgatagcattgcaacatatgttctcagtgttattaaaccactaaaatacctaaataaaattacgaatggattaatttatggcaaatggaagagatgtgccgtgcttcacggacacggttaccgtgaatttcacgggagattcacggggacagttcacgggttttccgcgaaaaatttacgctggaaaaactgaaaatttcagaatttcatattgttttatagaaacttgatccttttttatggaaagtttgataaggaattgaaccatgatctttataatttccccggcgcgcctattggtaccgccatgcttccaaaatactggcttatattcacaaaaattggtaatattttggtgtatatctgttatatacactcaaattatg

SEQ ID NO: 36176 - DNA, 1324 bp, Heterodera glycines
catggaatagaaacaaatgtcttttttaaattgctagttattttactttgtcatttcagctgtaagagagtgaattgggttgtgtttatctacttggcttcttattgttagattgtcactggaactgtcacattctaccagcaaatcgccaacaacaaaacacaattgtgtcaagccgcctgcggaaggctcttgtcccaaaaactcacgatcgccgtctacggagcgctcccgccgaggcaattctcactcccggcacaattcgggctcaaagtcactaacggtgcgctctcgtcccaaaactgtacgatcgcggtcaacggcacgctcccgtcgcagcaattatcgttcccggcacaattcgggatcaaagtcaccaatggcacgatcccgtctctgcaattctcgctcccgtcgcagcaattatcgttcccggcacaattcgggatcaaagtcaccaatggcacgatcccgccgaagcagttctcggcacgggtcaccggcgcaatattcgcgtcacaatagttcaaatgaaattggggcaccgatggcatactccgttcgcagtagatcacttattcgatgattttttaacatatgttcaaatgtttttggcagttctaacgacaatcacttaatttgcattttttttttgcatttttgacattagtagtattggggtaaaaatcttggcccccccccctgggcagagagatgcgcatttattataggagagaggagagaattagagaaaaagagtaattcttaaaacttggaaaagggattaaaacggaaaaaaccccttttgttatttttttgtcttgcggcattttttaatgcgggaaatgaacaccattttccatcaaaaggaaggggcgggaagcgctgccatcctctttttggagatggtcccatttttttgagtttgagttcacagcgaaaaaacttttcatttcattcaaaatttaaatttcgcgcgtcttttgacctaattattttgcaaaatcctgcccctgctgagtcagctgtcaaccgaaaatgattgatggctaaaaatgtgtattttgggacctaagaaacggcacgtgactggtcatgtgaccgaatatttcacaatgaagtgcaccgcgcggaaaatgactcctctgtcaacgaaaaatgctgatttgccgaagaaaaatgcggccaccctcaaaatgaccccagcaaatcccgaggggagtggtacgcaccaaaaaatcgttggcccacgtgcttacgtgtggtcaaaatgctgcaacaattttatgaaagcggcacgagtgtaagaagtgcacccaaaggt

SEQ ID NO: 36177 - DNA, 868 bp, Heterodera glycines
  misc_feature (59)..(59): n is a, c, g, or t
ggtgaacaaattacgcactgatgaccatttgtccatgcgtctgtccaccaccaacacanatcctcctctgcccccgccagcggccaacaaattgttttggaacagtgaagcatttttagttgcacatctttgctcgaccaccggtgaaatggactcgattctgatagagatggggaagaagggttataaaagagaccaggaaatagcggagagaatgagagagagaacagagggaaggaggaagaatgacaagcagagaggcagaggagagagagagatagttgggccatgcctgttgagatggacgaggtagtcgaccagcaattgatagtcctcgaaactgagcgaagtacgcgagtcgggaaaagtcatcagcggatggccggcatccgtttttgggccttaattaatgggcaaaaaagtaaagagaggcggggggaacggaccggagatgaagcagaagcgggacgagagaaggcgctgcctaaagtcaaacgacaaaaacgcctttcatccgtccgcccgcgccactcacaaaagttgaatggacacgcggctgtccccaacttcaacggaccctcctaaaggatttcaatttaacatgcagaaaagagcacattttgtaccccattcggcagccttttctggccattctgatggcttacgaaagccaacggccaatggttggcccgttatttggttggtcaattgcttttcatcgttttccccactgagagaaatcatccaaaaatgagttggggtcattcatccaaagatcgaatcgagcaattcaatgggaaaagcgcaaaagaaaaaacggacgaaagtttggaaaagggggaggggtacaaaaatggaggaaagaaat

SEQ ID NO: 36178 - DNA, 964 bp, Heterodera glycines
ttttgagaattaattcccaatttccgcagctcttgcggtaatgaaaaattttgaagattctctgtggaacggattagcatcggggtttcgagatagaaaattgtcctaaaaagagatagtcatttttctgagaattaattcacaatttccgcagctcttacggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctgcggaacggattagcatcggggttacgagatagaaaattgtcctaaaaagagatagccatttttctgagaattaattcacaatttccgcagctcttgcggtaaggaaaaattttgaagagtctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctgcggaacggattag

SEQ ID NO: 36179 - DNA, 175 bp, Heterodera glycines
cctcggggggtgacatgtcgggggtcggggacctcggggggtgacatgtcgggggtcggggcgggaggagctcaattgtcgggggtcggggaccccgatcggggaatgaccaaattttattttaacccaaaaaaacatttttctttttaaatgctcggaaatattcatttttttc

SEQ ID NO: 36180 - DNA, 883 bp, Heterodera glycines
tttcattttccaaaaacgataacccgagagcaagatgccaaaaaaaaaaatgaaaaaaggactcgtatttcaaaactggaatcttgaaaaatcttggattggtgtcggggatcttaattttaaaaacgaacaatttggccgggattttccggattggattcgatggttaaaataactggttagaatttggaaatggagaccaacattttgcttaattagaataattcctacataaaattcgctgaattcgattgtcgacacattctctttggatacggtcacctccagttgcattacggtagcgcccactaaaatttattaaaatgcccaaccaccgtatccaaaatgcgcttttacagtttttgacaggttcaatggcgtcgtggagcaaataaatgttgaaatgtgtggtgtccccatcgagcaatttgatgcgtgctctcagctctgatcgttcactccatggtgcaaaactgtagtaggatacggtagtgctgagttcgtcctataaatggcaaaatttaatcaattaagttattagatgaaaactgatacctgtgcctgtcttggaaacactcgtggctcatcaattaaggcataatgaccatcgagcttaaaatttattcaaatactaagaaaaaataaatgaattttaagtatatttaatttattgcttattaaattaattcaagtcttaattattcaaaaaaatttctcttataggtttcagaattccgtaactacgtaattagttttgatatttgaaaaatattaaaatatattttaattaattttattctgaattttagattcataaaattaaattaaatttggatatttaaaaaatttctgaatctaatgccaaattattaattagatatca

SEQ ID NO: 36181 - DNA, 773 bp, Heterodera glycines
  misc_feature (8)..(9): n is a, c, g, or t
ttaatacnncgcggccaccacaaatcatttcgtaagttcaataataattatagaaactagaatggtccaaattttttctgttaaaaattttaattgcaattcatttctgtattcaataaattaaaaaaacaagaattaaatacgaatgtaaaaaatttctgaagagaaaaaatttaaaagattttttaagcaataacttcatacgggcttcatcatcagagaatctatcttatgtatgttttgtttgtttatacgtattgtaaaaaattgtatttaaattatttttaggataatgatgacgatgcagcttttcaaaaggcacttcgcgattccattcacgatcaaaagtatattttacaaaaaaaacttttctattaaatggcatttattataagttaatttaaaaatatttttatttattttttagatgaaagtgtgcttctacaaaagaaaatttttgtgcttttgttacaaaaatatgaaaataaaattttcatttttgaagtttgtatttatttccattatatctttagcacctatttaattatttggaataagaataaaatttaaaaaataggacaagcagatttttgtcatcatttttatctcagaacatttaaatacttatgaccaggggttggattcgtacttgaatgcaagtacgtacttgaaagtgagcattggagaaaaacttcaaaataacactatttttatcaacttaaagcattatttggtacaaaatctattattatatcgcaaaaaaaacaaatttt

SEQ ID NO: 36182 - DNA, 471 bp, Heterodera glycines
  misc_feature (28)..(28): n is a, c, g, or t
  misc_feature (464)..(464): n is a, c, g, or t
aattattctaataacatcgaggcttttntggggaatttcaccaccaatcctgggcccgggattccgttccccaaatcgtcctcccatttattcttcgagcggtgtgtcgactgggggacccaacacgtttccctcactataacaataaaaccattaaaatacaacaattaatttaattgatattttcttgccatcaggggtgcgatcgccaaaacccaaaaaccgggcgcgcgagttgaaaaacccggcaaaaacccggcaaaaattttcaaaaacccggcaaaaaacccggcaattttttaagccaattattcactgtaaaaaaggacaataacatttaaacaatatatttatcaccacttttcacctgtttgagcaagtttggcaattaaagaaaataattgtgaacatttaggcacgcaatttttgtttgacaaaatcggtcaaaggcacgtttctattanattctgc

SEQ ID NO: 36183 - DNA, 603 bp, Heterodera glycines
tgaaaaagtactcgaaatcaatttgttttccaattttttatcctaaatttataaaatcctttttaatttgaagttctcctaaattgctaagatgtgatctgtagagaccggatttttaggtttttacctattttttttgcggcttagttatgatgagagaagcccaaaaatagcattttctccgaacaattttcgatttagagcgactttttagcacctaaaattacctaaaactggattttcggtcaatagcacctattttggcatttttcgagttttagcacctattttggcctttttccagaaatttcatagcaaaaatgcaataaaacgaaaaatgcaccccaagaatcgatctaaaaaatttcaaaaatatacccctaaaaattgaccaaaatttcagaaaatgttcccctaagaaatgaaaattttccccaaaaattcgtttccaaaatttttgttcttgataagttgcaattgtaagggctaaatgaataacgaatgggacttaaataagattttttgcataaaatatacttggtttttccaatttttaatacctattttcgcacctattttgggatttttagcacctaaaaatcc

SEQ ID NO: 36184 - DNA, 163 bp, Heterodera glycines
ctttgatctgcccgtggcgccgcgcgtcatggtgcagggagggatcgcgctggcgatgatgctggcggcagggatgcagctttcctcgctgggctatgtctggggccatcaggaagtgatgctcggttatggcgcgctgctgcttacgccgctggcggtctgg

SEQ ID NO: 36185 - DNA, 1079 bp, Heterodera glycines
tgaagggcagaaaatttgtcaaaataaaaaagaatttacggcatctcgttctttgacccattgactgaaagcaaattttagcggactatttttcgtgcgggttcgttttcaatttttttttagaatcatgaattaaacttgagtgacgagtttattttaacaattatatattatttaagctatttttcaaacaaaaaaaattgcgaaaatttattactagaaattttaagaaatatttaacccattggttatgcttaaaattagcgaatttatctatgttttggggcgggattttccattttttttgagcgtttcgaatgatgaaaaatttcgattttattaattgattttaaatttaaaaaaattattccgttttttgcacctcctttagctgcattccaaaaagaaggcgaattttttggctttttccctttattggccaaattacgtgaagaaaagttgcgcaaaaagaatacaccgtcgtttggtgaatttatgcttggcattgattcccattttaatccgtacaccatcggtttccctgctaataagtcaattgccaatctcattgacattttctacctttccatgatgtcagacggtttgatcaaggtatagaacaataaagcatcatactaggataacacaagaatagtcttaaatagggcagggggggggaagggataaacgaaaggggccaggtttaaaattgacacagaaaaagggcatctataaatcaatcaaagttattcaaaattatttaatcaattttacaagttaaaatccaaatattatcagaataaatgtataattcctttttgattgggcaagctcactttggataaagcttttttatctgtgatccgcactaattacccttattttttaaaaattacttacataaacatttatattcgctgcttgtcgagtgtgcaatgatcactaaatttgtacagtgcccatacaaacgaatataaaaatatatttaaaaaggcattttaataaaaaaaatttaatgaataaatttttatttgtaattagagacaggacaagagggtaggtcgaccgcggtttcggtt

SEQ ID NO: 36186 - DNA, 920 bp, Heterodera glycines
tcgatgatgcctttgaccagaatgtatttgtccatcggctgtgcccttgccaaaacacgcaatttcggccagacttggtccaacttctcctggcagacttcgccgtcctcgtcccggatccggtcgttgaattccttcccctcaagcgctaagaaatcctctccaggtttcaaaatgccacaagaagtcgcgatcgaccgggccgtgtttatgttgtcgccggtgaccattcggacaacaatcccagaccgttgacctaagcaacaaaaaaaatggtacatcagatttgccttaaacagtgctttcaatgtttcaaatgaatgcttacatttcgcaattgcctcaggcacctctgaaatggacgatggtaattaaagaagctaaatggacagacagaggcagacctgatctgaccgggtcctgaatgcccacaattgcgacgactgttaagtcactaatgaccgcactttcgtcgtcccaatcgatttcgcctccaaatgccagctgattctcctccacttgtgctgatccgtccgctatatagtctttgtaggccaaacaaatcgttcttaggccgtcggatgccattggctcaatcacttctttcaccaaacggtccaaatctttgctgccaaattgtgacaattgcccgtttcttccgagcatccatttgcatctgtaaaatgggagcacaacaatcagcgaattccggcggagcactcgtccaactttttcagaatgatttcggacgcccctttgctgaacacgcggtaaccaaggttgaagaatcgtatccgtacttcttcagctcgatgaccgttgacattgacttccgggacgaaatgaaagtgtacacctcaaaaaacaaaagtcagaaaagcgcaaatcgaagggacactttgaaatgcgctcttcgggaa

SEQ ID NO: 36187 - DNA, 1363 bp, Heterodera glycines
acccgataatcgtcgccgatttgcccaattcggcactattgccgagttccatttgggtggagggaagcaaatccctgtctaaaaatgccaccgtcggaagggtccaaacgagcaggcgctgattttcctgcagtgcggccaacatattggtcaaattgttggcactcaagcaggagatcagcgatccgatcttcgtagtcctttgggctgacccataacagctgactaatgccaagaaacagtcgcccttttggtccacaaaagccactcgacgctcggcaaaagtgccacacatattcacacacaactcagtgacttcagcctaaatggaggtgatgaccaaatcaatggagaaagtacaattttgggcatttgttggcattgtcctctttcgttaagtgcctctcatgacaaaatccctatgactgcccatttcgcctttacgcttccgcgctagtgattagaagttttaatggtgagttaagccgtctcagttgcaattgccattgaccggtcaatttcaactttccttcccaaaacgttgagggctctggcgcatggacaccgaatggtcttcttttgttcaatttacaatagaactcaaaattatcagtgagatgcagaactgaactgattttctttacaatttgcaatttgctgatgaatcatttgtgccattttgccgcttctatgctttactagtgccatttaatgcccccgccccccgcccccccgctaacattgtgtgttatcggcccgtcccccgccgttcgtccgttctgtgggtcgaaaagatggaccagtgaatgttgtgattggtcccgaagaacgatcaaatcgtttgaaattgccaccgtttgttctgtgaagggttcgcccgcggcggagggaggaatttgaattgtgctgagaattcggccttcgaagttgaacacttggacggcagagctttccaccagcagaaaacaccttcgagaattgggaatggtgggatataaagcattctcgaaaagatatttagcagaaaattatgccaaattgtcacacttttcgcagagtctgatcagcgacacgggccctgagtcctcctttaggtcgacaattgtcggcgcattccaattttttgcactaatttaaatattaatgagccattaaatgccggcaattacctgaatatgtagcattgtttgatggtcgcaaccaccaaatagttaaagccgagttcgaaacgcaccactctgtcccgcgtttccagtcgttctcgcgcgacctccgagctcaaatccctaatgttaatgaccttttggcgggcctggacggcctccaatgttcccacacaattcgccttaattcattcatttat

SEQ ID NO: 36188 - DNA, 1460 bp, Heterodera glycines
cattcattcattcttctcttttttctggctcatcaatgcattatttttgttgttgtttttgttgatgctttgtgttgctcttcccccctctctccctctcactgtcttcctcctcttttgctttgtcctctcctccattcattcattgcctctccttcctctcttctttgttccctttccctctcatccattttttctctagatccactatctttcttctttctctaatttcttaccctccttctccattcatccattatctctcctattatatatatatatatgtctcatttgatgcttttggtgtttttggagggattcactgcatctcttttcttcattttctcttctaaaggatgactcatcagctaatgcaaaccattcaaccaaaacacataaaaattgcagccccaaaattggcctgcgaagaaaacaatttgacgccataaaatttttggttgaaatttgttttaaaatgggaagaaaaaatgttttttttaaatacgccatgtaaatttcagttgtaattaatttaaaaaaaataaattttaccaaattataatcaaaaatccaaattttacgggtattaattaaggaagaatatattttttaggaaatcaatttaaaattttcgaaatttataattatcctttttttctcttaaatttttttttcttcttttccttttcaaacattttgtcggaattcttgaaaactttcacggcacacccaaaagccgcgaaacactaatcgagtttttcagttataaattccaaaaatcatcggcaaatcagttttcaaaaataacccgctgctttgttagcagccgcctgcttcaccgatcagagcaaaattgctctgatttgggaaagcagttagtcactttttacctcaaagcaaaatgagtcatgcttttcatttcacaaatgtcgcccctcccttcttcacgttttatttactcggtttgaaatgactggctgatcagtcaggtcaacttcagtgatcagggtcggggttttgacggagatcggcttacatccgtggctttatccccccccctcccctcctcgtgttgttgatgcttattcaccgcccacatattcatccctccccggctggagtgatcagatttatgtgttcctccttattctgagatttgttttttgagcctatcatttttgattttttttttagatttttttaaataaacaaaaatatttttaccccaaaaattggtttaaaaaattgcctattttgatccaaaatctgttaataaaatgcataattttcaaaaaaaatttcccagtcggcaccatcttaccaaattttcatactgtgtataaaaagatgaaaatctttattttagcttgcttgaagcttctaggacctgtctccatgcctctcttttaatcggcaattttgtttcttaggactgaaaattttttcaaaaaacttacttt

SEQ ID NO: 36189 - DNA, 930 bp, Heterodera glycines
tcggcaattgtgatgatcattggtcccgaaattttttaatttaattttcttttcaaaattttttaacacttttctaggggtgttttgaggcgctgagcacgaatccggcctccatttcgaccaattccgaatccctaatccgaactcgaacatttttcgagaattaaattttaaaattttttaaaatttcttttaaaacatggttcttacaaaggaggggtcggcaagtgaccgtgggatttccaaatgaaatttggtgggtggatagatgacgcccagattctattgtgagatgatgaccatttttgcctgaggaccatgattgacgtgatatgacgtgtgaatattcttggctgaaccaaataataagataaacaattgcaattatgcatatttgcaaatgtatttcatgattgtttagacttataaaaaattatggcgtactgaactttaatatcttattattattcctattaaagatcgtactatttacaacatgatcataccgagcaggtgaaattagaacaacaagctagctttgatgacatatgtgacagagatgtgtcgatggagcataagaaattctctgccgcattgatcacgtgattcaccgagatattgctgatcagtaatcagattctacaaaatacccgacgatttgatcaattttttgatgaaatttttggcagtaaaaaaataagatagtgaagaaatgtccaataattgcgatgaattggaacaattaaaattgggatccacctcaaagaaaatttatgaattgaaaaaagattttggattgaccaaaaacaccacctcttatgtggaaaacgcaaaataataaaacaatttgatcattatttgaccaattaaaattaaattaaataaaattggaagggaaaaagaaaaatatggccaaaaataatagcaaaa

SEQ ID NO: 36190 - DNA, 1057 bp, Heterodera glycines
aaaatcccgccacccgaatttcgccgagataaaatctcgccgcataactttttaaatttctagttttttatggtgttaactttttttcaaaaaaccgtaacgaattttttttttttgaaaatgttttaaaattaaaaaaatcttcagaggcgagcttttgtcccatctccaactccaaggtaacaattgaaaaggcattagatgttttctccaattaaataagtaacataaactgaccggaatgacaggctgagtttggcacgtgtacgcaattcggccgtccaaaaagggtgggattatgttgtggacgagcagagacactctgttctcgtcagtttcgttgtcgaagaagtcgccgagttcctcggagaaagtgaccacgcctgaacaaacaaacagaagtgcaaatgaatgaaaattgctaaaactaaatgcataattttttatgacccgagttggtgttctcaaaagctttggaatgaatgatggatgaatgcattgcttgatatttttggctaatttttttaagtaaaaataggtttttgggggccggcggtgccgataggcgccgccggggaaaaattttcagaatttttaatgaattatcaacaaaaaacatttcaaaaaaaaaaagaagataaatttattaattttagcgaaataacggcctgttagcgggcaccgccggatgcccatttaacaaaaatggctgaatgtgcggtatatgtgaatttccatgtttttcgaatcctacttaactatcatgctaattgttagtcagtcaactctaatcaccccccccccccttcacctgatctggccagtcggttgttctcccacatttcgttgtcttttttgatctgttgctggcggagggtcagccgcggtttctgtcgcgtttggtccaattgtttctcgcgcttttccacgtaattctgcgacacgttggcgaacgggttgaactcatcgttgtaacagccctggtcattctcatacctttacaaaattaccgggtggaccaatttgcatgtgttaattgtaagtgttaccattctct

SEQ ID NO: 36191 - DNA, 880 bp, Heterodera glycines
tttgccactcgactgtcaataccgctgccaagtgaacgtttgctactgaaaatgcccagcacgcaccgcaaagggctataaatttaatgaagcattttcaaattgttatttttaaattcccatgctgtttgaaaaaatttttcccttgatcgccggggtatggaatccgtcgctctccttttttggagtagcgcaaatccagctcggttggccaatcattctcttctaaaaaaatgattttaaagaatttaatgtttaattaagcataacaaattaatcaaaagtaaattgcaaccttggaaaaaaacgattattgaaaagaaatggtatataataatattgaaaagttgatgcatttcctaaagatttggtaaacattgtaattctatctggttctaagtgttttatcggggctgattttaaatgttttagctgctccttttaaatgctctagtggctgaaatccctagcgcccaaaaatttgtacccaaattttattcacaaatcagggggagagaatcgctgattagatagcaaattggtcatttcattttttatcctttcaattccatttcaatcatctgttaagttcgtaatgaaaaaattatttttcagttatttatcaagagaatttccaaattgcacaattatttcacgcattattattttttctttgtaaaaatgtgcaattggaccatttctctcttacagtaactactgaaattaatcattttaattatcgaaataataatgattgaaatggaatagaaagacaaaaaatttaattgacagccaatttgctatcaatcagcaattcattctccacattttttccaacacattcgaaattaatctcgtgccaaaatcccccccccccccc

SEQ ID NO: 36192 - DNA, 807 bp, Heterodera glycines
  misc_feature (799)..(800): n is a, c, g, or t
ggaaatatcaatataaaaggcaaatcatttgttaagaaatttcatccaaattttatttatttaaaattttttttgattctttttataaagtaatgctgaaaattgtaaaaattcccaaaaccttctttttattttttaatgaattttaaattggttttgtctaaaatgttatcaaaagtgataaaataaattaaaggcttattattgcaacaattagaatactttaagattttcctaagcaacgaatgattttttaattttatttactggtaatttattctttttcaaattgaaacacttccctaatgtctcttctgtgcgttatcacttttatgtactatggacattctgttgaaattctctccaattctgttttattatttcaacattgggtgatacgatattttacttaccgtaacctatttactatcgttccatgaaattgttttccatttcctttactagttcgaaaattttttatttatttctattttcactttttttgtctgtcaaataaaaatattgcattaagtttgccgactgttaattgccaaaaaaaactaatttatttgatttaaaaaatttaataatctctctggaatgaaaagctgaaaaacatataaatccgttccctggccataacattacgcaagtcggggtgtttttttggactgtaaattttctcattgtaaactagatccaacaaaattttatcatttaaagcttaacatgtttagagcctgtcccactgaggccaaaatttagacgaaataaaaaatgctcaaaatattttccaacnngtgacca

SEQ ID NO: 36193 - DNA, 1661 bp, Heterodera glycines
ccatttgcccgaatgttttgtgctcgacaatttggcatttggcattcaaaatttcccatttctcgtccatttccgactcattaatggcacaatgacgggcaccaccagcagaagaatttctttgtcgtctgaacttttgcaggcgccgaatgtttatggcattggcgatttgcgaatggaacaccggtggaggggggagacgacgccgcaggggcaatcggaggagggaaattgccaaagggtgcgaaagttgctgagaaaaatgtacgaggccgaatttgaaacggtgaggagcaattgtaggcaattaattaaatggctaattggttaattgattgtcagatggacaccgccgattcaccgattgtcagcagaacgatgcttatcccaccaatggaatacagctgttgtgggctgaatgaggaggagatggagaggaaatggggaaggcatttgacacgcgtgtacagagacggagaagtgccaataacggcggagagggcgaaaatgatttgtgtgatgaagggggcggaccaacgcaaaaaggtgggcaaaggcaattggcggattttgggaagaattcgaaaaggacgggggggggggggggaattggcaccaataaaatgactaatcgaaaaagaaacagggaagaggaaatcactgatcagaatggtgggaaaaagcataatgatcaataaaagagtgacgaaaacagtcggaaaggctcagaagagagtaactacaataattacaaaaatggccaggaactcgtcgttggcctccatataatcggtccaaaggctactcagctgatcagtgggtacgcataggcaatgaaattgggactgacaaagtgccaaatggaacaggacaattggcacaaaacaactgctgcttttggaaagtgatcagaaagagagagaaacgaaaccatcgatcgcttattatttggccaaaaataaatatttgaaaattaataaatttacgccattaaaaagaaaaaaaggaatgggcaaacaattttgctaatttgaacttttgttgcaaaatattaaagaaaatagaaatgaatgaatgcattgaaatgggaattgaaaattaattttggccgtctccgtttgatctccgcccatcgctttttaaaatgcaattgtcgtctttcgctttaaagagtttgctcttccaacacaaacacatggccaatgtcgttggtggagcagtgccaagtgatttggtccaacttctgtccccatcccgcgtgtgtgtcgttgtgggggtaaaatttgacttgcaaatttttgctcaatgttttgtccttggcctggaaatgggaatgaatgttccataagtgatcgatcactttttgttgttttccgatcacttttcgctgatcattcgacgcccttaccgaaagcacaaattcaatgtcctgccgtgtcccttttttggtcggctctttgtcagcggtgttctgaaagaaacaaagcgtatggccaagtgagggcactcgtccaattggacacggcacacaaacccaaatggccacgtattctccgctgccgccctcaatcggagccaaactgagcacgttcccggcgatgttcaaacttctaaagggaaaagtgatcacttcttcaagctcgatcaattgacaaaatgct

SEQ ID NO: 36194 - DNA, 1459 bp, Heterodera glycines
ttcccctcaatgcttttcctaagatcgctccttctgccaagtgtctctcaactttgttcaccgcattaaatttgtgcaggaatcaattcgattcgagtttttgcattgtatgttcgttttttgttttttcaatctttagatggatttttgtttccatttcctataaagtaattgagagatcaaaactaattatgacacattaaaaggaatgggcggggggcgatttttcttaattatcttacgccacttacaattagcacttaggttttaaagttgcttaaaaaacagaaaaattcacctaacttgccctatgttatcattcaatttcttcaggcatgggctcttttctgtaccagatgaaatcgttttaccaaatggccaatgaaattcagaaagattttgtgagtttttttcgaatgattttaaattgcttttccccctttagagtctgatctacaacgacgtgtgctacagagtggagaaggcgaagaaggaccagacggaactgcgtgcacagattgagggcacaaagcgcaatgttttggagaaattcttaaaacattcggtgggcgttagccgaacaattcaaattaatcgctaattatggctctgaaaaatgccacaagttttatgccacctttcaccccattttgtctaggtgtttgtgctcaattcgtcgtcgtccaactgtggcgagttgtcgtccgatttgtccacagccgcggtcgccgccgcttcggctgccgttgggggcggtgccgaagggtccgcgcacattcgccaaggctatctgttcgtgctggagatgcgcagtctgttatccaaggcggtccagtccaggggcactccgaccagaaattactgcgtctactccaaggagtccaggtgggcaacttgccattgggccgggtaatcaaatgcgataggcatgagaaatctttagatttgggagattgatttttaacatgttcgatttccaggattttgacgcttatcccggtgaacagtttgaccgtcaagacggtatgtccttattgttttgtaatgtgattctctcccatttactatttaaggatatgaagggctgtttggaccagaccatttcgtacaaattgaaaaattgcgcccgaaggccgtccgattcgattgacagaaggtgaattgtaaagagtgtaagagaaagaaacgctcaaattcgtccaccccaaaacacctaattttaaccaattttttcttttaatttgaattttttaagtttttttttatggatttgcggcctttgcccgacaattaatcaacttccttccaggttctgttttgatgtgtatttggagaacaaaaatgagccgatcacaatgcaagcactgagtgaatcaggttgggattgtgacactttttcggattggaaaaatataaaatttttgcagactttgtccaatggttgaacgtgatggacgcc

SEQ ID NO: 36195 - DNA, 1032 bp, Heterodera glycines
  misc_feature (62)..(62): n is a, c, g, or t
  misc_feature (70)..(71): n is a, c, g, or t
ttattaacatatgaatttgttttgtgaacgaaaaaaacgttttctttttatcagtatatttntattgatnntagtggttgttatttttcagtttgtttgtttatttggtttttgtgttccttgcgtgaaatattatgcaatgcttaggcttaatgtttaattgttattagatctttgtttttttttgtctaatttttctgatttagccaaaattgaagtgattaattaattaaaataaatttcaacaagtttaaagtttctgctctgccggttcggcaatattatcattccacactaactgccggtcggccattcatcatagggtgtagcatttctgaagaagttaaagtaattgccttttgtactcagaattatgtaaaaagtgagctaaaatttgtatttgtggctgactgtgatttagtttttccatatataattgtttttcaaaatttagataatgaactaagtgtcatggaggcctaaggttttgttgaatgcattgggatattagttttgttcagtcaaccacattagtgtggtgtgttgtttgttttaaacaatagtgtggtttatgtaaacaaaccacattagtgtgctttatgtaaaataattagaattggtttgagacgcacactactgtatctctcatgttttagtgatccacacaagtgtgaaattttgttaaaaaggaaatcttcgttatagtattgttttgagatgctgggaggccacgaagcggccgagcatgtaccttcaaagaaaatgaaaaaatacaaataaaatgttaaaaagaaatgttgcaaggaaacaagaaaagatgaggaaaacgctaagaaatgttcgtgccataagaaaatgccaataaacaagaaaatatgaggaaatgctaagaaatgttgtgccatacgaaaatgtcaagaaacaagaagagatgttgaaaatgctaataatgttgtgcagaaaatgtcaagagagggtgcgaggccgctaacgagaaaatactaaatgttgtgccataagaaaatgccaaga

SEQ ID NO: 36196 - DNA, 647 bp, Heterodera glycines
  misc_feature (620)..(621): n is a, c, g, or t
  misc_feature (623)..(623): n is a, c, g, or t
  misc_feature (634)..(635): n is a, c, g, or t
acatcactcatacatgggttggtatagcacaaattttcattttatgaaaaaatcacaattttttcatcatgttaattactgttattttcactgtccatagatatcatggaatttggtgttggaatacgacacggccaaggcgaccgatgtttgtgacaagaggggtaattagtgtgccgtgattagtaatttgggaatcggctttttgtctttagcctttctctccaacatcccagcggcaaaagttgtgcatccgttcgcttcccaagacacgtgttccaaggagggctgttgcaagtgcacaggcgaaagtcgaagcggcgaagccaatgcccgcggcaaagccatcgacgcgaacaaattgcacgacgagcggaaggaaaagagcaatttcgaaggtactctcttttttccctgtgaattattttgacatttttcattataattcaatagttttagtagaaatttaacaaaaacttaaagggcggcatatttttgcaaaaattttcagcgttatttttaaataaaccaattttaatttttaattaaaaaccaaaaaaggggggaggggagacccttttggtttgtatttttttacaaaagcccatttttccactatnncnatattcgaccnntgcgaggcatgc

SEQ ID NO: 36197 - DNA, 688 bp, Heterodera glycines
ttttcaattctcacaaagatgccagttttcgagaattttgaaattccagcactacatgccgaaaatattgctccaattgacatttctcgcccttttaagcgcaaatggggacttattttgtaattctcccgtaccgttttcaattctcacaaagatgccagttttcgagaattttgaaattccacactacatgccgaaaatattgctccaattgacatttctcgcccttttaagcgcaaatggggacttattttgtaattctcccgtaccgttttcaattctcacaaagatgccagttttcgagaattttgaaattccagcactacatgccgaaaatattgctccaattgacatttctcgcccttttaagcgcaaatggggacttattttgtaattctcccgtaccgttttcaattctcacaaagatgccagttttcgagaattttgaaattccagcactacatgccgaaaatattgctccaattgacatttctcgcccttttaagcgcaaatggggacttattttgtaattctcccggaccgttttcacttctcactaagatgccagttttcgagaattctgaaattccagcactacatgccgaaaatattgctccaattgacatttctcgccctttctatcgcaaatggggaattattttgtaattctcccacaccgatttcaatt

SEQ ID NO: 36198 - DNA, 1035 bp, Heterodera glycines
gtatgaatgatttggcttgctataaaattcttaacattttacgatttgatttcacttgcaatttactataattatttgttgaatttgttttatattagaaaattattgttggatttctttgtgtgaataaatattgtaaaacataaatacatatgatttttggattaatttttgtgaatttttagcatacaaatttgatttcttaatagtggattttggaaacttgttgattattttcgctagttgttcattttcattttaaatgggaaaaaatttgtttttattggttataaatttgtgattggtttaatcgcaaaccaagtcatacaaacgtgcagcttcatttagcgattatgttaaatattaagctaaattagtttaaatgtttttaaattataatattacataataatgtatcaactgaattgccgattttatggcacatggtcacaaagttggcgtattctttttgataaattgtcataacagtgttgtttgtttttcaaactttttctttattacaaatatatttatttattgcatattatagcatttttatttatatcgttccagtaactaatatttttgagcaaatatttctttattttgttgcaaaaataggaagaattttcgcagcatatgagtgagcatcatttactcgctttgttccattacttctctatgttctttgttttttatttttctctaattgatgcaaatttcctgagcgtaaaaggtttttttaatttttcacagttgaataattagtttacttttttaataaatttaaatccatttacaattatttatttttgcaaagctttggaataattctaattctagtgatgcgttaattttttagcctttttcgcacgcttagtattattttaagaacatttgtttaaattttaggaaattaaataaattcgtgaagaataattgatttattttttactagaatttttatttttatgagattcataatatgagagataatttatagttttgtaagattcttaattaagtgggttttat

SEQ ID NO: 36199 - DNA, 1247 bp, Heterodera glycines
ttaaatgaataatgaatgatatacctaggcgtccattaatctttattcaaaagaaaaagacatcttaattacaatgagaatgattagcactggcaccgagaataacaaagtattttttgtaataaaaacccaccaaaacaatttagctttcacaaaaggttttaatataattgcatgcttttatgctagatctctttgataattatattattaagaaaaaaatgagtcgaataaaataaataagaatgattagcaaagggaattcatctaaattagcctaaaaagacttggatattaagcatttaatataaaattttattttttcaattattcaggttctaagaaaagccatcttaattaggagaataattagcaatggcaccgaaaataacaatgtatttttgtgttctaaaagccaaacaaaaataatttctgtttatagtacgataatgcactttaatataattacgatacctacggtagcgaaaaggcataagaaccaaaatttgtcgcttaagcgccgcccattctttaacattttaatgcccatgaaaagtaaaaaaaaacaaaaaaaacaacaacattagtcttaataccatgttacaccttaattcgatttttgttaattaggataaggaaatagcaaaattggaaaatataacttttttatgcccttgtgaattttttgcaaatatatgtgcatatttttttaaaccttgtatttatataccatacagtatctaagatcatttcattcaaatttccgttttctttggcgttgctgattggcacccccccccccccccccgatatagggattttttaaaataccgtaattatagaaccaaaaaagaaaagactggattaatttttgtggcggaaaattaaaatttttgattgaaaatctgttaggaaatgaattaaatcaaagcgtcattgtcggcttgatcattaaatcagagatgccatcgaatattttccaaaataaacaaatcgctagtcaaaaataaatatatttttttgaaacttggttaagggccaaaatattttgacccaaaaaattgctgaaattaaatttaatatcaccaaaaatcagaccaaatgcagaggcttattattcattttgagttgctcattaatttaatgtgactgggcaaacatgaatttttgagcaagatctttttctttcataagtacattattaatacaaattgaagcaaacaaaaataaatgaaaaaagtgcattt

SEQ ID NO: 36200 - DNA, 1755 bp, Heterodera glycines
  misc_feature (1575)..(1575): n is a, c, g, or t
  misc_feature (1654)..(1655): n is a, c, g, or t
  misc_feature (1705)..(1705): n is a, c, g, or t
tgggttcattcggggccaaatgctttcggtgcttggttggccaactgttggcgaatgaactgaacggacacgcaaattatagggaaacgatttaaatgcctaatcatgttttttaattgtccaattaataaaattaattgtttctgtcggtctgttcttactccgtccggttggtgctgcacgcggtggaaaaacgcccttcgctcgcccttttcactggtgtccatcgcctcgccgttcatttcccacccaaaacaatttggccgggcacagcctttacacaaagaattaattttaattaaataattgatgctttattttttttaattggccccaaaaaataattacccaaaatcgggtgactgccagtgagtgccttaaaatattttacgataattataaaattgttattttcatttagcaaacttcaaagctaaacggaatggtcgattctccgcagaatgaggccaaataagaggggaaaataaagaaaaaaactgacagaaaaacagtgcaagttttcatgtgttttttgtccagcataattaagaggcttaattggtcaattaactgatggcaattaaggggaaaaacaatacttgtaaaataaaactaacaaatatttgaataaataataattaaatttaattatcaaaaccaaatgtaaatgattaataaagcagaaaataaataaataattgtttattcataaaaaataaaaaaggcatcagaagggcgaaaaccacttactctgaagactattccggtaaatgtgtcgtagagtaagtgacaaaaatatatggatgatcacaggaattaaaaaaagacaaaaatatgtgaaaataaataataaataaattgaggtcaaagtcaaatgaggtcgaaataccaaatcacttagaaatttgttacattctagctttcccggtcttacatattaccctagtgaactttaagttttattttaaattgatttaaagaatttgtttttattagttctttatctagttgattccacaattttgttaccctcccagcaaagggaatgaattttttgcccagtttgtattttgtgttaaatctataaaaggggatgttaaagcgtgctgatggattaaaaatagaaaatagtttcagatctgttcggccataaacaattttatgcgccatgaacagatcaaacagctttcgccttttctcaagtgttggcagttgcaggtattctaatcgattttggtatggaattggcggaaggctgcatttaaaaaatacccttttggtgaaatatttttgacacttttcgatttttttaatatttttttgaagaaacggattccaaacctctggagcgtattccaataaaggcctaatataagttttatataacgtaatccaaatcttagacgatttggatttaattattctaaacaaggaacgcatacgtaaatacgcattccttgttatttggttaatatgatcggaaaattgtaatttgttatcaatgtttactcctaaatccctaattgtatccacagcatttattgtatttccatcaaatttatatgtttcttttgngtttttttgacccaaatataatacaaaagttttttgaattgaaacttttatttgccatttatttgcccattcgaataannatatgcatgctttatgcatatttttaatgtgtcggttcttgctttatacnaaatatataatttaacatcatcagcatataaattttattttcactcctga

SEQ ID NO: 36201 - DNA, 1275 bp, Heterodera glycines
ctatttctgagcattttttaaatcgaccgcgaaagttttgttgtccaccaacatttttggttttaggaaccgatttgtcggtcttttttttcatttctaatttccgtcacaatttgtatataggagtgcattttttgttgtttttgggccattttgtaaaaaaaaaaaaaaaaaaattgtatcccaattttcaggagaatgtccgaatgtactaccaggcctggatggaagagcaggcacagaaattgatcgatgccaccactcgcggtatacaaatagaaaaattggctaattaatagagcctggacgggaccggggcctgccgggatttttgccgagactccctctgtcccggttttttggacggtcggaaaaacgggagtcccgggattccgtcccggtcgattttctaagtcccgaacatttcaaaatccgggctctcctaattaaaatggatacggtcatcaaatacacactccattttatgggtttagttttaaaactgaatttgctttcagcttttacatcgcagcggatgttggcaccaggagctccaggatttgtgccgcccccgactggcgttcccgtcatgattgtaatgttttgaacaaaacaacattgttgtttgctcaataatttttgatgtcatctcaatatatatatatatatatatttattttaaaatttttttttcactaatttttattaccaaaaatatctaaattttcaagtttgataaattattttaaaaaattgggaaacgatacggggggggggcagcctatctagacttcaattttttaaaattaaaaaaatcctattgtaggtttgtattttgtacagtttgccaatggcctttaaaactaatcccatgtgcttgatttacacctcctctgttaagccaccgcgtgctccgtatgttaatccgatgtcgattgtgcgtccgccggtgatcccttcggcggccggcttcttcacaccgccggtgttgccgcagggaatgccgtcaatgactgccgccgctttgagtgccattccgacgccggcagtcaccgccgcagcaatggccgctgttgccgcggcacaatcgtccggcattgcggtgaatgccaacggcgcattggcttcgtcggctgcgcttcgaacctcaatcaaacagcaaccgcaagaatgatgaagatgatgatgagctaaaaaattataatttgggctaattgtacactacaatttatgcgtgtccgatcgacttttgcgcggtttttttttaaattttta

SEQ ID NO: 36202 - DNA, 925 bp, Heterodera glycines
  misc_feature (857)..(857): n is a, c, g, or t
  misc_feature (867)..(867): n is a, c, g, or t
  misc_feature (878)..(878): n is a, c, g, or t
  misc_feature (892)..(893): n is a, c, g, or t
aatgccgggggaggaggggactagaatgataagagatgccgagggaggaggggggaagatgatcagagaagcttgaagggggatggattaatgaaatgccgggggaggaggggacaataatgttaatacatgcctaggtatgatgagcttagatttcatccccgacattgggagagaaaagtcatggatcggtgataaattttcccgacaaaacattcacaacattcacacaaaatcaatcctggcattaattttttaatttttttaatcttgtttcatcaccgttattcgaggatataaaagtctcggatcggggtgaaaattcccgaaaaaatattcacataaaatccctggtgaattcaaaaattttttaaaggccgccatgtcaaactgtataataattgaaattactttgaattctttcaatttcttcatgttgttcatcaaccaatttttttatccaataattgtacaggttgaattcgatgaccatttttgttcgccatttgcctaattcggtgccattttcaaaatattcaatgtatgtcaactgatacaaagcgtctggcaaagaaaagccgcctaaaaataaaatgaattaaaataaatattttaaaatgggaaaaggtaattaaaatgattaaagtatggaattaaggaaaagactaaattgactacaattttttcttaatgacaagaatataatttcttgattagtcaaattttgcgatgggtacttgaaaattgcagtttcaattgaggtccttgaaaaataaattataattaataattttcagtaaatgccattttaaaattgtttctcatttttggcctccaaatattaattgttgtactanatattcatanttttgcaattnttagaagaagtggnngaatatcataatttattaccaaagcataaaat

SEQ ID NO: 36203 - DNA, 759 bp, Heterodera glycines
ttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaatttgaaatcatgtttcccactcccttctcccaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactaaaaaaatatgagtgatctaactttcactaacaagttaagtctacactttttcccaaagttaaaaagcaattataattttattcacctccattattgatagaaaaagcatcagagtgcctatactaacatgtaaataaaatttggtgcgtttcagaaccctttctgaaaaatatttatgaattaattttgc

SEQ ID NO: 36204 - DNA, 631 bp, Heterodera glycines
caattgttggatacagtactcctgttttttttacgtgaccttatcccattgtcaacgataaatttatgaccaaaaaaatgctcaatgctgcaactccaaaacacgcggtaaaattgtacatatttctaacatataaataaatatagtataaacatatacattgttgggtaccgtaaccaatacaaattatctggggagtgtcaattacggtacaatgtacagtatcagtcagtgtcaatggtcaattagtgtggtgtccccgttgtgcgcaatggcgaggccaaaattggcggtgaaatcgtgcacaatggcaaacgctgtgccaagcaaatggacaatttcgaccaaccgcggcacaaggcattcggcttggaaaatctgaagaaacaaaaaaaaattgtaagggacgagaaaacgctcaaaaattggagtcatcggaccaaaatttcatgaaaattaagaaaaaaaaaaattttttttaatcaaactgagggttaaaatttgaatcaaactgcggaacggatgggattgaatttaaaataaagtgccaatactgaagatttttaaaaatcaatagaaaatacgacgaaaattttgaaatccaactcgagggggggggaaagggattttg

SEQ ID NO: 36205 - DNA, 825 bp, Heterodera glycines
aggtccggatacaaagtccactagtacctggcttctgacctttcgccggccgatagcgcgctcaactcagtcccatttaactcagtctcggcgctaataactttttcatatttttagttgaatggatgcgacaaattggagccatcaataaagagttatattatttaacctaccaatgattaaaaaatttaaaaaaaaaatttctaaaagttagggatttcgaatagttttctaaatcttttccatttggtttactaaaaaatatgggttgttctggttctaaatttgcaggaccgagttggccgatgatgccgagctgtggcccattttgtctttggtgggatttcaccaatttgtcctcctcctgttgctgggggggggggggggggacgacgaaccaagacgaacgaacgacgaagctcggcggcgagtggggccgaacttcgccgcacaattcccccgcggggcccccgtttgcccaccggcggcacggggcacccaaatgaggggtaattgcagtgttctagcgaaatgcttggccattccattcttttttattttgcaaaaatgttctaaaagaaaagcaattttgtgttcctctgctgggggaaaaggaagggacaaatttgagggggacacacaaaaccccccaggggatgcacaaataaggggcttaagccgaggcgagtttgtaaaaaattttcttaaaattcaataaggattagatggtggtggaagccatggaaaaaaagaacattatgtaatttacccaaaaatagaaattcgcaaataatttaatttaattttaaatggaaaaacaaaaaa

SEQ ID NO: 36206 - DNA, 1341 bp, Heterodera glycines
aaaattaaatgcaaaaatttataaattatattattaaaaaatgttaattataataattcctttttgcaaaataatgattttcaatgaaaattttttttctaaaactaaatttttagtgccaatgaattgtataaaataatcaatatgacagtgcgttatgagtcttagtgccgagttatgacgtgccaaagttttttaatgattaaacaaattaaataattgtttaaacacctttgcattatccagtggtgcagcggtagtgcgctattcagcgttttctagaacccaggttcggatcccctacatgcaaatcccttttttaattttaatttttgatttttatgccaagtcaattatctttatcaaaattttttatgatataaaaaaattcttattttttatccatttgacaaataagttactcataaagtattaaacaaaaattaataactgaaaggatatttattgcaccattatctttaatgaattttttaaatcaaataaaattaaaaataaagattttgtttcattaaaattttttgtataattgaccctgcataaaaaacaaaaataaaagtctaaaatggatttgcatgtagaggattcgaacctgggacccaaaaaattttgactaacgcactacctatacactatcacacacttctaagagatggccgaagtttcaggctaatggaaaagataaataaactgccaattttctaattagctaactaaacgtctagaaaagctgtaaaatttggtggtaattcttagcaaacaaatgcgccatgtccaaaatattaatagtcacgacaactgaacttaatacaaatcacatcaaaaattcttgaggttcaacatttttgtctcaataaagtaaaaaaagtctattttagccttattaggccgaactgaaataaaccaattttttcaaaacatttggcatttggcaacaacacgaatcagagatactgttaaccaaaagcaggatctgatgtcttaatgcttattgttagactgtacggctgaacatagaaaaaaacatatttgaataatttatagctttgatcaatcaataaattttttaagacgactattattggcctaagggaagtataagaagtgacacaaaaaactttggttttaaatttgttacgcagcgtaagaatttttaatgcgtgaataagaaaaaacatgcatagtaaggaaaaataaaaatgaatgtttttatcgcaatatgctcatcatcaaaattccgttcaacggacattggcatttcaccaagacagccaaccaatttcacagcccaataatcaaacacagtcacagtcctgaaaatgg

SEQ ID NO: 36207 - DNA, 808 bp, Heterodera glycines
  misc_feature (6)..(6): n is a, c, g, or t
agtacnctgttttttagcattagaattgttcagaagtatatgtatattgagggtgaccaagtttttttttcaaattcaggataaagaacactaaaattcagatatagacctcaaaattcagattattgcaaaacaaggggtcagcagccaattttccaattttgcgaaggggtctccggccatgtaaattaatgtaaatcaatgacctttttttgctttcaacaccgctttttacgcggcacgttttttccaagacttttgggggacaaggagggccggcggtgccgataggcgccgccgggaaaaattttgtaatttttaatgcgatttgttaacagaatttgtaaaaaaaatgaccaattgattaagttttgggtttttaggatgcttaacatgaaagaaaaaagttggaatattttttaaaattaaaattttaattaaaataatggtaaagaaaatgtgaggaatattctatccaagtggggaattgaactcaggcgaaaaattatgaaaggtagaaagtttaaccactacaccacatgtgcatgtgtgtaatcccatgactaaatgaaataaaatttaattttttctcaaaaatttctccttcttcaccaatttcctactcttttctcgaccagacccccattcttaccagtgcaaatttttaccggcggtaccggtactagacaaaccggtaacggtaatttcatttttgaaaaaaccggtaccggtaccaaaaaaaccggtaattaccggccagtaccggtaccggtaccgctcaaccctagtcaaaagtattgatgagggg

SEQ ID NO: 36208 - DNA, 1125 bp, Heterodera glycines
ctgaatgtaggggataaagtctgtccgggtccgtccctgtccagcaggtgtccacctcgaaaatcctgctccaggtaaaacaggggagaggaacttcgggccggggtccgatccgaaacggttttttaattgagcccatttaaaatgaatgctctttcattttgtagaatgtgtgatgaatgaatgaaccttttgcttttgttgctccgcaaattgaccacccaaatgacgcgcagtgttcaacaacgggtcgtacatgaactgtaagaaattattttaaaaaattccgtagaaaattttttggatttgaaaattttttcaacttttttggtcgagtatcgaattgagaaaaccaaggattcacaatttgatatttgtaattttgtcgccctcatccattttttgacaattttttttctaaaatttggtggagggcaaacttttggcatttgttaccgaaactttcagtttaaatgatcatctatctgtacctgtgtgcaattccattagtacaaccctaatggaacccaaaacatttaaaaaatccgaaattcctccatatgtccatttccatgccatcccaacccaatcccatcatttgcatcgattttctcttggttggcttggcttggcatgcccccaacctgctgttgtgggtccccaattggtggttggaacggcggggacatttgcggcggcgcctgctgttggtattggtggtaaggagaggacggcggtggtggcgacggcacattgccaccgctgtacatcattccgtagggcgatggtgactgatgctgttggtgtggttgttcaaatggactactggcgccggcgtcatacggcggtggtgggggactgaaattggtgcccgtactgaactggccgctcccctctcttgcaccgtaaggcaaattgggtgttgtcatcagcagggcgtatatttatagttgctaaaactgccaaaataggtattttgtttttagtttctaaaaaaccccaaaaagagttgctaaaaatgggtaaatagttgctaaatatttcaaatttaggggtgtatttttcgtttttattgcatttttcataaatttttattcacaagcaaaaatagttgaaaatagtttt

SEQ ID NO: 36209 - DNA, 1464 bp, Heterodera glycines
agcagggctggccgtgatcacggatcacggaaatcacggggtttttggggtgccatgatctcggatcacgggtcacggattttttcaatttttccgtgattttgatccgtgattggcattttatatatggaatttttattgaaacgaaaataggaaattggtgtgaaaagagaaattttttgagaaaaaattaaataagtaaatccatttatgttaaggaacttacctagtgattaagccttgcgtctttcattgtttgacccttgggttcaatttcccattgggataggagaatttttatattttgttttataattttaattgaaatttacaataattaaaaagaaaattttcttacattaaatttttttcattatttttaaaacaacattaaacccataaattaacaaatgattggacattttttggacaaaatctgttaacacattccactaaaaatttcaattttttcctggcggcacctatcggcaccgcctgaccctatccgtaccacaaaagtttttgtaaatggcgagccgcaaaaaaaagagatttaatcaaaaaaaaaagatttggtcaataagttcaaaatatagtcctttattttcctcaaaaaattggctcaaacagtaaatttggtcattttttggaaaaaatctgctaaaaaatcgaattaaaagtatcggcaccacctgttctgccccctgtactcgaaaagtttttgaaaaaagcacgccgcaaaaaaaagcgttacctatatggtttggtttctttaaaaaacttttatttatttttccagcgattaaattccgttttttgttaaatttaaatacaatcacggatcacggaaaacacggggttttggggtgccgtgatcacggttcacgggtcacggattttttagaagccccgcgatcacggctcacggatttccgtgattagaaatttaatcacggccagccctgattcatagggacaagagtggggttagggtattgacaaacaaaaatgggttaatggcaactcttacaaaggcaactcgtattttacaaaaaaaaaaaaagcctaagcttagcctaggcccaagcaagcgtaagccttggcctagcctaaagcttaggcctaagcttaagccattgtacgagttgccttttgtacgagttgtttgacaccggcattcataggggacaaaatgggtttagggtaatgaaaaaaattaaatgatgaattcacccgtttcaatccctctataaggctacagtaccaagggcaccaatttagggatacagtatactactttaaataaaaatcctataaaaataaaataaatcttcttcgtcagaatggcgactcattgaactcgatggcacgcaaagcacaacggttgtccaactttgtgcgctgttacactcagcaacagcagcaacttctgcaccatgctgatcaaattgccgtcccatcgaa

SEQ ID NO: 36210 - DNA, 999 bp, Heterodera glycines
aatagggttgcgctccgacattttcggggttttacgaaagtcgtcaattgcacttgaaatgagatggaagtgtctttaaatgagtttttaagacttttttgttctggaactttttttttaatcttttttccgactttttatgaaaatttcgcccccgacaaaggtgtctgcccccgacattttttaaatttctccagccaaccccgacaaatttagtcggggaattttcaccccgaaccccgacttttccaaccccgacgtcgggatcgcaaccctacattttaaggtcagtttgtaatgcgaccaatgagtgacactgtcggttccctctctgaagcattgcaaaacgaagacccggggattgagctcgtgacattctacaattcaggttcataaaccagtagaattattataactggatttgtttaaacagaagggtcaaggatatcgaaaagcacacgaattcagcatcttttaagacttccctctttctacattcgtatcaacgatacgtgagtttccaaatgttttaatacggtaatttatgtatgactacatttttgccaggtttttcaagttcaccataaattcctttgtttttgagaacattgagaacttagaaactctggatgggataaagtcgaaagtgagttcaaacataaatctaggagtaatgcatttttaggtattttctatgtacagcctaatgaacatggatgaatacaaattaaaattggaacactcacttatggaagagatagaaaatgtcgaacaaaggctcagaccgctgataatcgtaggtttaatgtttgtttcccactgtttgtttgataactcatccgttctatgacttcagtttaggtacgatctgccattgaaaaagaatgtgaagaatacactcaacgtgtcttttggctgggattttccgcaatttgttttcaagttggcgtttttgccaggtttaattctttgattcattacatttaatttgacttatta

SEQ ID NO: 36211 - DNA, 567 bp, Heterodera glycines
gaagagatagtacgccaaaatgagagaaattacaaagaaaaagaaaacgacgagatagtactaggcttttctctgcacagtggagttgacccatagtgttggtatattacctatctatatatataaattcggggcggctcgtttccccccccgccgtttcgctacttatcccgacgatttgctatttagcgactcgtcacaagacgcttcaagacggacgagtcttttgcccacacatggccaagtgccgacgctgacagtgacacgggggtcaatttgggacgacgccgcgggggacggcggacagcccaagggcgaagaagcagagaaaacaccacgatcagcacacatgtcatttttggagcacaggtggataataaagcagcattggcaaagcaaaacattgcgctgatttgagggcggacgggagaaagccctcgcggcttctccattcggtgttcgcgccaatctctgcgttgaatcgccgccgcaaacgaacgaaggcggaacgacgagcactcaaagcttttcggttcgaaaggaaatgccgattttggcggagtcggt

SEQ ID NO: 36212 - DNA, 587 bp, Heterodera glycines
ctgaggctttcgtttttatttattttttgcaaaattccttctagagtattttttcagaaagggttctgaaacgcacccacttttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagaccccccgaaccgatgcgcccagatttatggggagaccgaatccttcgggagtagcttccctatagcctgtactttaattctg

SEQ ID NO: 36213 - DNA, 1094 bp, Heterodera glycines
  misc_feature (28)..(28): n is a, c, g, or t
  misc_feature (57)..(57): n is a, c, g, or t
ttttgctcattaagtgccttcagtgttngcagtttagccttgtcaatgggcacgcgnagttgagggcggcgtatttcgtaaaagggcgccatttcgttgtcagtaatgctctgaatgcaagggatttcagtcttttttgatagaagacgagattcggactcaaattttgactctttaaaaagcaaattatgaaaattatccatttgctgttataataaagcacaattcaaataccaaccttaagcaattcgagaaaaattgttgcgacatcttttttgttttctttacacaagaaaaatttttgagcgatttcaagatcaggattcatttttctatctgaatgggaatggcaaatttggaaagcttttgattgaaaattgccgaatttaagagttaaaaatttaaaatcatcaaataaacaaaatgccataattattatttagcactaattagaaattatcagaatgaaaaatgaacattttctaaatttttttttttcttgacatttgaaaacgcaagtcttagagaattggaaaatgcacaattcatataaatatatatttattcgtcaatgagaacaaggaccataaaacatgcataaacagtgcaaacatgatacaattatgaaatacacatatactgtatatggcataattaaatagaacaacaaccatttgtgggagaatacattcagcaagacaatgccacagggatatggacatacaatatacaatatatacatacatagagatacaatgttctctttttttaattgggggattagtgttacagatgaatatattttttatttgaatgatttatatcagtaggttaaaaattgtttgtttatcgcagggctaggatcgaaaaattttcaaaatcagaacatcgggcccaaaaaatcagatactggggccgaaaatcaagaaattctgccaaaattgcttcaaatcagttatttttacaatgtttgatcaaaagtgtatcaaatattatatttttcatctcccattatcggttttaacaattttgtggagaaaattagcaaagcataaattttagcgcattcgagatcaaaaaatcagatttttaac

SEQ ID NO: 36214 - DNA, 1107 bp, Heterodera glycines
  misc_feature (959)..(959): n is a, c, g, or t
  misc_feature (1044)..(1044): n is a, c, g, or t
tttatgaatcccaacggggtgggctgtctgtttaaattgggctggaaaaataaagaaattttttacctacaccggcttccctttaatataccaaaaaaagtaaatttttaaataaataaattattcaatttaatatatttctgattatttaaattgaaaattttagtttggaaattttcgaagcaatggttttatttttcaatttttaatttaattccctaaatgaaattgttaaatacattttgtctgagcaatttaataatgttgttttggcatgaaatggtgtaccaccacaatttgtccgcgacggtcattttatgtacatttttgcctaaattgcagtcaattctaatccatcatttcatgtttgcctttctcgccaagcatttatcatcatgcctttgtgttgagactctatttacacacaagtccaaccaaattgtggtccattaattcgaaaaaaaatatttttttttcctacaatcaatcgcaaattactgggaaaattcaacaaaaaaaaagaaaacaagttttcatcataaatgatcggagagaataaaattattttatgttaaaacaatgaaaatatatttcaaaaacaataaataatattaattatccattaatatgattgcgtaaattttttctattattttaaatgaccacaagcagcacttcttctgaaaagggtgattatgaatttcattggaagaacccaagggagattaaacagaagtaaaatatatatatatttttaattttagaaaatataaaaacatttttagatgggagtcattcgcaaaatttgggcaatctcaagctcaagcaactcaagtcactgaaatcacagggaaaaacttcgataaatggtgcacaaattaagagttatttaattaattttaaaatgaaatcgctcgcaattttctaattcaaaccctaaaaaacacattattttttanatttacttttataaaattatttattttttaaatttattttacttaaatgaaattttagagtgcttatttttgctttactatttanaaattataattaactctcaaaattaatgtaaatgaaggtttataattaatcattttgaaaaat

SEQ ID NO: 36215 - DNA, 1744 bp, Heterodera glycines
  misc_feature (1039)..(1039): n is a, c, g, or t
tttccactcccttctcccaggggtattattttgtactcacccatgtttcaaaataaacttttcaaaccccatttttcgccctgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactaaaaaaatatgagtgatcaaactttcactaaaaagttaagcctaaactttttcccaaagttaaaaagcaattaaaattttattcacctccattattgatagaaaaagcatcagagtgcctaaactaacatgtaaataaaatttggtgcgtttcagaaccctttctgaaaaaatatttatgaattaattttgcaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtggggccttcgcccccccccccccctcccacgcccttcagagcacgacaaatatttcaacaaaaattttgaaaaattgactagagcaatcgaacgctaacggacgacctaatggaaaaaatccccgaaggagagaatttatttaaatcaattctttcgggggaccgtgccgggtggcgcggggtaaagcagtgctggttcgtttcatcacggaaccgaaccttttggctagtcagcaatcgttgcttaactgccagatcggacgggtgcgcatgattccnctgttccaagcaccccaccaaaagcaaaacgatataaccaaaatataaggaaaaattttttaaaacattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccaaagacaaaaaaatcgattttttcaagtgtccgtttggggta

SEQ ID NO: 36216 - DNA, 816 bp, Heterodera glycines
ttattttatatgtatatattttttattcacgatcctcaaagaaataacacaaatatagaattgaatttgatttaaaattaagaatcccaacaaaataattcaaaaaaaaagaaaataataatgatattcctttaaatgcgacagctgaatacttaaaaatatttagatatatatataagataaatcatggattatcccgcaatgtaaaaggagaaacaagggtacgaaaacgagaaaataatttattaaaagatatagacaaaaatataaattcaacattaaattattttaaaaattaaactgacaaagtcagaaactttgagatgtttgtttcattacttttattttaaataaataaagaagaaaaccttaaactttatacataatgtgaacaataagaaattatgatttgttaaaaactatcaaaaaaattattattatattgagccataaacagctcaaaattttattatctgattatatttatcaaaattacataaatattaaatattgctcaaatctggctaatataaatttaaataaatcttatatttacttttagcttctaattataatgaatgaaatttctaaactaaagtaaatgtttttaattttcaaaacaaggcaataaaattaatattggatctgctaaataatctaaaatacttaattatttaacatgacttggatttaaattttttacaaaaatgggaccttaaccgttacaacagacaaactgcaagtgcagctttgcaataacacagttcaaccaccatcgagatccacacttttaacgacgccaataacatcgtcaac

SEQ ID NO: 36217 - DNA, 698 bp, Heterodera glycines
actcatcagcaaaggtcctgccgacgacgtcagtgatgcccaaacgggcaaaaagcccccccccccccccgcaggtccaccatggacctgtgttggttggtccaccgctgccccttctttcatttacccacctctttgatgctttctctctcttcgccatgcttttccccccgagttattcagtcgttcgttcgtcttcgtttgtcctccccccccctcccttttctgtttcattcgctttcaccgcccctttccctttaatgtccaacaaagtgcaataaacgcaactttcgaattcgaattgtcgctctgtctgttgttactcaatggttgacaatggcatcggttgttctgccgccgttccgccgccgcccttccctttcaacgtgctaatgagcagtgaattccattctatgaacagaggcacaatttgcaaagatgaaaagccaacggaagccgagcggaagagaagagaaaatgagggagaagaagaggaagagaaggagaagggcacgaggacggccaagaagaagaagccgtacaaggagctgaccctggaggaaaaggtggagctgattcgacttgcggaacgctgctcaaacctcagccaggcgagcatcgcggaacggtacgcaattgcgaagagcaacgtgtgccgcattctgcagcggaaggacgagtacataatggcactggaa

SEQ ID NO: 36218 - DNA, 1208 bp, Heterodera glycines
ctttaaggttttgtctttgactttgcttttttgtcctctctagccaatcgaccacgttaattcattctctatacattttgtgtcttatttcatgaaattatatataatttaattttaaataaagaggcaaatttttacagaaaataaatagacgctgactaattagctaacatttataaagaaagtagaaatttgattaaatgcatatacaaaatattacttttttaaaatttgtataaagttcctagtcgtatgtgctttgcgttggttggttggcgtgggtgactgtggtggttgggccgtttttgcgatattatggctggaaaaaagatgcgatttcgctatggggagcgcggccgtctgggttcaagtgcttgcttgcgcttgtgctcggcattgaacggtgatggctgctgctggggtgccacctttgtcgtggcctcagtttctccagcgattggcagctgtcgaaatgaataaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctcggtctccttcgctgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatt

SEQ ID NO: 36219 - DNA, 553 bp, Heterodera glycines
aaaattgggtacttttccgttttggggtcaacgtttgaattttttaaaaaatcaaattcggatgagtagaattgcagaccaattcgaagagttcttagctcaaattgtggcatggcatttatgcctccgaaacaattttggcgagtagctttagcatttttacgtgccagctgctgattttaaaaaatcaaactttggctccaaaacggaaaagtaccaaaaattgtttggccaaaaacatttaattgaataaaacgacaaaaaaaagaatgttgtatacatatatttatttggtgtacgaagcaaaaaatgaatgttttggtgtcgaaaaaatcaaaataaacgagatgaggtcccttgttgctgcaggtaatgagaatatttgccaagctcctccggtttgagcagacgcgacttgaaaaaaaaggcaaagaatttgttaaaattcataaatgttttaaattattgaaattttaaaaaaatacgatgggagttagttaggtacttgggtttttgtttgattttatggaacatacccattttcgacaaaaaa

SEQ ID NO: 36220 - DNA, 841 bp, Heterodera glycines
cggctattcgggctttagtagtgcaatttgatttacctcctaacccaacgccagagcaagtgattaatcacttaagggccctacaataccgattagcatctaatgggtttgatcagtggaattagctcatgccaattattttgtagaattgtaaaaataggctgttgttggggccttcagcaagcctaataaaaaatttaaataattacgaattaatttgttttggcttttaaaaaaatattttggcttgtattttttaatttgttgatgtgtgcttctttagttttgtgtgtctgcggtagggccgaaacacactttttttcttattttttgttttcttttggaagagcaccgcactgacgaggcccactcttccattagaaatttttataacaaaaaaaatttttttcatttaattttttctcaggaattgtccgcaaatgtccgtccgcaaatgtccgtccgcaaatgtccgtccgcaaatgtccgtccgcaaatgtccgtccgcaaatgtccgtccgcaaatgtcccactgcgtaaagcgcccatccgatggatgggagggttgaaaaatagaagcaagtcctcctcctccaaaggagggggtggataaaagaaattttgcaaacaatatttgtcgaaatgttccatcttcgaaaacagttttaaactcataattgcatagacgaactcgaattgggtcaggtaattggcgtgccaattcgaagagacgaacacgcgacggtcaaagttctgtcgcttaagcattattttaataaaaaatttttttttaatattcaacaattattattcgaaaagaaattgccttttggaattttcg

SEQ ID NO: 36221 - DNA, 1079 bp, Heterodera glycines
  misc_feature (20)..(21): n is a, c, g, or t
attcaaaaatgcaatggccnngcggcggcgggacgcccctaccgggaggcgcaaaaagcaaggatggccgctttgaaccccttgctagctaggaatgtgccggcgaagaatggtgatccggcattcttcgagatttgccagcaaatctgggcaattctcggccaattcttgggtaagtttgtcttatttggtatggggaaggcgggagatggggggaatgaaaacggcaaaatgcaaaaataaatgcttgtaaggatggtaaagggaaaaatgagaaagaaaaattgcgagatgactatcagtggatcagtttaatggccgagaaatccattaggggaggggcataaatgtgtgcaaattatgtgatttatttaaaatgattgaaaatgattttaaatatatatatttatttgaaagaaagttatgaaattataattacatttaattgatatttaattaaatttgtccttgaattgtccttaaatgctaacttaaaaaaaaggaaaaactttgggatataatgtgaggttactgtaggttatattaccgatccggctttaaggggaattgaatccagtgactttcggctatttgaccaggccggaggaactcgcaacggcatgggcaacagtatgccggcgcaagttggcctgcatccgctgcaccattcgttgccaatgaagcgcctcgtgtcgtctttggcgcacgagggcctgcacatcctagaattccaacagggaaggcagtggccgagggctggcaccagcacgaagcacgatcatgggccattttttcgtgccaaatgtgccgaatttgatgagatttccggtggactgatccagccggaaatgcaagagtttgacccattgtgaattttgggtattttattattataaatttggtaactttgattttattatttataagaatataatttaaaaaaatattaaactcataattttaataaaaaatttggaaaatatcccaaaattaatttttattaatttttttttttaaatttttgggcaaaaagtttagaaaaaaaaaatttttctcaaaaccaaaaaatttttaaaatt

SEQ ID NO: 36222 - DNA, 1027 bp, Heterodera glycines
tatccctttttaaaaaaaagttataaaaataaaagtgcttttgggattcgggaccaaaggggtgtgaccaggatttttgagtgaaaaatttttccattaaaaaccatccaaaaacatggcattaggggttatttgggccgctgatcacgaatacgtattcaaattttacttttgacatcgttaagacctcagaatccctgtgtgattggggattctgaggcatcattttgaggggggggggaagttcgaatccggccggtgtacattatttttatgtgcattttttgattacttttgcatgtttaatttcatttcaaattaaataaatattatattattaattttcattttaataaatataaatagttttgtttaatccataaaaaataaaaatttttaatttaaattaaattatttttttgtgaaaaatgttttaaattaaaataataatttatttacttttattaaagaactcctgtattttttaaattagaatttgtaatattaatttcttaatttcaatttaaataaatattcaatccctgtacattttaaactctctttttaattaataaaaggaataatttattttattttttaaaatttattaattacattcaatatttaatcttactttttaataaacgatttccttaattatttaattttaaaaccatgattgtaccctttttaaccattattgtaccattccaacaattattgtaccttttcgacagtggttgtacctcatctaatcactgttgtacctcttctaatcactgttttacctcttctaatcacttttgttcaaattttaatcactgttgtacctcttctaatcactattgtacctcttccaataccttttccaacaaatcaccaaatttaaaaaacgggcgcgaagcgcccgtcgggcccaacaaaatttaaaaaacgggcgcgaagcgcccgtctggccaaaacaaatttaaaaaacggtcgcgaaacgcccgcccaagcccaacaaaattttaaaaacgggctcgaa

SEQ ID NO: 36223 - DNA, 1032 bp, Heterodera glycines
attattaataaaaggaaaggaggataatgatgaattaagaatgaatgattgcctttgcgccaagtgggggcggggggtaaatggccaataacaaggacattaattatgcttttatttgctatgctttgatattaaaaataaataccaatgctttgcggggaagtgaaaaaaaggaaataactgcaaaaatatgtaattaattagtgatggtaaaaaaaataataacaacacaaaatgcaaattaaagtgagtgtttacagcggcggcagagattatttgggccgagcgacccaattagggccaagggactgagggcggcggagagattggcgaagccaaaaacggcgaaaacgccttggacttctccaatttaattaaaaatgatatttgcacatttgttctctttttttccggccacaaatcccccgcttcattaagcccaacccccaaaatcccaaaaaatcaaattttaaccaccgccctcagccggaaaaagttggacagaatcggccaagacaaaagaaaggtcaggtgatcggtcggcggtcggtccctttgcttttcccttccgccgctgcgccgtttttttcattcatttcgcagcctatcgaaagaataaacaactcaaagccaaacaaaaatggaagggaccgaaatagcaaaggaaaaacggagggaaaagggggaaaaaggaaaagagaaaagggggaaaagggaaaaaagaggaaaagggaaaaaaaggaaaagagaaaagggggaaaatgagggaaaaggggaaaaagggaaaaaagaggaaaaggaaaaaagaggaaaagggaaaaaaaggaaaagagaaaagggggaaaagggaaaaaagaggaaaagggaaaaaaaggaaaagagaaaagggggaaaatgagggaaaaggggaaaaagggaaaaaagaggaaaaggaaaaaagaggaaaagggaaaaaaaggaaaagagaaaagggggaaaagggaaaaaagagaaaaagggaaaaaaaggaaaagagaaaagggggaaaatgag

SEQ ID NO: 36224 - DNA, 525 bp, Heterodera glycines
ggaaagaggagagagagaggagagagggcgggagaccttttagagggcgggggagagaggagagagggcgggagagacgttagagggcgggggagagaggagagagggcgggagagaggagagagggcgggggagagaggagagagggcgggagagagaggagagagagagggagagggagggagaggagagagggcgggggagagaggagagagggagggagagggaggaagaggagagagggcgggagagagaggagagagggcgggagagagaggagagagggcgggagagagaggagagagggcgggagagagaggagagagggcgggagagagaggagagagggcgggagagaggagagaggagagagggcgggagagagaggagagagggcgggagagagaggagagagggcgggagagagaggagagagggcgggagagagaggagagagggcgggagagaggagagagggcggtagagataggagagagggtgggagagagaggatagagggcgtga

SEQ ID NO: 36225 - DNA, 1234 bp, Heterodera glycines
  misc_feature (104)..(104): n is a, c, g, or t
  misc_feature (112)..(112): n is a, c, g, or t
  misc_feature (116)..(116): n is a, c, g, or t
  misc_feature (119)..(120): n is a, c, g, or t
  misc_feature (123)..(123): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (159)..(159): n is a, c, g, or t
  misc_feature (166)..(167): n is a, c, g, or t
  misc_feature (172)..(172): n is a, c, g, or t
  misc_feature (176)..(176): n is a, c, g, or t
  misc_feature (180)..(180): n is a, c, g, or t
  misc_feature (189)..(189): n is a, c, g, or t
  misc_feature (193)..(193): n is a, c, g, or t
  misc_feature (198)..(198): n is a, c, g, or t
  misc_feature (203)..(204): n is a, c, g, or t
  misc_feature (207)..(207): n is a, c, g, or t
  misc_feature (211)..(211): n is a, c, g, or t
  misc_feature (216)..(216): n is a, c, g, or t
  misc_feature (234)..(234): n is a, c, g, or t
  misc_feature (245)..(245): n is a, c, g, or t
  misc_feature (249)..(250): n is a, c, g, or t
  misc_feature (264)..(264): n is a, c, g, or t
  misc_feature (272)..(272): n is a, c, g, or t
tccctctctctctctctcactctctctcacctataatccatccacgggtgttgagtttagaaatttgttaggggaagaggctttttgaggagagaatgaagatnaaaagatntganganngantaagggaaggataaatggttnagnganagtggtganatatggnnagaanatgngatnattattagntggntggtngttgnntgnttantagtnggattgtagtaaatggantaaatttaaanttannttaaaattatttantttttgantaataaataaacacttaaaaaaaacacctcataaattattggaatccttttcgctttagtttatttttgtcattagttctaatgagttgctgctttttcaaagttcgctgtttttcgtccattcattgcttcatttttctccttttcttcggaagaggtcatttgaaagcagaagaaagaacggtaatattctgaaataacggaaatgggaaaattggattaaattgggaaattgttaattattccaacagtgccaaaggaaaagcctttcattgagaaagagaattaatattatttggctattactgtaaaagcatcattagacagtcagaagagtcggaaacattggtctgctggcaaaattgccaaaagcaataagcaatattagtcttccattaatgtccaactccgtctgaatccaattagtgccgtctttttcaggagaagcatttcagctgtgtctcttcccttccgtccggctttgagttttgtgcccaggggctgtgctttgatctcttccgcactgactccgttcgtcgtcttcgtcctttccctttttgtcccttcgtccattgctttctttgtccctttagggccaaatcctctcgggttgtgccaactcttccgacctttgcattgcctcgggctgttccctttcctccgatggccaatcagttcgtttgtctgctcattcttttccccattttgcctttctttcccaaagtttgtctgctgttgtgcccattccttctgcaatggcaaatcgccctctttggttcgggcgcggtggaaaatgtttcagaagggcgattatccaatggcaattgagggaggaagatggagaaaaagtgccaaaaatatgaaaaaggaaaatggggaaaataataaaggaattggaagtgaggaacaaatgccaatgaatacggcaagaaaaatgatgacaacaacaaataagccaaaaa

SEQ ID NO: 36226 - DNA, 811 bp, Heterodera glycines
gttggagttcatttgagtgttgagcagaaaaagagatagcgtgttttttcaaaattttcagagccaaactcgcccagaaagaaaatccagaaaaattagggtcgtcgctattattccgaaaatgtggttggagttcatgtgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctattattccgaaaatgtggttggaattcatttgagtgttgagcagaaaaagagatagacgttttttcaaaattttcggagccaaactcgcccagaaagaaaatccagaaaaattagggtcgtcgctattattccgaaaatgtggttggagttcatttgagcgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagcgttgagcagaaaaagagatagacgttttttcaaattttcaga

SEQ ID NO: 36227 - DNA, 1548 bp, Heterodera glycines
aaaaaccggtaattttagagcataaaaatttttggacaaaattttccaaatacaaaatttttattcagttttcgcgtgagtacctgttttttagcattagaattgttcagaagtatatgtatattcaggttgaccaagtttttttttcaaattcaggacatacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttattttaccatgttcacaatttgatcaaaatataggtggtcaaaagtgttgtcccatttcatttttaaaatattgcttctctggatcagcattaaaaaaatctaaaaaaattcaggtaagcataactttggatgctgatcaaaaaaggtagcaacaccaagttgatcagatcactccttcatggtgatctgatcagcccattttggctgggaacgaggggtaaatttcaaaaaaaatttctagggggttgggaaaatttttctggaaaatttgagtaggcccattttatagagcacaaaatttgctaccgaattgcctttggaatagtgggtctacgatttaggcccgctgagatacgtcgacttttatttcggtgcctataaaaagtactgtatttcttaagaaaatagtgcattttacactacgtcaaaattgaagtgcccatacctcagccggtataagtcatagagacatgcggttttttgaatattgtagagaattttgtgctctataaaatgggcctactcaaaatttccagaaaaattttcccaaccccctagaaattttttttgaaatttacccctcgttcccagccaaaatgggctgatcagatcaccatgaaggagtgatctgatcaacttggtgttgctaccttttttgatcagcatccaaagttatgcttacctgaatttttagatttttttaattattgatatttgtgccaaaaaatgaaatgggacaacacttttgaccacctatattttaatcaaattgtgaatatggtaaaataaatcaaataaatgtttatgtcacaaatgcaaatatggtatcattggaaagcccataaaaaatgctatccaatggtatgctacttatctgttgaaattggaaaatgacaattttatacgcaattatttttttcaaagcatgatgggacaacacttatgaccatgactgtaatatcatttttataaaaagggggtgggggcgcgccgaaaagcggcgcctaattttgatacatattggactttttcttacataatttcattttttttacatattttgaagaatttttacggaaattttttggaaatcctcaaaaaaagtccaaaatttcggcaatttttcgtaaatattttcattttttttacatattttgagaatttttgaaaatttataaaattcttatgaaaaataaaataaccaaaaattaattttt

SEQ ID NO: 36228 - DNA, 870 bp, Heterodera glycines
  misc_feature (684)..(684): n is a, c, g, or t
tttgttaaggattttttcgaaaatccttaaaatagaggcacattaagcacaaaaatcccgaaataggccaaactaggcattataaaagtcatcgtagacaccccaaaccaagcggaaaatgcgtttttcgtgcttatctgagcgtatgaagtgaagtgcgcaaaggcatttgcctaaaattcgcatccctagtaattagtaagtctaaattaattcgggaatcaaaaatgcaactctgaaagcctgaacattgggaaaatttaggcttgcaaaaaatttgctattaatttttcgtttgaggcatgactcgtggaaggaacgtttttgatgggactgatatggccggtgtggaaggggtgggaacgaacgataaaatggcattggcactcctgctgcggggggatgaatgtgagcaaattttgtgcggagagggacgagatgggattgattgttggaatttgtattttttttgttggactaatttggcctgttgtggtgggtggcacatggcaacattagacgaatgaagcaatataaatgtgacagggattaaagcggcttaatcttcctctctattttcggattaatttattcccccgaggggatgaacgacaaattgggaacactaaatggcctccgagggataaaatgggcaaaatgggaggagaggcgggggggaatggnaggtggtcatcggtgatgggactgattacggaagtatttttggtgggactgatatggccgggtagggtggggggaggggcgaaaaacgacacatggtaacattaaattgaaaaagcagctaatctctctttttttaaattaattgattttcccccgaggggatgaaaacaaattggtggggacact

SEQ ID NO: 36229 - DNA, 1425 bp, Heterodera glycines
ttcgaatgattgtatataccaaatttgaattgcctaaatgtaaaaaaaaagtattttgaaaaaggtagaaaaaagtaccgtcaaactgatattggatgatgttgttgaacaattcaagcaaaaagaaaatcaaatggtgatttgttggagttgagaaaatgaaccaaggagtgctaaaggaaaatttgaatgtaaaaaaacaactgacaaattgggtggacctaaatgcttcaaccaaatgcactaatttattagcagtaaccatcgatagcgatttgagataaggagaaactgaaaaaacgaattgaaaataatgcaaaaacaaaagaaaactttaccattcacgacaattgtaagaagacaatcgaaaagtgactgcaatttgtgatttccgctagtgattaatttgtggaaaacctaaaacatttttgaataaataaaaacatgattaaaaaataacaattatcagcaaatcggcatgagatccggtaaaaattggcacgtcaataagtcctcgggaagtgaaaggctaaaaatggagtaattaatataatttcaatcgtgttttatcagtcgaattttgacttgccttattcaatcggacaccgaaatttctttcaccactcaaaagaagaattaggaaaacgcccatatgaatcaaaccaatccgagcttaagaacaaaaattcaattaaaagggtacttagaagaataaaataaaacccgacttgggtccgtcctcgaatcattgagatggaacaaaattgggacgagaagttcaagcacatcgctgcttttcagcacataataaaggaatttctgtaacaatccgataaaatagtgaaaattgtagccactgtaaaaaggacctggtagtactcacaacatttccatagcaaaacaagcagttcctggtgcagttcaaccttcttcgtggagttcggcagataagaagtttgcaactgactgttaagaagtcgggtgaactcataaagagaaaaagattgaaattaataatttgacaggacggccaaaaattttttaatgtcttttttggtcggtctttgccgtggaaaaggttaaattttgaaaagggacaaaattcaaagaaaaaaaatttgaagtaaaaaaagggaggaaataaaattgagcaaattggaggacaattcaaaaggcggaaacaaacgatcaatgcccactgacgacgaatccattggccgaaaattaagtgacggacacatccctcccccgggggatggaactttcatcaagccattcattcattcattcgtgctataaaccccgaggagattcttgcctagcaaccaagacgaagcccggggggtccattacaggggaggagagggcacttaagatggcccaagggagaaaccgagacagtgacagcacaaggagaggggtgag

SEQ ID NO: 36230 - DNA, 879 bp, Heterodera glycines
tccatcccctgctatttctccccctttcctctccctcttttccgctctctttacacaatttcttctccttctttcgtcggagtgtctcccaccaattccaactctttccccataatttgtctcctcaccaaaacttaccaatgaaaggactaaaaaaggttaaaggggcgaaaagggctgctgagtttatagcgttattctgtgcataatttatgcattcgcagaagacatcagaaaaacatccgcaagtaccaaaagaaaaacaaacagttgaataattcaaaattcagaaaattaaagcaacaacccaactctaatcgcttcttctccttccccatcctcttctctcacacattctatccctcctctctctctccccctctctccccctttctctttctctccccccgcctcccctctctctcccccgctctctctctccctctctctctttttatatgtctctctctccctctctcttctctctcttttttcatcgctccctttcaaattttaggtcattttctcccccttccttctcacaaaaattcgccaccaaaagagtctcttctcatttattgccaacatttctgggtgaaacctgagtgtttctccctccccctccctctcttacacagcaggcatttgctcaataataaacggaacattatgtgcggccatgtatttttcgggatcagtgcctccgagttctttctcagaatcaatttgcgagcgttttccaatttcttcataagattatatggtaattccaaaaatgtctcaatttccgtttcaacgtcatcttcatctttttgggcatggatttggacagaatgcggccatgtgttttttcggttcaatgtctccggattctttcga

SEQ ID NO: 36231 - DNA, 979 bp, Heterodera glycines
  misc_feature (55)..(55): n is a, c, g, or t
  misc_feature (923)..(923): n is a, c, g, or t
atataccaatcgatagctctcggtctgtaatgtaagacttcgaaagaactttttntgcggcaacaaaatccctgaagggttacagacccgggactgaaatggccaaatgcctttgggactgaagcgtccaactggtaaacatgtgtccgatgtttgaatttgtgtggcgttatgtaattgttttgcgttaaaaaatgatttgaaaatgcgtgtgtgtgggagagggagggagtgtgaaaaaagagagagtaagtggaaaagtaaaagaaataagagaaaagaaattaaagggagagaaaatagaaaattgtctcgcatcccttccttatttatatcccatcttttattatataaaatatttaataaaagaaagaggaaaatggttctttttgattcctgtttttgtttgtgagaaaattttgcctttacttttctacattatttaatgatttttttgtttgcgattttcacttgaatttgttaatggtattaaagaatttgttattgttaaagagaaaagaattttatagttaaagagcggtgttttttgattttgtttagtaaaaaatgaagaagcaaaagattttgaatttgttttcattttgtaataggaaaaagctcgactttgaatttgatttgtgctttgattagtaaatgactatatgtttacacttattttggcattacggtttgccaagtaagaaaggatttgctgaagttgagtccagtgattgggataccgaagaatttgagtctcgatgattgggatgcagaagattaggtcacagtaattggaatgcgaagaattggtgagactgagttccggtgattggaaggtcgaagaatatgtgagattgagtccaaataattggaatgccgaggttgttgggattaagttttgaaagctgattaaatgccaaganatgttatgccataagaaaatgccaagaaaagggtgcgaggccgcgaagcggccgag

SEQ ID NO: 36232 - DNA, 1359 bp, Heterodera glycines
tgacttgacattattaaatgaatattaaaatttctggaaaatgagtcaaatgttggtccctttcaaaaaatttttctagctttttaaatttcttgaaattttgtataggcctatattttgaccccctctagcgattccaagtttattttatggaacttaagtttttaactcgagatcggctcttcagttcttacaagggaaaatctcggcaaaatttttaaattagtggggttttttggcgttttgaatatatgtaatgagaatatccgaaattcagtttttttcaattatactttggaattattttttgtttatgtctcgagcacaaaaattagttacacaaacattttgcagacagcttttaattgataccacgaattagtttgtattgttttagatttgacaaataaaatgtccccttctctttccgttgccaactcaaatgtctctcgaccgcttggccaaccaaaagtagcgggcttcaaagataaggataagccggaaagtgttcgtactagcaacattgtggcagcaaaggctgttgcggatgcggtgcggacgagtcttgggcctcggggaatggacaaaatgatccaatcgggcaacggagaagtgacaattaccaacgatggggcgactattctcaaccaaatgtcggttgtgcatcccaccgcaaaaatggcaagatttgtgttgtttgcttttatcaattgcactgttcagttggtcgagctgtccaaggcgcaggacattgaggcgggcgatggtaccaccactgttgtggtgttggccgggtctttgttggacgctgcagaaaaacttcttgccaaaggttgattaagctcgcttatacgccaaattttagcacttttgtttttaaaggaattcatccgaccaccatttccgactcattccaacgggcggccacattttctgaaaaagttctcgaggaaatggccacacccattgacattaacgatgacgacgagttggtgaagctcgccatgacgagtttgaactcgaaggtcctcagttcactttctgcactttctttcgtttgcccattgtttccttcgattttccttttttcaggtcgtcccgcaatattcccatctcttggcaccaatggcggtgcaggcagtgaagaaactgatgagttcaccggaggactcaagtgtcaatctgaagttgattaaagtcgttaaaaagttgggcgaaacgggtggaggagtcgcagctcattgagggggcgctgatcgatcagaaatcgatgggccaccgaggccccgcgcgggtggagaaggcgaaaattggcctcatcccaatcccaatctcaccaccaaacccaaacgaacgtcc

SEQ ID NO: 36233 - DNA, 1208 bp, Heterodera glycines
  misc_feature (1096)..(1096): n is a, c, g, or t
  misc_feature (1186)..(1187): n is a, c, g, or t
atcactgggactcaattctcttgcatttcaatccctgtaactcaattctcttgcatttcaatcaccgggactcaaccctccagcatttcaatcaccgggactcaattctccaggacttcaatcactgggactcaaccctccagcattccagtcactgggactcaacacaccagcatttcaatcaccgggactcaattctccaggacttcaatcactgggactctattctcctgcgtttcaatcacccggactcattctcctgcatttcaatcactgggactcaaccctccagcatttcaatcactgggactcaattctcttgcatttcaatcactgggacctaacctcacctggtccttcggcattccaatcactgggactcaattctcttgcatttcaatcactgggactcaattctcttgcatttcaatcactgggacctaacctcacctggtccttcggcattccaatcactgggactcaattctcctgcatttcaatcactgggactcaaccctccagcatttcaatcactgggactcaattctcttgcatttcaatcaccgggactcaaccctccagcatttcaatcaccgggactcaaccctccagcatttcaatcactgggactcaattctcttgcatttcaatcactgggactcaattctcttgcattccaatcactgggacctaacctcacctggtccttcggcattccaatcactgggactcaattctcttgcatttcaatcactgggactcaaccctccagcatttcaatcactgggactcaattctcttgcatttcaatcactgggactcaattctcttgcattccaatcactgggacctaacctcacctggtccttcggcattccaatcactgggactctattctcctgcgtttcaatcacccggactcattctcctgcatttcaatcactgggactcaaccctccagcatttcaatcactgggactcaattctcttgcatttcaatcaccgagactcaaccctccagcatttcaatcactgggactcaattctcttgcatttcaatcactgggactcaaccctccagcatttcaatcactgngactcaattctcttgcatttcaatcaccgggactcaaccctccagcatttcaatcactgggactcaattctcttgcattttcatcactgnngactcagacaccagcatttca

SEQ ID NO: 36234 - DNA, 925 bp, Heterodera glycines
agtgatgggctagcgagtgatgtccgtaggaataaaagccaaggcgtggctgcgtcccgtccaacaatttcctaatgcttagtgatggactagcgagtgatgtccgtaggaataaaagccaaggcgtggctgcgtcccatccaacaatttcctaatgcttagtgatggactagcgagtggtgtccgtaggaataaaagccaaagcgtggctgcgtcccgtccaacaatttcctaatgcttagtgatggactagcgagtgatgtccgtaggaataaaagccaaagcgtggctgcgtcccgtccaacaatttcctaatgcttagtgatggactagcgagtggtgtccgtaggaataaaagccaaagcgtggctgcgtcccgtccaacaatttcctagtgtttagtgatggactagcgagtggtgtccgtaggaataaaagccaaggcgtggctgcgtcccgtccaacaatttcctagtgcttagtggtggactagcgagtggtgtccgtaggaataaaagccaaggcgtggctgcgtcccatccaacaatttcataatgcttagtgatggactagcgagtggtgtccgtaggaataaaagccaaagcgtggactagcgagtgatgtccgtaggaataaaagccaaggcgtggctgcgtcccatccaacaatttcctaatgcttagtgatggactagcgagtgatgtccgtaggaataaaagccaaggcgtggctgcgtcccatccacaatttcctagtgcttagtggtggactagcgagtggtgtccgtaggaataaaagccaaggcgtggctgcgtcccatccaacaatttcctagtgcttagtgatggactagcgagtgatgtccgtaggaataaaagccaaggcgtgtctgcatcgcatccacaatttcctaaccttagtgatg

SEQ ID NO: 36235 - DNA, 794 bp, Heterodera glycines
acattatttctccgttctggatatgacaaatgtacccttgaaataaaattatattttaattagatatgcacctttttgcttgaggtaattaaataaaactttaaagcatcgaagattatggccaaggagggcgggcggaagggagtaagtgcttaggaccaaaatgaaaaagcctaaatgaaacgcgcctgccgattataaaaatcgcagattcattaaccgaattgaaagaggccccaggcgccgcctattggcctcacaaagctattcatttaatatccttaaattgatttgttcatacttttaagggcttaaataattaatagggattataattatagtaaattcaaatagttttgtttttttacaattttcctttttaaaaaaacgcacgcaattaaaaattgatttatttagtaaaattaaatgttttttaaattttatttttgaaatctatttttattaataagaagattaaagttaaaacaaaaaaagttattacaaaatgcatctccctaaaaatgaaaatcttgaataaataaattatttcctactttttttatattaaaaattcttaaaaaacgaataattcccaaaagggtctcaaaaatctcaaacattggttttagcataacgaaatatcaaaaatgaccatgtttaaaacgtgatgagaacatttgcgacgagggagtgggaaacatgatttcaaaattttcaattttttctagtctaatctactcaaaacggttcagaattcgataaaaataacattcacggtgcgaaaaatggggttt

SEQ ID NO: 36236 - DNA, 992 bp, Heterodera glycines
  misc_feature (933)..(933): n is a, c, g, or t
cttccaccagaggacgtcgcaacaatcatcacgcagaaggtagtcttcaacgccccgttcgacaacaaggccacctactacatgcgggtgcgtttggcgtggtgcacgtggcatgtggaataacccccccccccctttttcaggtgatcaaccctgggacgaagcgcatcggctacgccttcaagaccaccaaaccgaagcgcatcaacatgaacccgccgaacggagtgctcggcccaaaggagtccgtcaacgtggccgtctcctgcgacgccttcgaccccggcagcgaggacaccaagggcgaccgtgtgaccgtggagtggaccaacacgccggacccagccgccaccgcgttcaagctcgagtggttccagggagacgggatggtgcgccgcaagaacttgccgatcgagtacaacgtctgatggaaggatgcttcgtcacctcaacatggacatgataggatcccaccgtcccaaaattgtcattttgtcccccatcatgtaaattgttgtatctgtatgtaaatttctgtgatcatcacttcaaatgaatgtatatttaattgttgcctatgtaattgtatagttgttgtgcttaataaatgctcatatgtgcttcaattcaactgcttttgtaggaaggggggcggggtggtaaaatttggcgtctgtttggtcggagggttagctcgcgtagaactcggtctgctcactccttgtaaattcaggtcaaaatgagttttagacaaaagtggtccttcctataagtctaccagtcacacatttcgtttggaattcgaatgtcagccgcccaaatttggagataaactgaaattcagagtgtgcccttccttctgtttcaattcctgagataggtaacactggtacaaaaatgacgaaattcacaaataaggacagaactcgttcnaaaaatcacaaataacaagccggacaatcaaatctttccctttgaaaagtcattgcttg

SEQ ID NO: 36237 - DNA, 1033 bp, Heterodera glycines
attaattaaaatcattgaaaataacgtaaaaatgcacagaaaaataatgttacaccgtccggactcgaactttgcccccccccccaaaaatgatgcctcagaatccccaatcacacagggattctgaggtcttaacgatgtcaaaagtaaaatctgatcacatattcatgatcagcgtcataaaatagccctaataacatgtttctggaagatttttggtgaaaaaatttttccactcaaaaatcctggtcacccccctttggtcccgaaccccaaaatcacttttattttggtatcattttttaaaaatgtgataaaaatatgaaataaaatttatttggtagagcaaaaaattgcggattttttcagtatttaaaatttcaaaagcacctttacggaaccgagttctgaatttttttctgaaaattcggatttttccagaaattcttgaataactttttttcatttgaagatataaatttcatttaaatcccataaaattctcctgatttttctctatttttaaggctttattcctgtaaaattgatcaacccttcgatttgttatgaattttaaaatattaggccaaaatcccgagggccaaaaaattgccaaaaaataaagaatttttaaaaaattccaaaaattttgaaacgaaaaataaacatcatattcgtgctcagcacatcaaaataccccagaaaaatatttttgacccccattttcaacccaaaaaaaatttttgaaaatttctagggggcctagctcgaaaatttttgaaaatttcccgccatatggcacaccattagatagagcttcaaaagctctacaattttgccctaaggcgttttttcgataaaaccaacccctaacgagttatggacccgggactcaaatgtcccgctcgggccgaaaattttttctatttccgggaaaaaatcgaaattttttcgaaaaatatccacccaatcgatgagagccatgaaaaaaccggttgctatgaagagtggtctctcgtttttctgggaaaat

SEQ ID NO: 36238 - DNA, 911 bp, Heterodera glycines
  misc_feature (869)..(869): n is a, c, g, or t
gctcaattataaattaaattatctatatcttttttgagaatgtatttttatgattgaaaaaattatgttcaattaatttatattttgctttaattcgaaatagttaaatagaatatattaaatatcataagtgatagaatctctataaatctctcaataatgtaatgggtcgcgccgatataggaacgaaaagaaaatatcattaactaaattgaagtgcaattaaaattagactaataaattttaaattaatttaagtctaaaatttcattactaaataagtttgtatgtaaatgaaaacatgtaaaagtaaatgatactttttcttcatactaaaataagaaattaatttttgggaatatgaaaatcaaaacaaaaaatcataaaaggatttcaaaagtgtggaaactgtgcagaaaatcaacaagtacttaaaataattttcaagctaaattgtcattttcttgtttcaaattttaaactaaaatagtatatatttcattaataagaaactttcttgtaacatttaattattattttttagtagagaatgttttttcctttttaaatttttttgtttttaatattgcttatccttttgtaaaaatttactaattaaaattaaattaatttaattattttgaattttataattttttacttttattaacgttattaatactctttttgggtttgccttacatttcgaattttcaggtttgactattaaggttcaatatttttttattcctataaaaatcaatttcaattcaaagattaagttttaaatttagttgatcgataagttttaagattttttatataatataaaatcgatgtatactataaaatatattaaattttattanataaatgatatttgaataactttttatggttatttttttgat

SEQ ID NO: 36239 - DNA, 793 bp, Heterodera glycines
agcataatattctcactccacagatcacttttgttgcccacagctgggtaattttagttttatcatttgtttcctttttgttttcaatttcaagttcaacattctccgttttccgattgccatcttcgcaatgatcggctctcaagccattcaaacagccgttagcaatcgacgcctcaaacattttttggccgccgaggaaatggagcctttgttgagagggagaccaacttctggtttccaaaaaaatcgtttaaaggaattttttgcaatttagaaatttcgataaccattaaaaatgctgactttgcctgggaaaaagatcgatctttggttctcaaggacatcaatttgtctgttcggaagggaactctgttcgcaattgtcggtttgttttctcaagttctaagtgaaccgacagacaatccgtccacttttaggaaggaccgggtccggaaagagcagccttttgtctgcaatgcttggttagtgatttgacttttttacttttttgtattcggatttaaattaaggcgaattataccgcaaatcgggggaaaattctctaaacggaagtgttgcgtatgtgccgcaacaggtgtcctttcggagtgttgtccaaccaaccatctgttttcatttaggcttggattcagaatatgacgctggagaacaatgttttgtttggccatgagtttgactccgaccgttaccaaagtgtgctcgacgtgtgcgctttgcgacaggatttggccgttctgcctgccggagaccaaaccgaaattggagaaaa

SEQ ID NO: 36240 - DNA, 919 bp, Heterodera glycines
  misc_feature (896)..(896): n is a, c, g, or t
aattaaaataaattaaatgataattaaaataatgttcctctacctatagtgtgcatttgggggaagcccggccgggcattctctccccccccccctcccgcgcgttttgaaaacgtaaaaaattaaaatattttattcaaaaactccttaaaaactcaaacctagcaacttaaactttttccatattttatgaatcgccaatctccttgttatcagaacagttccagtccgcgtttggtcgaccgacgaaaaagtgtaaaaaccaagcatttggtttctgcacatgatttttaatctaattattagattatttaattcaaaaattttaaagttagctcttttgtatagtaaaattatgctaattttcaaatgaagcaaaagataaaatttttgttaaataataatacaatttatttaaaaatagcgtttctttcaaagtttttcagggttttattgtatttttggggtctagatcaccatgaagaagtgatctggtcaagttagtgctaaatacttttttaattagtaaaactaattagggagaattttgtattaattacttaaggtgatccactcccaacaaaaagtgccctccacgggcactgtaatttatatgcccggattgcccggctcacacaaacactgaatgatgaaatgaatcaatgagataattttagagttcattttgacaaattgttcgtcaattagttgttgaattttgtaattagcaaaatataaattatttatcctttaattggtactcatttttcaatttaatgctgtttttttttacatttttcattattttgcactgactgtatttaaatgaattaacgaaattgaatgcgaaaatcattggcattcatttgctcggcactttctgctggcaattaatntatccgccactctttcaaacttt

SEQ ID NO: 36241 - DNA, 926 bp, Heterodera glycines
tttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagatcgaatccttcgggaatagcttccctatagcctgtactttaattctgcgttggatttttactccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatcttcggggatagctttcctatagcctgtacttaattctgcgt

SEQ ID NO: 36242 - DNA, 1414 bp, Heterodera glycines
  misc_feature (58)..(58): n is a, c, g, or t
  misc_feature (126)..(127): n is a, c, g, or t
  misc_feature (140)..(141): n is a, c, g, or t
  misc_feature (158)..(158): n is a, c, g, or t
  misc_feature (182)..(182): n is a, c, g, or t
  misc_feature (241)..(241): n is a, c, g, or t
actttttttctaaacccctgatcaaaaaatgctgctggtaggatttaagtgaagtgtnttctaatttcaaaaaaaattccaggcctttacctatacttgggagggctgcagaaatgggcactttcnnagtaccacttgcnnccagttcagtcccgttngaataactcattaggcttgacctngagcgcagggtggccagcagacttattgtagagctcggtgagctcgattttctgaaatntaaaaatttcgaaaattttcaaaatttttcgagctaggcctaaaaaacggttttcgggtttttgaattttaggaatttttaacgaattttcccagaaaaacggagaccacttccaaaacatagtttttcgagctctatcgactggtatttttttcggaaaaatttcgattttttcccggaaatagaaaaaaattttggcctgagcgggacatttgagtcccgggcccataactcgtcaggagttgattttagcgaaaaattgtcttagaacatttttgtagagctttcgaaactctatcgaatggtgtactataagtctggaaaatttcaaaaattttcgagctaggccccctagaaattttcgaaattttttttgtgggccaaaatgggggtgaaaattttttttctgggctattttgaggtgctgaatacgaatatgatgttttttttaagtttcataatttttggaattttttaaaaattctttattttttggcaattttttggccctcgggattttggcctaatatttgaaaattcataacaaatcgaagggttgaccaatttagattaaataaagcattaaaaatggagaaaaatcaggagaattttatgggttttatttggcttttgtatcataaatatgaaaaaagttattccagaaattctggaaaaattcggattttcagaaaaaaatttataactcgtttctgaaaagatattcaggaaaagtacaatgcttcaaaattacgcaatttttaactttagtgtataaaccgtatccgacacctttatggcatgtatacacgagagaatcaatgaatgagaaagccgggactagtcccggtcaagaccggggcttcggtactcagttgtccgtgttcgggtcccggtcccgctcaactctacttaatgctgaataaaaatttttgaaaattaacaaaaacaatgaaaagttaaaagctttttaagccgaaaatcctctataaaaatattcgaataatgcttttttgtgacgaaatgatcgctcaagttctacaacattgagatgaatatgatcaaaaaagaaatgaaatttgtacaaagaaaaaaaaagtattaacaaaaaacggactcaaagtacaaacaacttggaggaactatcgtttagcaattctctttaaaagcagcgac

SEQ ID NO: 36243 - DNA, 1141 bp, Heterodera glycines
  misc_feature (67)..(67): n is a, c, g, or t
  misc_feature (991)..(991): n is a, c, g, or t
  misc_feature (1073)..(1074): n is a, c, g, or t
  misc_feature (1124)..(1124): n is a, c, g, or t
aaaaaatccagagcggcgtctctcggcacccatatttcgtttgttttctacaaaaatgcaacattgngaaaaagggtcgggtcgtggtcaaccaccacacgaaattttttctgtttatgacatggaatggatcccttataaaacatatttattgcaaggcctaattattatcaaaataaacctccaaactggtaattgatgaaaacatatttgcacagtatctccgtattcgcaacgtccacaaaaccctcgtcatgctcctccggtatatttttttgaatggcaacagataaatgtcttttgaagaaatttggcaaaactccacgtagagaacagagcatttggcaatgagtagggcttccttttttaggcacaaaaatcgagaaataggcacctaaaaaggcacaaaaatcttctaataggcataaaaataggcaaatacaatttttattatagcaaaacacggtaatagtaaagctggtgtccccctcccccttcgtagaaaaaatttttctaaagagtcgtgaaacatgttttatgagggttttgagagccgctgataaatatgacatccgaccaattgcgaacccggacccgaattcgaacaaaaagtcgaaaattcactccaccaaaactcatttaaaaaataaactacataaaagccatatttgtttgtgatcagcgaagccccaaaacccgcataaaacattttcttacgattttttataggaataaacaatttttttcggctctaatgcagtttacgcgtccaatcgacttttagcgtccaatcaatgactatcctcggtttcttaggcatcatttttttctttcttgcttaaaacttacattcttggtatcaatctagagcttaaagtccaaagaagtttgttaggaaaattattggataaatgcaacagacaaatatttcgaatatacgcgaaaaataatgaatttcaggtttttttcattgcaatttttttcttattgntaatatttgctcttttcttgtatttgtaaattcccgagactttaagctctcaattgataccaaggatgtatggattgaccanngtagaacgttatggcctaagaaccgaggatggtcattgattggacgcgtnaactgcattaagccatt

SEQ ID NO: 36244 - DNA, 849 bp, Heterodera glycines
  misc_feature (17)..(17): n is a, c, g, or t
  misc_feature (684)..(684): n is a, c, g, or t
  misc_feature (739)..(739): n is a, c, g, or t
attctgggttgaaaccncggtaaaaaattataaaaatttcatttccccatccaaaaatgggtttttttgtagtaaattaagccccgttcggctaaaaatttggtaccaaaattcccaataccccaccttggaagtgatcacatggaacttctccaccggatgttgcagttgttcaatggccaacggatagtcgtcgtttggcggcgggccggccaatgcgttttctctggcgctgctagcggcggtggtggaccgatgatgctctttcggtgttctcctctgctaaaccgcaaatatttgaatttttaaacaatttttttggcgttttgcccaccggtcgggaatggacaattttccacacattgccccgtattcggagttggacacagtgctcgacaaagcgatggccgaccgcaaaacaggcggacgaatgggccagcagttggcacgtgtcctgctcggcgggcccgggcgctgccatcagcatgcaatctgggaaaagcaacagaagtacaccaattttcgtaagttataacaaaactaaggtggactaaaatttgtaaaatttgtgataggtgcagaaatttttgaattttagatcttccttgatggaggattttaaaaatcaaaggaattttgaaaacttaaaaattttgtcgctaaaacaggcaatacgaagggtgnggtggacagggaattggtggggatccgccgcccgatggatgttgactgaccatgngtccgatgggcggcgtaaatgttgagcagatgcggcaccgttgccggcgttttcgggcggaaacgaatgtgcagcacgcgcaggcccgaggcgcgcaacagctgctgctg

SEQ ID NO: 36245 - DNA, 893 bp, Heterodera glycines
  misc_feature (711)..(711): n is a, c, g, or t
  misc_feature (783)..(783): n is a, c, g, or t
  misc_feature (820)..(820): n is a, c, g, or t
  misc_feature (883)..(883): n is a, c, g, or t
ttgctttaagtcaaataacaacaatttaaaatttaaaaatatttacattttctatttttgttttatttttaataatgtccacgtgtacatatttattatgccttaattaaatgtacttttagtcaattaatgaccattgaacccaaatttcagccaaaaacgcaatttttcataaagaagacgaagaaaatgctggcgccgataatgagtaaattgaggagggagggataatgaaaagctaatgaaatataaaatatttaattagtttaaatatttaaagaggaataaacttaatttaaattttgcaattgatcattggtgcttatttttgcctttagccaaggagatgaagctgttcccgtcccaaccgcttccgtcccgcgttaaaaatggtttgtgccggtattttgggaatcattctttggtttatcaatgatgcagggagggttttgaggttttgtttagcggtacaaattgttaattatgcaatttcgagcaaaatttccatatgaaaaacatatgaatttaatttgttttaattggcaaaatatattttggcttggctttacgatacaaaaaacaaacaaaaaacaattatgttttgtgtcatgaattaattaatttcccattttcagtgcgttcgcgtgcgcaaagtttgaaagagttttatgcggtacgttcataaaattatggcaaatgtttaaaaaaagncaatgaattaaatgtgaaataaatgccaaatgaataaggaatggtagaaattaatttaaaaagatattcggnaccaaatttggagcagggaaaataggagaagggacgngacaatggcactttgtgaacaaattttgaaagtgaaatctccgccatttttctgtttcatcanaattgcaatt

SEQ ID NO: 36246 - DNA, 939 bp, Heterodera glycines
  misc_feature (24)..(24): n is a, c, g, or t
cggtgcaccagaaaatgtcgccgnttgaaaagacaatttcgttaaaaaaataatttttcaaactcagattttgcaaaatctaattatgcctatgacttttcatcaagtactcgattttctcaaaaattgatcttttcaatggcgtagaactcaagtctttcaactaaaacccatcacaacaattcggcattttaaatttgccttcatatattatagctctttctaaaaccacttattagttatatgccactgaggataatatgaattttaccgccaacaattttatagaaattaaacattttggaaatcaaatacttgatgaaatagccctatttgataaaaatcatttcgatcatagctataaagcaacaatgttagttgagatagaaatttataagaaaatctctatagaacaggtttcaatcagatcataaaaataaacggtcaatttcacaaatgtaaaggcggctcgatgaatggaaaaatgtttgtcattgaggctggcggaaaacgaaggctggcatacgctgcggcggagccacatgttgtggcggagccacatgttgtggtggagcaacacgttgcggtggagcaacacgttgcggtggaggagccatacgttgcggcggagcaacacgttgcggtggaggagccatacgattcggcggggccacacgcggcggcaaatgtaatgcaacatgaacacgttgaggcagcatcggtggaatgatggctcgtggttgctgtttcgtggacggtccaggcataggcgacgccgggatgttaatctctacgccggactccttaagaatgcgaaggattgcttcgcgatcgtgacgcttgaagtcctcccacaacatgcattgtggcttaacgcacttgtcgcacttcgctatagtcgggtctcgtggatggcccaacaatataaatataataaag

SEQ ID NO: 36247 - DNA, 1227 bp, Heterodera glycines
  misc_feature (7)..(7): n is a, c, g, or t
  misc_feature (1055)..(1055): n is a, c, g, or t
atcaatnttggtgaataatccattgacattcttttgccgatggatattaaagccattgcgcttaaattaaatgtccaattctttgtcttcctttacctgtagaggccaatgatgccgtcgtgtttggcaattttggcaaaacaatcgaccagccctttgaattcgcgggtggcaacatctgtaaaaagggaaagaaaaactcagaaaaacgagaaaaagctcccacagaaattttttttctcacaatcagctcgaaaaatatgaatttataatctttaaacatttttcatcaaaaattgtgcgagtttttttggaccccgcaattattttgcattgaaactaattaattttgaattttacctgagaaattaaccaactgaggcggaattttggaaaacgcagaaacggaggaatgggtttcgaaaatggtgctgattgtgaacaagaaaccagcggtaaaaagtcccgttttgctggactccatgggtcattcaatttctccaaaatcgggcataagaccgggatttctgcaaaattatgtcccgtaataaaaagtgccatctgattgtgagaatggagctgggggtcaacctttgcccatgtcaacagcgagccgagtgcgcgagaagtccaacgggtaaatgaagaaaaaggtgacacttccggccaaaccgccggccaacaaattgcctaaggcattgagacattcggaatattttttgcccgaccaaccggcaacaaaacgacgataatttacagagcgatcagactcagtgacacaccaacgcttgaacaactccttaaaagccatgccaagcgactcctaaaagcgaaatggaatatttgtaaaagcacaaaatgattatgaaaaaagggataaatggaagtttttcgaagagaacggactcggaaaaagcccttaaaaattaatatttctattaataggacttgttacgaaacaggagactttttccaggagcccaaattttatgcaaaaaaagggaaaaattaaaatttggttttagcccaaaattattggcactttataaattgtncaaacgtgagttggtattgttcagaaatggtttgtcttctgctcgatggcaactctgtaccgccaaccaagtccccagcaaattgaagaagccatgactttttttttctcagacagttgatcttttttatcatcttgacatccaggtccgtaaccaaaaaattttcccgcat

SEQ ID NO: 36248 - DNA, 1063 bp, Heterodera glycines
gcccatttgaggcgctaattgaatgggcgagggaccaaacggaaacggagggttttatcccctccagcagcaatttaaaattaaatgttttgtttctattgtatatttcagtgtgccattaaagtcagaaacctaaattttataagtccgctgattttgttttatttggtacactttaaaaaagggaaacgtgccaaatttttgtttgctataatttaattttcaacatttttaaataaaaattctcattgatttattggtcctatgaaaccaaatacaaaaaatcccattgggcaagaacggatttaaggaggaaaaagaaaataatctaattaaggaacaaatgacaacgaaatgagagaaagaggctcaaaagggggaattgacgatgagtatcaaagaaaacgcactttaattgggggggggggggggggacattcgtacaatgaatggaatggagtccaaacaaatcctccgctaacaaagcaatgactaaggaaaagccaaaggagcagtgggaaaaacaatgggcagacgaacctgagaaaaaagccatgaaagaacttgaaaagaccgacaaacaattcaaggaaaacaatcgaaggtgaaaaggccactttaaaaagctgagaaaagccaaaaatggcgacaaaaaacgacgattgtataaaagcagaacatttggaaaggcaaaacgaataaacaaaacaaaaaagacatgacgagtacaaaatcgggcatctcttcgctcattcccttctcttccctcaaatatcgcttctgttggttcatcggccccacacgagttcgtcctctttcaccgaccagaaactgtccacctcctcctcctccggctccacacggttattgttgttttgggcattgtgccgtggtacgctggccgtttcttctctgcccattgttttaccattcactgattgtgaggcatctccgcaggggccacgcgagtcaaagttcggcgcgtttgcccaatcaagaaagtcagggccaaatctgcgtaaaaagtccggcacgggcagccccccttgcagaagcacctgaa

SEQ ID NO: 36249 - DNA, 741 bp, Heterodera glycines
aattaaattaaataccgaaatttaaaaaaaaaatcagaaatgaagaaacaaaaccgactgaagaaatgggaaggaattgtcaacaaatttatggaggaaaagggaaaatatttgcgtaaaaaagaacctaaaggcaaaaagaatatccatcatcgagaaattgatgagcaaatcgccgaaacatggggcactaatagcagaacaatttacagatggaaaaaaaattgggacagactcgtgagttttattttattaataattttataaatatggtaactgccaaacttcctattaaatgacagtcaaaaaatgatcattaccgataattagggttacaatttttcagctgaaaattttggactaaatgtgtaagtaaattttctaaaaatggttgttgctaaaaggtcctcattaactcgtaagttttattttatttataaatttataaaaaagccaaaaaatgccaattaaaaacagaataaatttgtgaaggaattaggcattttaaaaaagacatttcgcaaatggaaaaaagaattactgccaaattgctataaaagtaataatttttttttattaatttcaattctatttttaagagaatattaccaatgcggacaaattagaaaaaacacggcaatattttgaaattaaagaaaacaatccaaaaattagtgacgaaataattgctaagaaattgggaatcggaatcgcaactcttttcagatggaaaaagaaatt

SEQ ID NO: 36250 - DNA, 945 bp, Heterodera glycines
  misc_feature (868)..(868): n is a, c, g, or t
  misc_feature (887)..(887): n is a, c, g, or t
ggacgcataaaatgagattggacgcataaaatagggacttgtgacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgggattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcataaaatgagattggacgcatanaatgagattggacgcatanaatgagattggacgcataaaatgagattggacgcataaaatgagattggacgcataaa

SEQ ID NO: 36251 - DNA, 822 bp, Heterodera glycines
aatttctattttggaggcctttcgggatcgctgagaataattttgacatccatatgcacgaaattctggattcctcaaccgaggcacgggatccaacccgaatgggactccaaaatacaagaccctaaacacttttatccttcccaatgttgattttaaaaaaagtataaccataattaaaaatatgtatcttgttttgactttgcacaattattaattaacatttgaaaagggcacatttttaattcgtactttaaaatggtgaaagtaaacttttaaaggtaaacatatgctttggaattgcagcaaatataatgaaaaaaattgaacattagattaaaagtgattggagaagaataggagcaatttttaatcgaaaaaataggggagaaaagagaaattaataagtgaacgaaacgaatgcatgcttaattaggtaattaattaattaattaattgcttttttgtttttggctgtgtgtggttgaactttttctgctgttggaaaggcaaaaaaaaagcgaatatgaaatggatgtgacgatgatatgacaaccatatgatgacaaataaaatacaaaatgtggcggtggtgcgccaagggaagaaaaaagcgctccaatgaaggcaaaagtaaatttaatgacgaccgaccacggacataaggtgatgttgatgaaaattaaaataggattttgtgtattttgggttgctaaaaggaagccaagggaaaaaccaacaaacaaattttttcagggaattggattttcggggctcaaaggcggaatcccaaatttttggttcggaccccccaaatttttt

SEQ ID NO: 36252 - DNA, 925 bp, Heterodera glycines
  misc_feature (26)..(26): n is a, c, g, or t
  misc_feature (906)..(906): n is a, c, g, or t
attggcggattgagaaggtcgaaatncggctgaaaaaatgcgcattttgtggagccaattaaataatgatgcttaattacctgatgcggtcccctcccctccctttttaccgacttagaatttgagttttaagtaatacttacactcttccctcgccatcagtttggttgacccgtcatcattcctttgaaattttgcgtgtgaatttgtgttggctgcgaatggacttttcgactggactttctcgctgtctatgacgtcgacggaacggtgaaacgaatcacggtcgaccagaaaagacactgacggcgtgtgattctgcgaaaaagcgcatttctgaccatcttgagcacttgcatttttgtgccctattacaattcgagagtctcgctattggaccgagaaaatatcaagttttggagattttcggtctcaagatttgctcattggtcttctcagtcggttccatcaccctgatcagtttagaatccttctcctcccccccccaatccatcgattgttcgcgccacctttctttcaggcagctgatagtgccggtgattgcgcagctgcgcttcctcccgtcgcattatttcgatgtgtcgcatcaccgcacgcagtttgcctccatcgacgcccatccgtcgggcattttgccgaaggcttcgcacaatgtccgccttgctgaaacgcctcagccgcgcggctaaaagcgctgggggcaattgccaatagtcggcgggaaagctgaacagcaaacacaagaaaacataagatccgcgaacagttcttctcgagacaggtcgatgtaccgtatccctttgcccaactgacattggcccgtagactacggtgttttgcgatgcatttgcatttgcgtccgcgtgtttgtcagtcgcaatttgncaattcgctgggctttttg

SEQ ID NO: 36253 - DNA, 822 bp, Heterodera glycines
agcaatgattattagtgttgaggtaaaaagcttcaactgtgtttgtaaaatttttttgagaattcttaagggtctttttgcgtaccaagaattaaagtgcatcggaatgaaaagggaaatgagcaaactgaagaatatgtgtcatgtgtctatgtgatgcttatttataatcaggagaatttaacagttcattagataggtattcaagtattgtgcattacagacatatcatgtgtaccatggccatggtagaatgaatggacatggaattagatacatatctatgccaattatttattccttggaaaaaaatttaaaatcattttctaattttttgatctaaatactgatggcaggcgaaagaaaagaatattttaacgctttcatacctaaaaattcctgagaatttgcttgaatttttgaaaatttcacgacgtatccacatatactttacattagttgaaaaaaagactacgccagtctcaacttttcctaagtttacgctccttatacctacaaaatttaaatgcttgtccgaatattcgccgtggcgttttgcagtgtcaaactgacaattcaaaatggcaccctctctctctctgctttatgctttgtcactttgcgctccctttgtcaattttcgttgcccttgtaaaatgtttccctcatttcgggtgcttaaatagcggcgcgtgggggaagggcgttgtcaagcgcagttactcattcccttcccacccatccatcgacgcccccacaaatcatcctcccgctgcttggtgacatacccccctcccacgggtgaaaaaaaggaaatttttt

SEQ ID NO: 36254 - DNA, 890 bp, Heterodera glycines
taaatacagtacatgcaccctattagattcttacatgaataacaaattaaaaaattaaacaacgtattaggccttcgtgtgctggtttatgccaacgtgtccgaatatttgcccatcacagaagctgtcggttttcgcatcactgtgcatgacaagtgggaaagattaggcggggtggggaaatagggaaataaaggtattaactgacgaattcatgaacaattttggcattgataaattaaccccatttattttgggcacttttccgattaattttggtagttgatctactgataaccggtctggccacttattaaagaacctctgattaacttttggccctaataatgcttgctgatcggtgatcactttatttcccagatggactgtgccgtttgtggacgcgtttggttacaacgcacccaccggcactttatcagcatttggcgtacgtatggtatgcaaaaaaaaaatgcttgaaaattaaaaaataaacaaattaattaagaaaaaatttttccgcctcgagcacccatacggacattgccgcgaaggcggagaacgtgccgaatggtacatctacaacaaaaaagaagtaggcaaaagaattaattaataattaaatgattttaattaaaagaattttgatgcaaaattattaaactaataattttagaattacaattattcaatcgaaggttgtcatcgaagttgcacacaacgtgaggtgcaaaatatttgaaattagccaattaattaataaaattaattaattaatgagtatgtgtatttgtaggttgtgcgcgtttgtggttgcgcagatccaatggtccccgtcagttgaaaaaattaattaaaattttaaatttctttggtcatacacaaagcaa

SEQ ID NO: 36255 - DNA, 967 bp, Heterodera glycines
aatattttataatgtttttcgaataaggaaaatttttcattgaaaaatttttttatcaaaaaaataattaattttggtgggcaagttttgagaaaatatttcaattcttagaagggtattttctgaaaattttcaagtcatttcttagggggtgtattttcccgatttattgcatttttaatggattttccggaaaaaacaccaaaaagggcaccaaacggcaaaatgccaaaaaaagcatttaaggcacgaaaatcccgaaaaaggcaaaaaaaaaaaaggcataataaaagtcaacgtagaagcctcaaaccaagtgaaaaatgtattatttatgctttaattgttggtacacggaaaacccgccaagggaacatttttacgggttataatttgttttcattggcgcctaattttaaaataatcaattattaagtttttgaaatttcaatttcaaataatttattaaagaacaataaattttcaagtaagaaaatagtgaactttcaaaactttattattgaaaaacgaaaatttttcaagatttgacaataagtgagtcttggctttccgattcgagaaatttcttagattttcaggtctatctcattctcgaggtttttttctttaattcttgttactcaatcttttaatcgttgtctcgattttttttttgttttttttttttttttgcattttcttagtcttaattctcgggaccaattatcgctcttattctcgattaaaaaaaaaatcatttctcacatgttttgaatgaattattgaaaaaataacatttttttctccataatcttgggtgtttcgccgttcaaaaatcaccaaatctcatgggacgttaatggattcttacattatcatcagtcccttcttagctggaatttatttttgttttttagccataatatccgcttacaaattatgtcagtcatttctcctcccctatata

SEQ ID NO: 36256 - DNA, 580 bp, Heterodera glycines
ttacccaaatatatgaggcctttcatacaccataaaatcatttcaattcgctttatcattctcatgaataagtcgccgtgatcagaccattgctcaaaaaaagggcggaaaaaagtcttgactcaaacttgaaaaactatttcaaagtttacccaaaaatctgaaaaaattcctatttatataacttttgatactgattaaaaaagtctcttataccaacttggtcaaatcactcctttatggtgatcgaaacaccagaaaatacattgaaaatcggggactttttcgaaaaaaatttctagtaggtttagtgaaaattccctgaaattttgaattagctcattggaaagagcataaaattctctaccgaattgccttttgaatggtagggctacgacttgtacataaaaagttatacttgggttaaaattggacaactcaaaaatgatcaatttttgatcattttcccttaaaatacggtagaaaattgtgatttttatcatcatcaaattcaacgcaagtatagccttttatgtacaagtcgcacgtatacttaccattcaaaaggcaattcggtaga

SEQ ID NO: 36257 - DNA, 860 bp, Heterodera glycines
tatttcgtttcacattttatcaattttttgttgctcttcccaagttgtgaaaaaatatacgaaaattattttcgctctttattatgatgtacaatgcttttaagccccgccgtgaggcggctcctttttgtgcactattttcgtttttaaaattggatccggattttttggcttttttaaataaattgtgaaaaattcaaaacaaaaaacttttattgcgctacaaatgcttttaagccccgccgtgaggcggctcctttttgtgcactattttcgtttttataattggatccggattttttggcttttttaaataaattgtgaaaaattcaaaacaaaaaacttttattgcgctacaaatgcttttaagccccgccgtgaggcgggacagttccaaaatttgcaccacattttactgtggaaagtccaagtaccttaattggacaactacgtgccaatgagcacagtcaccgttggccagttgtgaaacagaaaaatgggaatatcagatggggtgcgtcccatcctaaaaattcctcttttcgtctaaccatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggctcctttttgtgcactattttcgtttttaaaattggatccggattttttggcttttttaaataaattgtgaaaaattcaaaacaaaaaacttttattgcgctacaaatgcttttaagccccgccgtgaggcgggactgttccaaaatttgcaccacattttact

SEQ ID NO: 36258 - DNA, 401 bp, Heterodera glycines
cccccctttccctgtccatttgtccctttccctcactttttcttttgtccccaaaatgttcattttgtccgccgggaaaggtcaaaaaattatgtaagaatggtggccaaaaagaagcaaatgcattataatttgcacaacaaaacctgctagcgaacagtttgtttttgcatccctttgattaattatttttatgcaaatttttggggaaagaaaaaacgaaagaattttgaggggggggggggggagacgaacaccaacaatttgctgggtttttttaaaattaatggcaattaatgcaacaattagagatttgtcactttgaaatggaaaaatttacagaaaatttttcactataaatataacagcagctgactctccccctttttttgctcctttta

SEQ ID NO: 36259 - DNA, 1121 bp, Heterodera glycines
  misc_feature (1072)..(1072): n is a, c, g, or t
attgtagtgtgaggacaggcgcacccggctttgggccggactcgaaacttctaaataaccattgcataagcgtacatagttagcctgcaaaattttattttagcatacaaaattctattcagaggaattgttggaatataaccggcaccattaaaaattagtattggttattggtgtaacacagtgggccacccactgcgtcttccatgcgcatttaaaagcgcctaaatataacgaaattaattactacttgcggtttaatattccatcatttttccagtggaatgtaatgtgataaaattaataattataatataaacaaaacatttagactatgagcaccattgtcaatttagtcccattagcataaaagcgcttcgagcaacattcacatacccaaattgtgaccaatacaccaatgtaaaaccgaaatgaaaaaataaaaaataaatatatattttttacataactaaatagtgcgattttgaatcaaatttaaaaaaataaagagttttaagggtatagcggtgccaataagcactaccggggaaaatttaacaaaagcatttaaaaaatactatatatacacataattaacaaataaattattgtaattttctaattgaaaaagtaaagttcgacattaaaacatatgggttatatttttaaaaaacaataatttaagaaatatatttgaaaaattaaaaataatcattaaataacaaattttttcttgaaaacgctaaaatataatataaaatatatcagctttaatttacttgcaattatatttatacatgagttatgccaaaggaaagaaataaatacaacaaggataaccataagaatgaataaagtaaaactaaaaaactaatcaaaattatcattactgaaaacaataaagaagttccgagtttaaaagatacgaaatatgaaaaaacaaaaaggcttaaaatatggcaaataattcaataaaagggcccaatttttttgactttcggtattttatgattgtcataaataaatagttaaacaaaacgatcccagcgaaattttgttccgtttgggtcgngatacattttatataatagaatgagcaataaatgaaataaaaaaattca

SEQ ID NO: 36260 - DNA, 1431 bp, Heterodera glycines
  misc_feature (1391)..(1391): n is a, c, g, or t
atcgatgaggttcacatgttggacttggaatgctttacatttttgcaccgtgccctcgaatccgaagtcaacccggtcattgtgttcgccaccaaccgaggccggagtaaaataaggtgtgtgcctcgggtggaaatgtcacattacgcgtaccttacatccgtcaaaactaatttgctcttgtgtacaattcatattttatgttaactttttgattttcaagaaattcggatgaaattggcttctacggaatcccaagcgatttgatcgaccgtttgctgatagtgcccacccggccctattccatcgaagaaatgtccttggtttgtttgtttgttcgtggtggatatatatgtagaccggcgggtggtcccactgctgatcgttcagattgtgagaattcgtgccgatgccgaaggcgtactgctcgaccccggggcgttatctcgcctttgtgagctcggtcaaaaaacttcacttcgttacgtaatgcaactgttaacacccgcaaagctactcgcccacattggcgggcgtgagtccgtagaggttagaaggagaaaaactgtatttttagcatagaaatgacatttagattgttgacattgacgagtgcgtgcaattgtttatggacagcaaaacatcaactaatctactcaaaagcaagcagtcagaaggtggagacgacgatgtggagatgagttgaaggagaaaggggagacggacacaacaaacagcccgcgatctctgttccttttcaaatccctaaatcacaattgttgttttttcatttatattttagtttataaaaatgaacaaaaaaaacaaaatcaaatgttcgtttcgcagtccatcacaatgcttagcccatcaacgaatgggtcgacgagtctaaaattaaatgtgatatttttatggctggttccctcttcttttctcacctaacattgatacgcttccgttggtctttctgttccacaacggtgacactgactttcacttccctgaacaaagtgatgccatttgatgcgcaaaattccgccatcttttgctgagtccatgccgcgctttgttgccgcgtcgtgccatctccatcccggttcagataaataacgctttccaagccaaacttcgggaccataacctgacgaaagatatcgtcaaaaaaatgattgtccacagatgggcggcgattctcgcctttattccgttgctgctgattccaatgacaatcgcaggcaaacacttctccggacactccttcaccatcaaaaaagtgttgagcagaactgacgcacggccggcgtattgcgcgtgacgatgacgtcggttcatattctgtttttgagatttgattatataagagaaaaacagtggtcttgtcaaatttnggcagatttctattttttggccataatttgacaaccgatt

SEQ ID NO: 36261 - DNA, 1109 bp, Heterodera glycines
aatgggaaagctcacgcaaatttgctttcattgtgtacgagtatttgttccgtgaatatgttgctgaatatgtaagaggttggaatactttcaataaataataattaataataatatttaggctaatttttccagtttttaatattttaaattcaacgcatcgaaaaatttttttggcctttaaaattaattaaaatttcatatttcttatgaataaattttcagaagtcgactcggctttggctgaacaaattcccgttgttgagaagcccataattaattatcataaaagagcattcgcacaacgggtaacaatttgtgaggcgatcaacaattgggccaatattcggagtagtgtccaagtagaggattattcttttatgctttactatgccaacacgagactacaaaatgatcgatcattgatcaaaaattatgcgatcaatttcaacagattgtatgagcccgaatatctgttcgacatgcaaaaactgaagttgcaaatcagtgccaattccaaatttgacaattcgtatgccccactccgccgtatatttgaccaccaaatggggaaaatgaagacaaaagcgatggcgaagtttgtgtcaagcgccttttcttgtcatcagcacctcagcatgttttcaagaagtcattctatggcatagacaaagcggtaaatgtggcaaaatttttgaaagttttgcatttatcgtagcaaattacggagaattttaaaaaatttaccaccatgtgaagccatgcctgccggcaccgacagatataaagttacacatttttaaaatggtttttggcgcaaatctatcaacgaatcactcaatttttagaactcaaaatgtctgtgtaattttttttagtatttttactgttttatgccatcaaggtgctaataatctggtcaagtgcaagcaagtccggttctggactttcaaaattttgtttctcgactaaataagcgttaaattaggtctatttagattgatgacaacatatttcttagctctctgaaagaagagaagcgaagcaaatttgaaaaattttgtgacaaattgagagcagaaaatttgccaaaagttaatgcattaaaa

SEQ ID NO: 36262 - DNA, 1188 bp, Heterodera glycines
taattaattttctaatagtatttcattttagagtccactctttaacatcttcgaaatttaaaatgctttttttttgtctttttatccttttaaaattgattaaataattactaaaaatattgtaaattatatttatttcattataataaatgatcgatttgagttcataattattattttaaaggttattcgttatgcattcagttttttacttaatgtttatttttgtatttattcatggctccatatgtgagtgatatcccattttgaaggaaaattgatttggaaattatttattagtctttttatagaatttatttttattatttagacatttggaaaaattcattattaatttaagaaaataatgattattttaaaattactttgaattctatcattttttaattttctttacagtttattaacaaattagtaattatgtaaatatggttgaatgaaattattttaaaattgtcgctcaaaactcccggtttcaaacattgccgcatccttttcttaataaattaattttaataaattgttaaatgcctatattaattcctaatttataaaataatggctaacatttctcaaaacattcttatatttttttaagaaatgtatttataatttttgttgtatttatgtcatttatttatttatttcgataattgaaaaatttgatatttaaaaaattatatataataacttataaaagttttatgggtcataattatcacttttttgccattttatttaatactttttttataatagaaattttggtccttttgcaagtttttagttggtattccttgcataagttaacttttcttaagaaaaaaagagagataaagagagggagagaaaggatatagataatgagagagggagagagagagagaaagaaagagaaaaaaggaaagagaagagagaaaagagagagagagagagaaagaaaaagaggaaagagaaaagaggagagaggagagagagggggagagaaaataatagacatagagaaaaaagagaatagaaacggcgagaaaccatcctagatacggagagaggcagagagagagcgaaagagacacaaggaaagcgataaagagagagatagagagagaaagacagaaagaagacataggaagagagaaaagcgcacgagacagacgagagaaaaga

SEQ ID NO: 36263 - DNA, 1105 bp, Heterodera glycines
ttattagcggcagaaaatgctgcaaaatgtttaatccattcaaaatacaacggaattttaaataataaataaaatgactccaattttgcgctcatttgttcgcacatttgactatgtgggaaaaatcaaattagcgggttcggttttaggattggggggtccaatctttaacgggattagattaatgctataatttcccaaataagccaacaaagagtttggaaaatgccaaaatagtgaaaaaatccgaaatagtgacgaatagtgacataattttcagtcaaaaattaagcaaaaataatttttattcactttttgcagttgcaaatgaggtagaaaataaatgaggtcaagaaatatgtttgttttttttatatttcgctgttattttattcttctctttaacaaaaacggtttttggatgacgagctaatttggaaaacaaaattgaaggaactgtcaaaattgagtgaatgaatgaatgcgttgggtggtgtcagtccgtcccccccccccgccgcccctcccaccgttttttggtctctccgaatttaaatttatgcagcggcagaaaatgctactgcaaaatatgcatttgaatgttcaaaattaaatgaactttttaataagaagttatttgtcaccttttgactaggtcgacaaatccaatttgcgggttcgatttcggaattggagtcgtccaattttttaccgggtcgatttgccagattagactgttcatggggaaaatcaaattagcgggttcggttttgggattgggggggggcccaattcctaacgggattagattaatgctataatttcccaaataagccaacaaagagtttggaaaatgccaaaatagtgaaaaaatccgaaatagtgacgaatagtgacataattttcagtcaaaaattaagcaaaaataatttttattcactttttgcagttgcaaatgaggtagaaaataaatgaggtcaagaaatttgtttgttttttttatatttcgctgttattttattcttctcttaggcagaaatttaacttaaattgtgatacctttaaaatattaattgaaattcaaaattttttaaatatataatta

SEQ ID NO: 36264 - DNA, 981 bp, Heterodera glycines
  misc_feature (933)..(933): n is a, c, g, or t
ttgccaccatttgtcggctgtttcgcactttaatcatcacattcaaaattgttttgtacggaatgccagaacgttttgccaaaaaaatgacggagtatgccagtgttgcagtgagaaagcatttacacgcagctttatcttaaatttgtattatactaaatcaaatttttttaggtatttattgaacgctttttatgatttatcatttttttttggggttttatcgtataaaaaggcaaaaaaggaatttcattttctccgaaaaactctcggattaatttgacaataaaaaagtgataagcgtcgtaaaaaaatcgtgaataaaaaatatattgaaactaaaaaattaaaataaaatatactaaaataaataaacttttatttttatccattaaacaaaaaaaaaattttaatttattttattaatttttaagaaaaaacttttatataaaattgttaaaaattccatttaattgcattacgtaaaaacttcaacagcttaagtttttggtaaatggtgtacaaattttgcaaaaggtgtcccattgccggatcattttgttcaacataatcaattggagatttgccaaaaaataaaaaacgctaaaaaataatatataaatttaaaataaattaaaattagaaaatctgagtattttaaaagaatttaaattaaatttaattaaacttaaaaacctgagttaatgagttggcaaatgtattgacaatgacttgatcgagttgacccaactggcataataaactttttgttgctacggcaccggcacttttcacaagtttggcaccatttttatataaatttgcccaaaaacttcccattgttgtacaacaaactgccgaaatagcaaacattgaaacaatgatgcaaaacgacaatattgcacgcctcattattcgcctttttcagactanatttcttttaaaaatttaaatttattttaattacaattatacattaat

SEQ ID NO: 36265 - DNA, 1210 bp, Heterodera glycines
cttttttgaaaatcatgtgaaaataaaaaaatttaaaaataaatgcagaattcttagggctatcaaataaattaattaagtttggctcaattcaaatacggtattttggtacatcttttttttgtatatttttaaaaatatttatacttatttcaaccattttaaattattctgtttaaattatcaagattttatcctctgagcctcgaaatgacgcaatgatataaataatacttatatatgacattgatataaagaaaagtaaataatacaacaaaataagcatctaattgaatggatattcgttaaaaacactggattcctaccttgattaaaatttactatgcttttaaattaaaggattgcatttttgcgcaattaaaaatatttctatttttaaggtcgttgatttggtgcccaaacttccccccctgcgttttttacggcataattcgcgatttttcggcttaaaatccaaatcttactcaaatatttttttgtgctttataaaaattgtaatcaagaatacgtgcatgtgctggaatcaatattcttaaaaaattattaaaaacatcatgttatacaaaaaacatttgttgatgggttccccttccgtcgtgccttacgtctttttatcacgtttaaacgtggcaaacatttttacatgcaaaatttgcattggcggttacagcctgacatttgttggcaatctgttttgaaagtatctctaatggagaggcaaaaatagggtacattaaaattttgtttttctctctcgcttccgtctttttcgtatggataaagcaaaggcatgcgggcaaggcttctttgcctgaaaaaggcatatataaatgcaccgcgattttagcatttttatacttacaaaaaaaaatattttaaatgaagacttttaaaaacaatttgcttctctctctcgtgttgtttagcttttttccatttttcattagcggaggtaattataaaaaacctaagttttttcaaattttttgaagatacatacacataaagcattattatcagggcccgaaattacattttttgattttttggtgaataaatatgtatttggcgtttttagcacatataatcctggccctaattatgatgaatgtgttataaaaaatacactttgataattgtaaattacgggagccccaaattttgcaggtttttcatctgacgactcaaa

SEQ ID NO: 36266 - DNA, 1349 bp, Heterodera glycines
  misc_feature (1304)..(1304): n is a, c, g, or t
aaaattaatgaaaataattccatttaattgaatgttttatgttaataaaaaattgtttttaaataattttattgtattatgctgcttatttaaatataaactcggcttgaagacaatttgaatggccatgtctttgccgcgcggaaattggcaacggtcggtggccgaacaatcggttgtgatcgccacactgagcacatcaaactgagactctaaaaataaaaattaaagaaattacttaaattaattcaatttactgcaatttttgtaacgaatcgggtagaaagttgactgatcagcgtcagtaaattgagcaatcgagcagataaaaaggaccaaacaaatgtatttgttttgacaaaaaatcattttttccaaaataaaataatcaaaaaaataacaattaaataaataaaataaaataaatgggatgataaaaaatgaattaatgctaaaattagttgttttaatgtaaatcactgaccaataaaaaaaaatattgggtgtgatgaatcaatcagccaagtgggacgaataatgttaagccaattaatgacacacaactgtttttgatcgatgaaaagccgttttagcattaatttaagtggtaaaaaagacataaaataataaaatggaaaataattattttaattttgaaatttactttaattataaaaaaaatattttaaaatatattcaatttatctgttggatagttaattgttctttttttatattttttgattgtttactaattaaaattaaatattgatcttttttcgttttggatttttcaattttaataaaaaaaatttcataaattcatggatgcttatgcttgtccagagcaagactcgattggttttgtgcgttgatttgctgatttaactgttggcctacggtagtgcgtgctgcacgaatactgtatcacatggtcggatatcgtgagctgatgtttcgagtaaaattttgtgcaaaggcaggaacaaattttgtctatttttgtgaaacagatggcataatagtacggcattcaaatttttcattgtttgaaattttcgattaaaagaatttaattttaagaaatttaaattcatttacacaaaaaattatacaaatagcgaaaaacaaaaatttaaaagtaagaaaaaggaaaaaagaaagacaggaaggaaataaagcgtaacaattggtttgctaccaaaatgtgccattcttagggggtgagtatgtgtgtttaacacaaatcccgagttgaggtttgaagtgtcgtggttggggataaccactagaaataaccctanaaaattgagacaaacagaaatttttgaaactgtccttcctcccat

SEQ ID NO: 36267 - DNA, 882 bp, Heterodera glycines
cagaaaaatcgtaacgtgcccaaaaatggctatctcttttttgtatccaaattgcgcattaggtatttcatacagtgcgtagcacaggttgccttttcttatccggccaaacgaagcattagtagggtgttggacaccgacagaaaaatcgtaacgtgcccaaagatagctatctcttttttgtatccaaattgcgcattaggtatttcatacagtgcgtagcacaggttgccttttcttatccggccaaacgaagcattagtagggtgttggacacagacagaaaaatcgtaacgtgcccaaaaatggctatctcttttttgtatccaaattgcgcattaggtatttcatacagtgcgtagcacaggttgccttttcttatccggccaaacgaagcattagtagggtgttggacacagacagaaaaatcgtaacgtgcccaaaaatggctatctcttttttgtatccaaattgcgcattaggtatttcatacagtgcgtagcacaggttgccttttcttatccggccaaacgaagcattagtagggtgttggacaccgacagaaaaatcgtaacgtgcccaaaaatggctatctcttttttgtatccaaattgcgcattaggtatttcatacagtgcgtagcacagggtgccttttcttatccgggcaaacgaagcattaatagggtgttggacacagacagaaaaaatcgtaacgtgcccaaaaatggctatctcttttttgtatccaaattgcgcattaggtatttcatacagtgcgtagcacagggtgccttttcttatccggccaaaccgaagcattagtaggaggttggacaccgacagaaaaatcgtaacgtgcccaaaaatggctatctctttt

SEQ ID NO: 36268 - DNA, 1587 bp, Heterodera glycines
  misc_feature (1336)..(1336): n is a, c, g, or t
atataagactccctgatctgaattcaatggcatgcttctgagaaaggggtggcataatcttgatccgatcagaaaaacttggccccatataagactccctgatctgaattcaatggcatgcttctgagaaaagggtggcataatcttgatccgatcagaaaaacttggccccatataagactccctgatctgaattcaatggcatgcctctgagaaaagggtggcataatcttgatccgatcagaaaaacttggccccatataagactccctgatctgaattcaatggcatgcttctgagaaaagggtggcataatcttgatccgatcagaaaaacttggccccatataagactccctgatctggaattcaatggcatgcctctgagaaaagggtggcataatcttgatccgatcagaaaaacttggccccatataagactccctgatctgaattcaatggcatgcctctgagaaaagggtggcataatcttgatccgatcagaaaaacttggccccatataagactccctgatctggaattcaatggcatgcctctgagaaaaggttggcataatcttgatccgatcagaaaaacttggccccatataagactccctgatctgaattcaatggcatgcttctgagaaaagggtggcataatcttgatccgatcagaaaaacttggccccatataagactccctgatctgaattcaatggcatgcctctgagaaaagggtggcataatcttgatccgatcagaaaaacttggccccatataagactccctgatctggaattcaatggcatgcctctgagaaaagggtggcataatcttgatccgatcagaaaaacttggcatggcctttatccgaccagaaataatgcaacactttttaagatgcgcactaagcctgaacacatcaatgagggcggagtggaaatgggtggaggtgtccatgactcgccatacttgatctagataatcaatccataatttctacaaatgaaggattatttgaatttttaggcatgtaaatggcatttttcctacaaattttttattttatttatttgatggttgtgtattttgaaatattatgccaatgatgacaataataaaattttatacgaaaaaaatgatttatttgaaaaaattattattttatatatttgttaacaaaagaattattttcacaggttataatctattcaattatctttccattaattttacaaaaaataaaaaataaattttagctaattacgtcctaatcctaatattgttttgttttttgtatatcatcaattcacttttttggtgccactcacattntgtgggttttgccaatttaccggattcatcaaaagatttctcgacttcttcctgctgatcatttccatcaccaaatggcggttttagtggcaaaaaatgcgcaaatcggcgccagccagtagacactgatgtgtccgagatgactgatctaaacaaaaaaaaatgtggatttggaaaatattgtttattaactcaaaaataaattgtataaagtatgaaaaaaaactttttttaaatataaaaaaatagca

SEQ ID NO: 36269 - DNA, 657 bp, Heterodera glycines
ggggggggtggacttggcgaagtgccacccaaaaccaaatggagtgagtgccacccattgaaacttccgcttttcttttatctccccccccccaagtcattttttccaccgcacattggcacttgtgcagaggcgaaggtgaagagacaaaaggcgaaagagtgccgaatggcctttgtggaggaacacatattggcacttctttaagttctgcaagttccgttgtccattttagaaagtaaaactcactaagtttctttggcttttggcaattgaaaggcctttttaagcatttaaaatttatttaaatgttattttagtaagcaaaaaaagcaataaatgtgaagtaaatgtccaaaaaagagaagtgaaaaaagaacagaaaaaggaaagaaagcaaatgcaaattaaaataaaagaatttctggggcacgattaatttgggaaggaaaagacttttgggatgggagggcatttggagggacacaacaaattgacaattggtcgatagaatgaatgattatgacagtttgtgcacttttatgggggggggggcaaaatgagtgaaatcggacgaaagggcggcgccattctcagcaaattcgacggacataagaaaagtcagagaaatctgctggtcagagcaacgggctgaag

SEQ ID NO: 36270 - DNA, 762 bp, Heterodera glycines
tttaagtcttcggatttgtcaaataaattaacgatttgcaattaataataaaaaattctattataaattttttttgtagaggggaaaattctgaaccaaactactatttgaaaacccaatcaaaactgggaaaaatttgaagtcaaaaaattattcgaatttctccaattttgtttccataatttccgaatgttattcggtatcataatgccaaaccaaaacgaattcgttttaaaatattcttttctggacttgacttggtttctcaatatcgaagcttttttctccgcaatttctaaaacgcttataccaaaccctagatttttggttccgatgggtttcagaaaaaatcccgtgtggtgaaaacatatttcacatttcacttcataactttttgagttctgcacggatcgagaccgggataagaccattggaaagagcagctcgagctctacaagaagctatggaaagaaaaaatcgacatttcagggactttttcagaaatcatgtttaattccccaatggggccccattttgggtcctcagccacagccccatgcttctcccaattgtggcgaaaacaatatttcacatttcacttcataactttttgagttcggcagggatcgagaccgggataagaccatgcaaagaacagctcgagctttacaagaagatatggaaagaaaaaatcgacatttcagggactttttcagaaatcatgtttaattcccccaatggggccccaattttggttcctca

SEQ ID NO: 36271 - DNA, 692 bp, Heterodera glycines
ctgtacgccgccgcgcacccgaaataaaagtgcattacggaactaaagaagtaaaaacataaacatttatcatcatcctccaccccggcactgctcagccgcaacaattgtaatttgagagagatagagaaaaagagaatttgaagagattgtgtgtatgggagacagtgcaagaagaaagtaatgtctgccctttcccaatgaaatagagaaaatgagagtcaagattgtaaagaaagaaggtgcaagaaggaagtagtgcctgccccatttctaaagacatagagaaaaagagaatttgaaaagttttcgttaggagacagtacaagaaggaaatgtctgccctttcctctgcgtcactgccctgttttccatgtcatgtactatttctttagtttcttttccttttgcatttttagcgaaaaaaaattgacagaaaaagacaatggcgaaaatgttgaaaaaataaatgtctagttgtgtatgtaagtgtgacttcattttttattgtgatttttattgtgaatactgtttttgctcttaactttgcctatttttattgactgaccgctcgggtaattattgcatttactggtccgataaaaaatgatgaaaacagtggttttgaacagttctgagttgcagttcgaattcgggatcgaattcgatataagcttaatgatccgcgccca

SEQ ID NO: 36272 - DNA, 988 bp, Heterodera glycines
tctcaccgagtcgtggttcgcttcccgagtggcgtgtatcgcaattggcacccagtttagtgccgggtcgaatcggtccccgtcggactgtggcgggaacattccgctcagcagcgattgcgcactttctagcgcccgatcgacgtcggtggaacgaattattatctttgaaacaaataaataattacctattctcattaaaggttccttcctctaattgatttttcggtaattagcttattttgttcaaaaattctattgtcatcttttccaatttggccttacaatttatcataatctccaaaattggcgttaaaatgtctcctcaattggtccattaatctttttcttggggaagtttcttcttctctgtctcaaactctaattaatccattttttaaatttaatcggaaatttacctggaaattgcatcaaaactaaaccaatttaaaaataaaaaaaatccagaaatattttaaattatttctcggtgacgaaacgaacagtggcgaaaactttcggtcaccttcccaatttggctttacaattaattccgtgctgagctgatgcgaaagaactcaatgattgataaaataattaaattaattatataaatcaatgtccatgaattaataataggataattttttttcttttatctacaattaggcgttcagatcaaattccagttaaaaattgcctgtactttttgatttcggagattaatatttacaaattgatagccctaatcaatcaataattgatcactttcttacctcttttctgtcaaaatgttggggcaaaaaatttgcagcggcataacgctcccggaggaactggccaagctcctccatttgccgcatgccatcctgaatttgtttgcactgtttgaatttcgaaatttaaaaaataaaacatttgttaattggccccatcctctggcccatttgctttcatctgaaaattaattaattaatttatttatttt

SEQ ID NO: 36273 - DNA, 828 bp, Heterodera glycines
ttcacagaaatgtttccatacggttttaattatctctcatcgtaaaaaaaattcccattttatcattttctccattttttaattatgtaattattttgggttttcactaaatattccactcatatgtagtccaatcacttgttttttaatgacaatccgtcgaatttcttatccctttttccgttttttatgcgaatcgaattttttacattctttttccattaattattcattctttttttcacccctctatccaaaactaaagggcgtcgtgacaaaccgctgaacaaaatgtgatcagcttgcgaaaattccacgtttttaacatttcctaccaaaattgtccaaacaaaaagggcgactgaatccataccgtgccccattttcctttttctcctttgaaacgtttcattccgtcaaaaaaaaccaagtcccaactatgttaagtggactcctcaaacggttggaagaggattgtattgggtcagccccagcagtaatggacaaggacgacgccaaacaatttgaagaatatcgggcgaggaaagtcgcaatgataactggcatttctggtcaggtaattgaccgtaaatgaattaataccaagtacaagatacatacctattttttctccctaggatgggtcgtaccttgccgaatttctcctcgccaaggggtaccaagtgcacggggtcatccgtcgttcctcctccttcaacactggtcgaattgagcatttgtactccaatccgatgacacacgctgtcggttccagcttcaacttgcactacggcgacatgaccgactcgtcctgtttgatcaaactga

SEQ ID NO: 36274 - DNA, 942 bp, Heterodera glycines
  misc_feature (893)..(893): n is a, c, g, or t
cagctcttagggtaatggaaaaaattttgaagaggctctccggaacggattagcatcggggttacgagatagaaaattgtcctaaaaagagatagccatttttctgagaattaattcacaatttccgcagctcttagggtaaggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaaggaaaaaattttgaagaggctctccggaacggattagcatcggggttacgagatagaaaattgtcctaaaaagagagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaaggaaaaaattttgaagaggctctccggaacggattagcatcggggttacgagatagaaaattgtcctaaaaagagatagccatttttctgagaattatttcacatttccgcagctcttanggtaatggaaaaaattttgagaagctctccggaacgattagcatcgggg

SEQ ID NO: 36275 - DNA, 1105 bp, Heterodera glycines
  misc_feature (1070)..(1070): n is a, c, g, or t
atttcccaaagccatgcgcagctttgttagaccgatgccgaaatggcaatataatggaaaaggacagacaacaatgcttttctttatatcagctgatggtttacaaaaatcgaaatacttcctgagtactttccaagaaccatgagaataaatatcgcactagcgccaaaatcgaacaagaacgctaatcatcagtatcatcttaattttcccccagtgatttgtgagtgataagaaaatagaagaaattcagggattaattccagaggaatttccaaggaccacgtgcatcattgctacaacggtgccttaatggcattttaatgtcaaaatgcccgacactagcgcatttctttagacaacgaaaattaattcctgaggaatttcccaaagccatgcgcagctttgttagaccgatgccgaaatggcaatataattggaaaaggacagacaacaatgcttttctttatatcagctgatggtttatttacaaaaatcgaaatacttcctgattactttccaagaaccatgagaataaatatcgcattagcgccaaaatcgaacaagaacgctaatcatcagaatcatcttaattttcccacagtgatttgtgagtgataagaaaatagaagaaattcagggattaattcctgaggaatttccaaggaccacgtccatcattgctacaacggtgccttaatggcattttaatgtcaaaatgcccgacactagcgcatttctttagacaacgaaaattaattcctgaggaatttcccaaagccatgcgcagctttgttagaccgatgccgaaatggcaatataattggaaaaggacagacaacaatgcttttctttatatcagctgatggtttacaaaaatcgaaatacttcctgagtactttccaagaaccatgagaataaatatcgcactagcgccaaaatcgaacaagaacgctaatcatcagtatcatcttaattttcccccagtgatttgtgagtgataagaaaatagaagaaattcagggattaattcctgaggaatttccaaggaccacgtgcatcattgctancacggtgccttaatggcttttaatgtcaaaatgcc

SEQ ID NO: 36276 - DNA, 1234 bp, Heterodera glycines
cgccttgtaatttcgcgaaataatgaaaggttacctttttatttacaatctgatattaatcggaccatatcttgttaaagaatctgaaatacagggaaaatcactgatatgacgataactccatcaaaactgaatttatagattttatattaacttttagacctactatatctaccctctgacgaaaaatcaattactaaatattttttcataaaccgatccccaccgatcaaaatgctaattaagacgtatacaagggtccctgatgcttttcctatcaaaaggacatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattttttgcaaaattaattcataagtattttttcagaaagtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaatattttaaaaatttttaattcctttttaaatttgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacagactgctctgaaacgcaccaaattttatttacaagtta

SEQ ID NO: 36277 - DNA, 980 bp, Heterodera glycines
  misc_feature (947)..(947): n is a, c, g, or t
tttccaaaaatcgtaacatcatcatcatcatcatcataatcatattgacgataacaaatccaaaatgtcaaacctaagctggatgattttgtacgagccacgtgagggtggtcgtatggtaccccatccgctgttcgaccccggtccggaaatgtcggcgcgcgtcattgccaccgctccgcttttttcgacatcatatttttgtttgttttttattatcttttacattacatgtcttggcaatgtgcacatcgcaccgttccatgtaataataataataatttttaagccacccaacacgctaatgaatcagacgacagcgtggcagatgctgtcatctccggcggcggtagcggcgtagcatacactgtaacagaagctgcgttgctgaacaacaccaccagcacactaataggcacgacgtcagccgccgccgtgacatcaacgacggcgatgaccgcggcgggggcaagagtggatggggctgttcagattttgtccaccctgttccttatcgccaactacgcaatcgtgctgccaatgttcctactgtgttggatgatggttgtacactggctccgccgctccggcctcatgcctccgcctcatcaatcaccgtcgacatcccaacaccccaaccgctacggtggccttcacaccatatttgaggacaccgttgagcagaaggcagggcatgagaaagacgtacggcaacaacaacaacgccacacgtcagctgctgctgctgctgctgctgatactgtcactacagaggcaatggtgcgtgaggcgcaccgggtgacctcccaacttgctgctgcaattccggagcctatgcgtagcgctgtgacctcctccgtggccattcccatgcttgtgtcggcaccaagtggcgctggtagaaaaaaagcacgcaacacaacagtgaagaagaaaagaagaagaanaggaacgctattgatataatgatggaaggacaa

SEQ ID NO: 36278 - DNA, 2543 bp, Heterodera glycines
  misc_feature (826)..(826): n is a, c, g, or t
  misc_feature (898)..(898): n is a, c, g, or t
  misc_feature (930)..(930): n is a, c, g, or t
  misc_feature (1724)..(1724): n is a, c, g, or t
  misc_feature (1846)..(1846): n is a, c, g, or t
cccccaatttttttttgtcgtcaaatttttccaatgttttaggctaccacaaatattttcgggatgggagacgagtgtcattttaatgtggcacaccgtacattaatgcttgtaacttttcttagtttagtttttttgccaccaattttttaatttaattaaattttttcaaattttgtagactaattaaaacccattgggctatctaatgatgtcaatgaatgtttaatttggttgatcattttagataaaagttaaaagcctaacaataaaactgtccaatttgaattttccgattcaatagagcgagcctaaccgtttgattttttcaaaaaaaaaatttttttttctttatttgctcatgcaaattttttttggcttttaaagccttcattaaaatgcaaaaaattaagaaatggcaaaattcaatgggcaatctcatcaacttgcaaaacaaggaaaattgtactatttgctaccgccaaaattgctactttcttatcactcgaaattttggggggtgccgaaaacagccaaaaatttttgttgggtcaaaattggtcactcactctctgctgcactttcttcgtttgtttgtttgttttgtgtacaatttgtacgaacatttgcaagtggacaaacacgaaaaacagaacgcggcaaaaagatcaaagggcgcgccaccaaaatgccgcgccgcaattaataaaccaattaattaattaattagggttattagccactgatagccgccattcattagccactgcacatttttatcacattttatttgtacttactgtattagtcaagtcagtacccattntttgttttgttttgttacctcgtgttgtgccctccccctccccacccccatataaaaaggggggagcataangcaatggtgaaataatgtggacgacaacgagngcacgattgtgggggcgggaaaatggagaaaatgggaatgggcaaaaaaaagacttttccgaaaaaaagaatgcatttttgcgggggaaaaatagaaaatttttcaatgtattttctcccccatttttttttttttttatggaaatttttttccccccttttaacatttttttaaacaccatttttttttttcctttttccccctttttttttaaatatttttttttcccttcttctaaaaaaatccccaaaaattttttttttttggaaaatttttttttggagtttttttttttttttgaccaaaaaattttcaaaaaaaaaaaaggggggtctgttttttgctttttatttttttttttttttttttttttttttttaaaaaaaaaatttttttttttctattttttcaaaatttttggggctttttcccccctttaaaaaaaagttaaaagaggaaagaaagaattccttcccttttcttccccaaacccaatttttggggagaaaccccccttttggggccgggaaacggcccaaaaaaaatttcgttaatattttaaaatcccaattttttcccaaaccctaacttttttagtagcgagctccaaaagcgggagcgcttttccccagctaatagcgagcgttcacgcaccggctagtttataatatatagataaagtgggtttcgtagaaaaattataagtccccgtggttgcccggagggggctgaaattttgcaggcaggggtactttttgattgcgcatctggaaaaataaaggaaattccggtngggagcccaactgagcgccagcggcgctgaaacggccaactttgaaaaacgagctcggtttccgggctgtaactttttcctgggaaccgggagcggaaaaagtccgctgagagggcacaccncagacatgttggctacaactttgtcactgatcactttttgatcagatcaaatgccgagcctgtagaaattggcgactgaacggcgctcaaaatgccggttttatgtttttcgggaataactcgctgggggttaagcggagcgggttggcgccgcttgagcatttgtgtagtttttaaagctgcatccgatggcgttttcagattttgaaaattttcaaaatttttcttgctaggccccctcgaaaatttttcgtttttgaattttattattttttgccgatttttcccaggaaaacgaagaccactttgaagcaaccgtttttcgagctctatcgattggtggcatttttgaaaaaatttcaaaattttccggaaatagaaaaattttccggaattgagctccccatttccgttcaaggcttataactcgtcaggcgttgattttagcgaaaatttgtcttagagcatttttgtagagaattttaagctctatctaatgtactttatctcatgtttttaccttgagtttaaaaaaagttataaaattaattgtgattttgaaactcaaaaccataggggggaccccatggttttgcatttcatgaaaaaattttttactcttaaattagccaaaatgcatttttatggcataatttgaagtgctgaatacgtatatacgctttattttgtgtttcag

SEQ ID NO: 36279 - DNA, 837 bp, Heterodera glycines
  misc_feature (731)..(731): n is a, c, g, or t
  misc_feature (754)..(754): n is a, c, g, or t
  misc_feature (778)..(779): n is a, c, g, or t
  misc_feature (784)..(784): n is a, c, g, or t
  misc_feature (805)..(805): n is a, c, g, or t
  misc_feature (809)..(809): n is a, c, g, or t
  misc_feature (815)..(815): n is a, c, g, or t
  misc_feature (831)..(831): n is a, c, g, or t
ctcccccaaattgtccaactccaaaagtccgttggccctttccccgattgggtggtgtttcgccttctccctgcagtgcctgtgctcccatcgctcaatcttcgtctcacttccacacaatcgaatcttccattccgttttgtctccacaaccccaaattctgactgaaccaaaacatcccccggggggctaagggtgaacagacgcggagaattgggagaattgggggatcgaccgatggcggcggatggcccatcgaattggccctttccctctgagcacaaagaaaggccatttattttaggcacaaagacaacattttatgtcattttggccgctttctgtccattaaactccgcagttgacgagcacagttttattgggtcagttcagcagagagtggagaaaatattcaaattaaaataaccaaacgacgccattcattcggtttgaaaactcggcaaattgaccaaagaaatgaaagcatttgcccaccccccgcaaattgtcacaccttttctgcaccgagtcaaaagcaccggatcaaatctcgaaaaggccaatctaagaaagtaagctaaagcaatggtaaaagaagagggaaaacaaaagggagagatgggaagagagagggcaattaaaaaggggggggggggaggaggaacaattagtcaattcaaagaattttggaaatttattaatcagatggcccatgctcaaaactttttaanaacaatcttaatctatttcgaanagcaaaaaaaaaaatgcaaattannggctntcttagttttttgctccattnttgncgatgngtaactgagtcccggntaaaat

SEQ ID NO: 36280 - DNA, 1720 bp, Heterodera glycines
  misc_feature (1551)..(1551): n is a, c, g, or t
  misc_feature (1559)..(1559): n is a, c, g, or t
  misc_feature (1598)..(1598): n is a, c, g, or t
  misc_feature (1670)..(1670): n is a, c, g, or t
tcattatcaaccaaattaaatatttttattatcattcgatagctcttgagattctctattagcctacaaaatttcaaaaaaattcatctgtttacaaaaaagttatggccaaaaaacctcaaaaattggctttttcttggctttttcggcgccgcgtgccataacttttttattgttgaatcattaatttctattttggcatgtaaatatagagcacacatagagctttcaaatgatgccagaatggctaaagttgactgacaaataaaaaagttatagcatttcaaaatttgcggcgccgaaatggtccgcgccgaagtgaccccgacccgtctttttctgcgtggcttggtcacgaatttttaaattttaacaaaaattaaaattgtcgactttcattcgcgtcggattgtggattggtaattgctcgaaatagatgtcagattcgtggtcagctccctgaaagtcctgcagggacaagatttcacgactatacataatctaactaaaaaatttgggtactttacggttatctgtactcagattttgaaaaaaaacattttttttttgaaataaacgtgttttaggggttttcaaggtcgggagaccgattctggcatctgttttgacccaattcgaaccccaaacccggattcgaaaaaaagtcaaaatacatttttcaaaaaatttcacattttatacacaaaatcgcttcacaatgtcacgaggatgacccgcacaaccaaaaaatgccacgacgacgacacgtataaccaaaaaatgacaccacgacgactcgtacaaccaaaaattttttgcatgttttagcctgggaattttgttaaattgctatttttggcagaaaattttcatcaaatgttgcccagaatttgttgtagtagcagaagtttgttgctccggaatttgagtaagtttatgcacataagtgttgtaaaacaaatgttcatgtttcccattttttcgatcctttcccacactgaattacacgaaaaatcgagaaaattcttggttcacagcacattgtcctcacctcccaccgaaaatattgcaaaaaatcgtctaaactggccatgtttttggaggtttttggatgcttaaaagtcgaccaattccgattttcagcagaaatttgcatttttgggattcgttttccacaatgcattcaatttattattgcattccccatttttcaggaatttcccccgctctctccattcattttgcgatgcatcaaagcaccgtcgcgccgtcctccgccgctgctgcgcagagtttgggctgtaaaattgagcccccaaagccaagggttgacgccacgcgggcgaccgactcggacaaacattcgacagcaaaaagttagttgtgtttttttgcccccccccttttctgacgttgacactttttttgactttggtggaaacgtgttgaagaaatggagacagttttgtgcaaattttgaaaaattttaaaaacctaaccctaaaactttggcgagtcgcaaccatcgttttcccagaagcaaatcaattngaattatntgtcgttaatagaggaattttttgagaatgaagtcttgntccacagcatttccccctccccccgaagtcttgcaaaatcggaaatgggcattttgaagcataacgacaaantttaatagcaacaaaacaatgcaacagaaaatttaattttggaatttttg

SEQ ID NO: 36281 - DNA, 671 bp, Heterodera glycines
attagagcccggaaatttcaaatttgcggatctcgctgcgggattgatactgaaaattttagaattaaattttgaaaaactaaaaaaacaaatatacctgacaattttaaaaaagaaatttttagaggctggcggtatacgttgaaaggggttaatgggtttaagtcgtttttgcggcgcgctttttcaaaaacttttcgagaacagagggtccggtgccgataagcgccgctgggaaattttttttgaaagttttgtcgatttcttaactgattttgtccaaaaaagaccaaatatcgcacttttggactcaatttctaaattattcaaaaatatttggcattttgtcattaaaaattttcaaaaaaaatcaataaaatcccgcattccccaaaaaatgcgggattgcggattgggatccctcaaaatcccgcgcgggatcccgtcccgcgccgggctctagtttccatcacatttggtatagaagcgcgtcgtcgcgcagcggtgcgctggctaaaatgcttttgggactctgggagccaattataaatgagcgatatttagggagctttaatgttgccatatattcccgaaggagtcaaacgagtaattccaaaccccttacaaatcccgactctctcttacagtatcttcgtaaaaattttatcaag

SEQ ID NO: 36282 - DNA, 809 bp, Heterodera glycines
gaatggcattttgggagagaaaggcatttggaagacattgtgccattcattcattcattggccgtgctcacagtttggccctcatttggcttttttccctttccgtcctttcactttttgctttcgtttggcttttctccgtttccatccgtttcggcactgccctcggcacccaaacggcttctccctccacttcccccctaaggaatgcgttccgtcttttgtgctgctcgtagtgccccacttcgtccatgttcagcaccggcgttacacacgcgtcctcccctcaatggcaccgtttgggaggggcaaggcgacccttttcattttcaccttcaaaaataatggcccattctctctgcgtttttcccctgaacgcattttccatttcgcgcgttaatttcgccattccgtcaattttttcggtggaaattcccaaaactgcaaagcaatcgaaaataagtgccaaattcgaaaatcttcatactttcgaagagtttctgctgaaatttcggctccacagctcccactgccatccattttctgtccgccgtttcgtaagtccttcaaacgaatggccaaaaacaaagattaatctcgaaaaaaagaaaattaccgatagatgggacatttacccgagaaaagggcaaattcctcgtgccaaagccacggctcatgacgggagaggaacagaaaagagcccaggtaagccaacccttccgtcattgcgcagtccaacacaaagcctcggcccccaaaagatttccacaatttgctccaatcaaattccaaaatgccaaaaccttttt

SEQ ID NO: 36283 - DNA, 997 bp, Heterodera glycines
tatttttaaattttaattgaaattatgaatgtttaaaacaaaaattattatgtacaaaattcgcaaatagtaattcaaaaaattcaattttattaaataattcattttttaatttgtcttacaggctgtgtgtaccaataggtttgtccaggttcaacggggcaagtgatgttgctggcaacgcaagcattctctgccaaatttcagtcatttattttttaatgtttgcaaatttgaatcattcaatattatatttgaattttaagattttgtcaaatcattcggctgccaaagtgtcaacgttttccgagtcttgtgaaatgagatccgagaattgtccttccgtgaatattatgcagttctactgctgatcatatatcaataataggcagggtaaatgaaccattttcaatgtggaaacgagtcagtgctccgcgagagtcgccaagatgcgcccacacggcggtttgcagagagtcaacatgacgatctttaaagaaaaaaaaaaaaaaaaattaaaaatggcatgattaatagtagggatcggaccccgtgggcgggggtggcttttcgcgggggcgggggatggcgggggtcagagtcgcgggggcggtggcgggggaacaataatcccgcccccgcagtgaccggggcgggggtttgatttgaattagctccaaaaaatctcaaaaaaattaatttttatgaattatgtgttggctccacatttctttagtcgatgtatcgcctcgattcaattccttttggcataattacacagattttgtctaaagaatgaccaaatttattgatttatgttaattttttaagaaaaaataggttttttggggggccggtggtgccgacaggcgccgccgggggaaaatttttttatgaattttgttagaaattagccaaatttttcagaaatttcattcttttggatgaaattagcccaaaagaaagaacatttctcagaaataagaacataaagaaa

SEQ ID NO: 36284 - DNA, 1018 bp, Heterodera glycines
cccaaaaccggaccacttgaaaaaaatcgattttttttgttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatctttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatagatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgattttttttgtttttcggggcagtcccccccgaaccgatgcgccccagattatgggggagaccgaatccttcgggaatagcttccctatagcctgtactttaattctgcgttggatttttgctccccataatttgtttgagtacccccaacgggacacttgaaaaa

SEQ ID NO: 36285 - DNA, 892 bp, Heterodera glycines
tttatgagattatatttaatactttaaaaatataaattttatcaattagcatattttattattaattgtaatttaaatttaaaaaatatttcattccttatggttctattctatcctttatattaaattaatttgtcaattttaatcaaatcatcatgatttattcattgtaagtaaaaaggacgggtttcaatttttctatgtaaatcgggaaattaatatttcttcattaatttcaataaagatttaatattcatttttaaaaagtattttcttttaaaattttctttttaataaaaaattcctctatgttttttctttaagtgttaatcactagtttttatatatactattcttcacggttaattaaaaataaatgtaagtttttagcatttttcttcttttcaatttgctaattaatgaaattcatcatacattttttcaattaatcaattagacgaaattatctttcctcagtcataaataaaatagaaaacaattactcaaaataatacaacggctattatttctatttaaaagtaaaaatatttttgagctcggaatttggtttttaattaacgtatttttttgagccgttagattcccgattcgttaatttttgtattttttaaaaccttcatttatgtagaaaacgtaaaaagattaaaaaaattttaattaatttcatttgtgaaaatgcatttattcaaaggaaataaattgtgaaaattttaattgactttaatataaaagaattgttaggtttaagaagacttacaaaatagtatgaatcgaaaagatttgttattattttttggctaaccatacataaaagattaaaaaaacatttttgtattaaaaggaaacgatcaaaaaattatcgcaagaatgc

SEQ ID NO: 36286 - DNA, 978 bp, Heterodera glycines
  misc_feature (870)..(870): n is a, c, g, or t
  misc_feature (930)..(932): n is a, c, g, or t
  misc_feature (951)..(951): n is a, c, g, or t
  misc_feature (964)..(965): n is a, c, g, or t
tgcctgtggttgggtaccagcatattttttggaaaactctgaagcttctctctagaaattcgggtggtatattttgatgatgaattaaaaacctataatgagaaactgcgtttatattattatatttaagcgattcaaaactgtttaagtgtgaatttttagaaattaactattgtaattttctgaaatcatcattaaattcattcctttcaacaaaaaggaaaacgaattaaacaaattccattatataattaattattttaataagaaaattataaaacctttgcatatttattatttgccaaggtgtgccaaaaaacattggaaattctttcttattgccaattattcttgggaaaaatgaaatgccgttgtaaaaagattcttttagtgcctgtggttgggtaccagcatattttttggaaaactctgaagcttctctctagaaattcgggtggtatattttgatgatgaattaaaaacctataatgagaaactgcgtttatattattatatttaagcgattcaaaactgtttaagtgtgaatttttagaaataaaacctattaattttctgaaatcatcattaaattcattcctttcaacaaaaaggaaaacgaattaaacaaattccattatataattaattattttaataagaaaattataaaacctttgcatatttattatttgccaaggtgtgccaaaaaacattggaaattctttcttattgccaattattcttgggaaaaatgaaatgccgttgtaaaaagattcttttagtgcctgtggttgggtaccagcatattttttggaaaactctgaagcttctctctagaaattcgggtggtatattttgatgatgaattanaaacctataatgagaaactgcgtttatattattatatttaagcgatttcaaactgttaannngtgtgatttttagaaatanaacctattaattnntctgaatcatcat

SEQ ID NO: 36287 - DNA, 1144 bp, Heterodera glycines
  misc_feature (54)..(54): n is a, c, g, or t
  misc_feature (68)..(68): n is a, c, g, or t
  misc_feature (103)..(103): n is a, c, g, or t
  misc_feature (155)..(155): n is a, c, g, or t
  misc_feature (1101)..(1101): n is a, c, g, or t
  misc_feature (1107)..(1107): n is a, c, g, or t
  misc_feature (1111)..(1111): n is a, c, g, or t
ataaatagccatttttgataaaattgattaaaaatgtatgttaaaaatctatanaatttctcttaagnaaattggcttaaaatcacaaaattatgagcacttnaataaaattttcagtatttttcggggtgtctaaagtaaaaaagtgccaaatntggttatttttcggcaaaatccgttaacaaatcgcattcctcaaactgtttgaatagtgcaccgcaaaaaaaaagcattgtgaatggcaaaaatgttcttggcttggcctaatcacaagctgaactataagactaccattttttattttattaatcaaaatcccacaaattttgaaaaagcccgggcccggcgggcgcccggccacaattttagaccgggcccgcgactcgcggtaaaagggcttttttttggaccgggcggcccggtcccggtcaaatggctaaaccaacccggtttcggtactttcaaaattccgggttctagtattaatcacttacaattggagaaaatctttataaacatcgtccgaattaaaaatatttttataaagtccttaaattttaattgcttaaaaacatagctaagattttcaatgaaatgagaaaaaggtaacctatttataataaagttaagtgtactattaccgtaccctttctttgagtgatttttggtatggcatgttgaatatgacaaatgtgttatgacgtaaaaaggacgttgtcaatgattgtctgtcatacagtacgctccttctttcaccgtaaagaattgaacaaatctgttaaaaaaaactttttttatgcctcttcacattttgaaattattgtattatagaagagatacgattgaataactcaaaaatttatatttaggaaatttaaaagtttaatagaattttgaaattttttaaatttttattgcattttttttaagcattctcttataaaaattttaattttcataaaatagcaatcctaaaattattttaattaccattgaaagttcaatttcgtaaatttgtttaaatccaaaacgccatcatttttgcgcatgatttcatagcccaatgcagaaaatccgatgactgtcttattgaaaattccnagatgntccnacatatctaaatttaagatgcaaaatattaaaa

SEQ ID NO: 36288 - DNA, 437 bp, Heterodera glycines
tttttcactttttatgtgcatattttgcgattttatgtgcatataattacctgccctactcattagaattgttttacctaaacatattatacacaaattatgggtgatcaaatgtttatcaacaccacaaaaaagcagagtatttcgtgagccaccgcgagatttgatcacagattcgataatatttttggcgctgatcaaaagattttacaccaacttggtccgatcactccttcatggtgatccgaatagactgtaaatcggaaattttttgaaaaattcctaaaggttgggaaaatttttttaacttcatgaaaataagcttttattttcgtggaaaaaattgaattgaaaaaataattttttgggatggtttcaatacccggttgacccaatacgcggttgaatcctccgcttgtgtgtcgtactcgctactc

SEQ ID NO: 36289 - DNA, 763 bp, Heterodera glycines
  misc_feature (752)..(752): n is a, c, g, or t
gcggcaatctttcggaattgtggtcccgaaaattttttaatttgtatggcactttttctaggcttaaaaatacgctaatcacgaatatgaactcggatttgcccaattccgaaccccggacccgaattcgaacaaaaattgaatttttttcaaaaatatacgttaaaatcgatcaaattttggcgtaaaccgcgcatttttatccaattaacaatttgaagcattattttaatcaaaaaataatagttgttgcatgaattagagttttttatcccaaaaatgcattcttgaaatttttttttttcaatttttgttcgaactcgggtcaggagttcggatttgggacaatccaagttcagattcgtaatcagcacccttgaaaacccttaaatatgaattttaaataaaaatttttttttcgggaccacaattccgaaagattgccgcgccgacggcattttgcctgttccttttttcaacacaatatctgattttttccttttcatcaagctgttttttctgctccctcattagcgattttattataatttatgagtattaatgatacacacgataaatacgacgtacacacaccgccgccgcaaccacaacgacccaatcacacacagaacacagacaaagaatttattttgggttttcgataaatttcattctcacaaaaacacatacagccaatcaatcgatcatatttattgtatttctgaaacaattacatatgtattttgaacaanttagacctgca

SEQ ID NO: 36290 - DNA, 1396 bp, Heterodera glycines
tttgacacattggactgttaaattccaaaaatatcgcctctgggtccatccaaaaacccaagaataattaatatcctttttttaacggcatttatcggaaatttcctaatgaatgattaatcttttttctattggccggttttggcatttaaatttcatgaattgtcatttttaaatattaaactgggccacataaaaagatattttaatgaaattatcaataaatgccgaaataaaaaagaatttaaatttttattaagaaattgggtctcttttaaagcctatgtcgaaacacgggtttcgaaaatcaaattatttgatttgtgccaaaatgcacatcggacaaaaaccaaaaatcaaatcaatttaaaaatggtccgatgtgcaattgcgccttatcagcggctgtcactccccccccccccgcaaattccgttccttatcacctaaaaattctctccccattttccgtcccttttaatgtgtgcttaacaaacagcacttcatttccccaaatcgacaacaatttgttggccgaacagctccaacccctcggccctcgttcaccgccatatttgtcccattttggccccctctggccaattcatttccatgcgcacctccccaaaattcatgcgctcattgtcctgtcccaattgccctcgcacacatttacttgttgtactgctccaacttcatgtcctcccaatttggcccaattttcaccatttcatttgtgatttttgtgtgatcagccaatagggccattttgcattacatttcaatttgtggcctttggccggatttttcttcccccatttgtccgcccattgtccactttttcggtttagttacccaagtttgaggataaaatttgggtgtgaatttttcctctgcacttgcccccgtttgacccccggtacatttcccgtcccactttctgcttcctctcctgtcaatttcaacgcccgaactcctcgggctttgtcgacaccaccgcggcgacctgcaccgcactcaacgtcaagcgcacacggccaactccaagcagctcaacggagctcaactcaaaacacggccatctccaagcagctcaacggagctcaactcaatcaatcaatcaatcaacgggtggtgatcggacaagtggcgacctgggcagggacgacagggacgacaaaccctcgacagcaccagcacaactgaacgacttcaagcagtagtggaactgcaactggtgggaattttttgagaaaaaattccaaaaaaagtatcaagtttgagctctccgtagccaaacttgaatacatcaaaaaggggggagcaaaagtgggaattgtgaaatactgcttggtctccgagccagcagtagtttcacaggggaaacagtgactta

SEQ ID NO: 36291 - DNA, 881 bp, Heterodera glycines
attccttcacaaaatgattttccgacgtcgtcgcctttggcatccgtcgcccgtccttttcgagccgtttgttctgttccattttgctatcgtcgctatgcttttactttttactccttcggttgtgccaaacattgtgagaattgcgcatcttcagcccaataacccggccataatgcatgagccgcaagtgctcaaaatgtgctccagcgatttgaaggagaagaaaatattgccagacgcgatcagtctcgagtaagggggcgcacaaaatggcacagaattcactgaactgcttgaagtcttgccgctgcgttttgttaggtttaagagtcgacggagtaaaccacacaaacaagcccgtttaaattatactttgatattttgtatgttaattaaataaatggtttctattagctttttaaaagtgattgtgcaccaccgtaattcattttttcatataccgtaactttcccaattaatgctgtcaaatccatctcagggtcatcacaatggagtcgtgcaatcggttcagcggagttgaacatgctgcttacctgcactatatgcgcaactccagcgtgtatttcgggcccggctgtaacaatggcagtcaaacaattgaaaaactaacgaatcaaaaaaatatttaaaaatttaaattttcatttgaaaataaattttttttattttattcagaaatactggtcattggtcggcttgtttcacgttggaatggtacaaattatgctgccaaattgttaactttcattttcttcccaatttcagtgccgatcattgctcatttgtccggcgatgacgcactttctgatcgaacaggtcggtgattttggccgtttcactcattaatcaaatcatcg

SEQ ID NO: 36292 - DNA, 520 bp, Heterodera glycines
gaaagttacggtactccctgcgggtgcatatcaaggctggccgtgatcacggatcacggaaatcacggggttttgaggtgccgtgttctcggatcacgggtcacggattttttcaatttttccgtgattttgatccgtgattggcattttatgtattgaatttttattgaaacgaaaataggaaattattgtgaaaagaggaattttttgagaaaaattaataaataaattcatttctgttagtgaagaacacatgtatatatagcctagtggttcagccctccgtcattcattgtttgccctttgggttcaattccccattgggatagcagaatttatatatatatatattttgataattttaattgaatttaattaataagaaaatttcttaacagtgaaaattattttctttattttttaaatatccatataccaataaattaacgcaatgattagacatatttttggacaaaatctgttaacaaattcactccaaaaatcaaaattttttccggcg

SEQ ID NO: 36293 - DNA, 409 bp, Heterodera glycines
aatggattctcttttccctttcaatccattcacatatctttttgaacatttcgcctaagcaaaaattaatgtacttgcacgttcgcgggcgggcaaaaattgattttccccctctcatagttttttaataaaaagttaattaataattataattaaaattttctagatttaaaaaaatattaatttattagcaaaatttcgccaatgataactcctgtaagtaggctttttaaaatataatttaaattattttcataatgttttttcttggtattttctcattttttaattttcaggaacaacaccaaaagcggctcgaatttataaaaaggaaaaaaatgaatagcgtgggctgtttcggcttggaggtgtgttgtaaattttttgttttttatttttatttgatttt

SEQ ID NO: 36294 - DNA, 885 bp, Heterodera glycines
ataccaaaaatgttcatttgctaatgaaacagcaaagcccaagctcagcgcattctctgaatggaaaagaaacggcacaaaagccgcagagaggcaccgatgacccatttttggtaattgttggaggggagggacagtgccactgaatccctttaggtaaaggacgacgtgaaaacattggcctcgaaattgcgctacaatgacgtacataaagccaatgaattctttgccatagaccaaagcaaatcaaaaaacaattggacaaatttattgcccgattggacggcgaatgatcggaaatttgaagaagtgcggcgacagcagagcagcagcaatgtcgcggttgttcagccatttctgaacaaccaaaacgaagtcgaaactgtgcaggaccaatgtccgctcgtgaaacccgccgggtccctccttcccccgccttcggacctccttttgtccggccttggcatttcttctgctcaaattagacactccgatcatttgaagtgtcagcctctgttcgacatttccggtatatttctctgttcatttatatttgttttttttaatttttggcggattgtccactcgtgaaaacccgtacattcgttacggagcaaatggcatcccaattttggagccagcgcctgtctcagtgacaacgaattttgacttgtttaaaccccgaacaaacaatcgtaaggaaaaggccgaagagagacagaaagaggcgacggccgtttccttgagcgaattggacaccgacgcacttttaaaccgagttaaagttggagctgattttgcgaggtatgaaggcactccctttcgccggcggggggagggggccgcaccccccccccccccccccacacaattttcacttaaacc

SEQ ID NO: 36295 - DNA, 631 bp, Heterodera glycines
aatattttacttctaattttctcttaatttttttgtcaatttttaattttaaaacgattttagaaatgaaaattttacttttaactttttttttactatcctttgctttattgacttaaagtcaaaccataagtcgaaatttgaggactttcttaaaaatcgagaagcaatgaaactgatcaaaagttacaaggaaaatcagatcaaaactgttaaggaactacatattggattcaattgggaatatgcactttaaaaatatatatgtgtaaaatcaagagcactatttccgatacatcaaacgaatccctcgattagaaatgaaatttgaaatgtctttctcgtgatctatcagatactatctatttaatcggaagtgagaacaaagcctattctatcaataatatgcttaaattataaaatatataaaaaaatacaattgtgaataataaaagtgcaatgcattgaatgggtaaaatatattgatggattttttgcctccatatttaaaaatatttaaaataatatatttaaaataattattaattaattaaaatctttgttccgtactgaaatgacccgcctcttctgatcacccacatcgatacttttgacacttcgccacagcacc

SEQ ID NO: 36296 - DNA, 1014 bp, Heterodera glycines
ccctagagaagtgtcgttcaaactacgccatttttgctatggtgcgctattttgccgaaaaaggacgatcccaacgagcttttgaaaagcgaaacttctgactcaaaacacctcaaaccctagagaagtgtcgttcaacctccgccctttttgctgtggtgcactcttttaccgaaaaaggacgatcccaactagctttttgaaaagcgaaacttctgactcaaaacacctcaaaccctagagaagtgtcgttcaaactacgccatttttgctatggtgcgctattttgccgaaaaaggacgatcccaacgagctttttgaaaagcgaaacttctgactcaaaacacctcaaaccctagagaagtgtcgttcaaactacgccatttttgctatggtgcgctcttttgccgaaaacgtacgatcccaatgatttttttgaaaagcgaaacttctgactcaaaacacctcaaaccctagagaagtgtcgttcaaactacgccatttttgctgtggtgcactattttgccgaaaaaggacgatcccaacgagctttttgaaaagcgaaacttttgactcaaaacacctcaaaccctagagaagtgtcgttcaacctccgccctttttgctgtggtgcactattttaccgaaaaaggacgatcccaactagctttttgaaaagcgaaacttctgactcaaaacacctcaaaccctagagaagtgtcgttcaaactacgccatttttgctatggtgcgctcttttgccgaaaacgtacgatcctaacgagctttttgaaaagcgaaacttctgactcaaaacacctcaaaccctagagaagtgtcgttcaagctccgccctttttgctgtggtgcactattttgccgagaaaggacgatcccaactagctttttgaaaagcgatacttctgactctaaacaccgtcaaccctagagaagtgtcgttcaaactacgccatttttgctatggtgcgctcttgtgacgaaaacggacgatcc

SEQ ID NO: 36297 - DNA, 1080 bp, Heterodera glycines
  misc_feature (1019)..(1019): n is a, c, g, or t
ttctcttacagggtaggcgaaaagggctgcaatttcgttaaaaatattaatacagtttagttccccgtttttagcatagtcgtttagatgtgatcccagtgcaattaagaaagtaggtatgaatgcttgggataattttgttgtttaaaacagagcaaatagagcggtgtgcgaggaaatgcttatcgtataatgtgggtattgaagaaaaatcgacaaaaaatttaatgagctccaattgcatgggcgcctgtaaattcgaaaccagcacaaaaaataagcctcatggcaaaattccagcgcaattggtcggggctatagccatggaattaccacaaatttcgacgacattcaagactgctttttgttaaaatatgaacacatatttaaccgaaaataatgaaaggtgtgtgcttgatcagaacttatcttctctatttgttacactatcgattgcttatagaaaattgcataagatttatacaattaataaaattacaaaaaaaaaattgtttatttaattgaccttttccaaaacataatgaaaataaacaagcctatgattttttaaatgctttgcaatcatagaaaaatgtttgattattattgtttacttaataaagtacatagaaattgaaaaactcaccatagaagagttaatctgttatagaagaaaattgagaaattattagtgaaattaagatttctcttaacagggtaggcgaaaagggctgcaatttgttaaaaatattaatacagtttagttccccgtttttagcatagtcgtttagatgtgatcccagtgcaattaagaaagtaggtatgaatgcttgggaaaattttgttgtttaaaacagagcaaatagagcggtgtgcgaggaaatgcttatcgtttaatgtgggtattgaagaaaaatcgacaaaaaatttaatgagctccaattgcatgggcgcctgtaaattcgaaaccagcacaaaaaataagcctcatgggcaaattccagcgcaaattggtcggngctatagccatggaattaccacaaattcgacgacatcataactgctttttgtaaaatatga

SEQ ID NO: 36298 - DNA, 340 bp, Heterodera glycines
tcaaaggcgtagccagacccttggcttcggggggggggaggggctgaagtcaaaaattcgatttttaggggtgcatttttcgtttgttgaaatcccgaattagtgggtgtattctacaaaaaattttaactgtttttcggcaaaaaattaccattttttgccattttggtctccatttttcaaaaatatggtaaaatgggggtccccggcggtgccgataggcgccgccgggaaaattttttgagtattttaatgcaattttgttaagaaaatttcttaaaatttctaaaaatctactgaaatttttacttttttgggttttcgggggggggggtgggtt

SEQ ID NO: 36299 - DNA, 760 bp, Heterodera glycines
tttccatgtcgatgtccgatgatccaaggcacaacgcaacttctcttacttcccttccaaatcccaactttctgatcacttcactcaattgtatgctgtcttgtgccctgattgtttctgcatcgcatctgcttccaatgtccttggccaaactgtccccagcaaacacaaaatgcgtgcggattacacgactatattttgccgatttatcaatttttggttccatcttcggattttctcttcctttcactcgattttcctttttcatttctttctcgaccacgtttaaaatttttaattgcatttgtttttaattttacattcaattgttttcattcgaatgtgaacattgattaccccgatcacactgatttttgtcccatttaatgaagaaacagagaacggtagtttattgtgaccagtatttggcggaatccccaatccaacaaattaattcctttttcttttgtcaaactatgtaaaaaatgggatttacaacagcagtttcagcccttgagtcggaaagtgccgttgctgaatttccaattacagacaaattcaaagtaagacattccgaaatttgggggatggcagggttttcgggtggaaattcgcttgcgtggagagagagttcactgaaaaattttttatgtttgataatccaaattttccaacatgaacactctgagtttcttccttctcttcggcctgaacaaaaattgtgtttgcacgcttttgttcaacttttttttgggggggg

SEQ ID NO: 36300 - DNA, 632 bp, Heterodera glycines
agttgagaagggacgacagagacggcgaaaagcggcgctgacgcggaagggcgcggaaccgcgaggcgagcggaagcggcaaaaagtaagggttgcggcaaagtggcggcggaaacggccgcggtacgccccgctcggcgaccacagcagcggcggcgattgtggcggtggcagcgcaacgcgcgcggcagcagcggcaaaaatggcggcggcggccagcgcattcccatcgcggcggcacagttgcacatcggcgggcgcggactgttccgaatggtgagagagcaattagcgggaattacagtaatggtttttttgacaattagtattagctacaagagtaattacagtaatcgttgcatagttcgtcgagagttacggtcaagggtaattacagtaatcgttgcatagttcgtcgagagttacggtcaagggtaattacagtaatcattgcatagtgcatcgaggagttatggcaatggaagcaataaaaaacatttgtatttgggtggacgttttttgacaggaaaaattgcgttcaactaatcctaggaatttttggatcatcaggaaaactaaaataatttcttaaaagttcagcattttcatcataatttagttaattattttgg

SEQ ID NO: 36301 - DNA, 576 bp, Heterodera glycines
  misc_feature (322)..(322): n is a, c, g, or t
agaaccacatctggtcggtgctgcttgacagcaaaagccttggcctgtcgtgccccaggcgttgctccaactccgccgcgtcccatgggcagtatcgacgggcccgctgctcttcccgacgcagccgcaacctataataaagaatgtagtagagggattgctaacaacgagactgcagctgtgaaggtaagcgtgtgggatgagattaagcttcatcactttaccatatccttatggggatgaaattccatccctttaccaatgtccatagggaatggaaacccatccctttaccaatgtccataagggatgggaacccatnccctttaccaatgtccatagggatggaacccatccctttaccaatgtccatagggatggaacccatccctttagcagtgaccaaagggatggaacccatccctttaccaatgtccatagggatggaacccatccctttactaatgtccatagggatggaacccatccctttaccaatgtccatagggatggagtccatcccttttaccaatgtccatagggatggagtccatccctttaccaatgtccctaggg

SEQ ID NO: 36302 - DNA, 955 bp, Heterodera glycines
tataaattgtgacggattgaaaccgaaaaaatcatttgagatgagacaatggggaaaattagaaaccgactgataatttctctgatcaaaagaattgatgtcagacacgatgttccaaaggcggtgcaaaaatggcggagagaccaaacattcccagaggggaggagccgaaaagtgccggcggagcaaagggcctaaagaaaatggaaaaatgcaataaatagcaattaaatgggaatgatgggcaattaatttaaaattaattagtgttaattgggttataagtgctggtttctgttgtcaaatgacctttgctcggattccgtcgtgctgtccgaccaactcgttgaccatccgccgttgcttttccctttgtccttccacttttctcgctttgtcaatggcacattgctaatcactcccccgaggggtcgtagtttttcgctttcccccgcttttacccgtggccgtgccggcacggcgcattgccgtcgcgaatggcacggctttggcgcgtggcacattagatgcccattgtcagttgtagtgctccaacttgtcgttgttctacttttggctgttggtgaccacccctttgggtcgaaagtgtccctccctcgcgcatcgttcgtttcccttccgttcggtgaatcatcgctctctccgtaggagtcttttcgccgtgccaacgaccgaattttgggcactctttccacccaaaagttcgcttctccgtttggtgccatcgctttcttctgctgatccatcggatcacttccgaacccaaattccattggccttttgtcccttcccttttccgtcccccaaaattcgtccattggcaaattcttttgtcggaccaattgttgtccatctttgcatcctttcgttgttgggcagtcaacggaggaacatcgcagtgaaaggtcaatttggtgcagtttgtggtggcaaa

SEQ ID NO: 36303 - DNA, 747 bp, Heterodera glycines
ccccgaaccgatgcgcctagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaatttttaaaaaaatttttccttatattttggttatatcgttttgcttttggtggggtgcttggaacagaggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgatagcgttcgattgctctagtcaatttttaaaaatttttgttgaaatatttgtcgtgctctgaagggcgcgggggg

SEQ ID NO: 36304 - DNA, 969 bp, Heterodera glycines
ataaaaagcaaaaaaccattatacccgaccattctctgatcatttttaagcgtcatgaggactccgccaccactgttgtgcagcgctattcgctgcctgatctggcttcatcaacagcaacaacaacgccaaaaccaattcgcttgcacgcgaacaaattttcttggcacgataatgccaacatcaacaatttgtgacggcgcaacaacaacaacccaaggaatggcacaccgcgtaccacaaccaccaacagacaggggcaggcggaagcggacgctaccgcgaaggtattgcaggtaaaaaagcagacggatcagctgcacccagtgaccacgaaactgaaacagccgaggcagcgtctcccagcttggtactgtttatattaccaattaggcattatttgataccggtatatcctggagactgttaattttagttaatgctattttttgtgtatatttgaacaatatcccaaaaaactgttactgtactacaaaaacgggcaaaatgtaacaaaatgtgcttccgttttttaaataaattaacaatttgcttttaattgcctcacataaatgtccttctaaaaatttagagtttttatcaatcaaaatttttaaaatttcagcgaatcgactagccacggtggcgcaccaccaacagctgagccgattaaaatgccaaataataagcggtttattatagacgaagccgagttggaattaaaatatgcttggattcggcactataacgtaattaaatttgaacgttgcattaaatttatttaaaatttatttttgtcctttttaagtaaaaaataaaagtaataatcattttataatgtttattataaattgacgaatttcagccaattacagctcttgccggaggacctcggatggattggaataataacgataaaaataatgaaattgtaacaaaattttaaaaaataattttatttgattattt

SEQ ID NO: 36305 - DNA, 935 bp, Heterodera glycines
aaaaaaaaaaaaacgacaattttataagtccctctcctttcttaatttacccctcatatcaaacatcattcagatcagtgggatggatcacttccttcccatatgaggggatggacaaaaagttgttaattttatgctgccgtggtccccaacgatcacaacaataggcagaaagtgaactattttgtcgtaacagcaccgtcttggacactgagaccgaatgctggagcagttcgggtggcagtgacggatgctcggatagacctttgtcgaaatgctgccgaaggctggtgccaggctgttcagcttcacacacaaccggagaaggagccaatcgcagggccgaatgcagaaatttgatgtgcaaaccaccagcctcatcgacggccatacatttcgaatcgtcccgtaggtattcggtgagacgctcaaaaaacccgaccccgaaaaagaattcaaaaagtggcaacatttcactaaaataacaaaaaaaaaatcttttttacaaactattatttcagattttacaagccaccgttaaatcttgtagccttaggttttctatcggtaaaaaaaaaaaaaaaaatttttccaaatttaattgaaattgagctggcctgacagcttagatgataagacactgatttgtgtgggtcaatcgcaggacaagagtcgctttttcgagtccctcccaggaaattgactaaatcatttagcaaataaaaggagatacagcaacttagaaattttgcaactagtgtaagccataatttaaaaaaaaaaacacacacacaccattaaacccagcctgagggcgggaaacaaaaaatacataaatcgaacaagatcctttatttaatcctttaaaccaatttacaaaaattattaaattgttttttttcctccaatacatatacaatacataaatatttatt

SEQ ID NO: 36306 - DNA, 434 bp, Heterodera glycines
ggggggccgaaggccccccacgaggccgcgaagcggccgagtcagtaccttggttgcaagaaaaaacaggccaaaaaatttaggcttaactttttagtgaaaattcaatcactcatttttcgagtagtgatcagaagtgcaccaggttttgcaggagcctaaaaaggtcaaggaaaggcgtctctgcgttgatttagcagtagtacctatgaatttaaatttcctatgaatttttaaaggttcacaatttatttattttttgcaaaattaattcataattattttttcagaaagtgctcttaaacgcaccaaattctatttacatgttaaataaggctctctgatgctttctctatcaaaaagggagatgaataaaaaatctaaaaatttttaattgtttttaaatatgcgaaaaattttaggcttaacttttt

SEQ ID NO: 36307 - DNA, 1042 bp, Heterodera glycines
acaaacctcatcaggtaacagcatcaaaacaggcgacaattatgctggggaaggggagggagttctgatttcaatgtaatttttctgatgaattcacagcaaaagtcttccggtctcaacaataattgttttcttcagatcagttcaaatattaattctgaatatcttttgcttatatttaatactatttggtcatttatgaaataaaaacaaaagaattgtttaaaatatttgcacttggcaaattaattaaatcaaaatctttcatgttttttagaaaattttccagttgaaaattctggtcccggtcccgccttgaaatactaaaattcaaaatatttcaacttaaagtttacaattttttttaaattgtaatttctataagtcaggggtttcattttgaagacacagtcattagggctgggaattcattgaatacatatttttttcctggcttctgcatgctctgaatagtaggaaaatctttttatttttcttctgttaccattaaaattttccaatttctagtcaaaaacacataattttataagagaaagtttactgtgctcttcccaattattggggtgagcggaagtctttgcatagttcagaatagggttcggaccccgtgggcgggggtggcttttcgcgggggcgggggttggcgggggtcagagtcgcgggggcggtggcgggggcacgataattccgcccccgcgggggcgggggcggggtttgctttgaattagctccaaaaatctcacaaaaaaaaatattgtttatgaataatttctttggctccacattctttattcgttgatcgccttgataatatttattttgacataaattgcacagattttgactaaaaataatcaaatttagcgatttttgggtaattttttaagaaaaaaaggtttttttttgggggggccggcgtgccgataggagcgaattttaaatttatttctaacagatattcaaatttgcaaaatatctactaaaatatgtaaataaaagtcccaacttttgtctgcaaaca

SEQ ID NO: 36308 - DNA, 1232 bp, Heterodera glycines
  misc_feature (8)..(8): n is a, c, g, or t
  misc_feature (15)..(15): n is a, c, g, or t
ttatttcntgactcncaaattgagagaaatgtaaagcaattgcccacccgtagcaaaagcatgtgctgctcaaaacgacggattgtctcccgcgcgtatcgcaacacttccgtgacggtgttgtgacgcacttgcagcgtgttcagctgctgctccttctgtccctgctccgtctccaattcgcttttgtcgccttctgccaaaacttttccaacaatttttggctttgtttggggagagagcggctgagaaagcgaacgaacgataggagaagggacagaggccaaactcagcctaaaagaacaaatggaaatgggaataaagaggacgaacgaaaaccgattgtgcaggttttgggcggacaaaagaaactgatgggccagcaaatgagcatggattttgaccaatggcaaatcctgtaaagaattgttcaaatgattaattaacaatttggattttgaatgactcggcccatgtgataacgaacttcttcaaccgtattgagatacatttggacgcccaaaagagtacaatggcgacccaacggaagaagacgaagctgcctgacccaccggggccatgcctcggcattttctggaatggcattccatgggaagggcaattaataccgccgatagtaggccattatttgccagaaaaatatgttataaaaagtcacgaacatattcccggagttgctgatcagtgatcacaaatatgacattcacttctgacaattccaaattccaaatcagaattcggataataataaattataaacgattaattatcgttggcgttttgactttattgtttcccggaccatcagatccttccaaaagtgtaaactgccttgtccttctcttgggcttttaattaaacaaatttggaatttaaaagtttgtaagaattctgattcggggtttgaaattagccaaaatgatgtcagattcataatcagatgttttatgacgagtttttaattgatagaagagcccatcatcaatcaaaggccaaaccatttacactccaagttttgatagaatctgacaaaagattggccaaagcgtccaactcggaaagtgcaacttcaaataaacccaaattccaataaaaacgacacaaacgaaactgaaaatgaatatataaaatgcaaatggagaacaatgctggtatttctcttacttatatatgaacattcgctttgatttcacctgctcatgacaagggaa

SEQ ID NO: 36309 - DNA, 1116 bp, Heterodera glycines
  misc_feature (68)..(68): n is a, c, g, or t
gcgaaaaaacgcattaatgatatgaagtaattatttgacattattttcattactagtaaagcaatatnttcgaaatgtaatttcaaaaaaatccaaaatctaaaaagatgtttttttaggagttttccgataaaggtcgaaatggaaaataataaaatattgtcgctaataattgtgacctcttttagagcatattttagaagttaacagtcaaaattaaaaacaattatactaattatttgatcaaattttctgttaaacttccgagaaaaatgcattaataatacatcaaattctattttattaaatattcgtcaccataaaagcatatttttggaaattaatgtcaaaaagtaatcaaaaatatgctattaattcaaggattttaaaagaaactttgacacattggactgttaaattacaaaaatatgcctcgggtccatccaaaaacccaagaataattaatatcctttttttaacggcatttatcggaaatttcctaatgaatgattaatcttttttctattggccggttttggcatttaaatttcatgaattgtcatttttaaatattaaactgggccacataaaaagatattttaatgaaattatcgataaatgccgaaataaaaaagaatttaaatttttattaagaaattgggtctcttttaaagcctattttagaactctacagtccaattaatggcaattaggagaattatttgaccaaatattctgttaagcacctgcgaaaaaacgcattaataatatgaagtaattatttgacgttattttcattactagtaaagcaatattttcgaaatttaatttcaaaaaaatccaaaatctaaaaagatgtttttttaggagttttccgataaaggtcgaaatggaaaataataaaatattgtcgctaataattgtgacctcttttagagcatattttagaagttaacagtcaaaattaaaaacaattatactaattatttgatcaaattttctgttaaacttccgagaaaaatgtattaataatacatcaaattctattttattaaatattcgtcaccataaaagcatatttttggaaattaatgtcaaaaagtaatcaaaaatatg

SEQ ID NO: 36310 - DNA, 1049 bp, Heterodera glycines
ctatcagttcagtgcaatctcatcgaaagtccatttcttttacctctttcactaataaatcccaaatgtgccaaaagcacttttcacactttaccataattaattaataattataattatcaaatttaatatttttgtctgaaattctctttttcgcttcacacaaaatgatcagatttacttttctaatgttttccttttctcaccttttctttttcgtcattttaatgcaatgatattttattactaattaggtattattattattattgtaattaaatgttaggtttgtgatttatttatttttttaaatctaaattaatgctttcgtgagtcatcggaaattttaatcttttttattcttgcgaattgattgtggcaattcatacaaacctaacgcagtgaccaacaaatgggccatattatataagggaaactaaattttctgttcttatccatgccgaataaaaaatgacatataaactgaatggaacaactggaaaacaatttgtccggcattttctattctcaattcgcttattacatttcatgccaattttgtacgttcgttcattatttgtttatctttctttctcaatttactaagcacatatgatttatttaagaagaataaactgctaatcaaattaaaaaaggcgaccgacatatatctgaaatgggggggggggcaatgctttgcttatatggtaaaatgcttaaactcgaaatcggttcttgcatttttacatgggataatatcagaatttttaagttttgcaaagttttggcgttttgatacttaataagaaataaacttatttttgaaaataaaatattggaagcaatatttttttttaatgtgaaaccatttcattttgatttagatttgttaaaaagtccaattatcactgcattcttatgattctcgcttcttcgtcaaagcgattagcttgtcaattcctcatccgaaaagtgcctcattttgctgtgacttcctcgagaaaagagtattttgttgttttgtcgacatgataaatttttggaaaatt

SEQ ID NO: 36311 - DNA, 1561 bp, Heterodera glycines
aaattacctttcttatgatgacgtttttgggcaattttgacaggaggcaattctttgtatccgatccctcgttttgggttgggacgcttcgtagccaactgttttctcaagttgtgcagttgactctgcatgtgttggctgccactgctcgacgaaaagcctttttgggattgggttttgcgggctgtttgcttggttcgtgccatattctgcaagaaaatagacagcatgtgttacaacccaaaatttttgaaatttattaaaaatcgtaagaaacaaaagaaatatatgagtttacatatttgaaccgctgtgacgtaggaattcggcgggggtttcacgactttaaaagaaagccaaagttaaagtcacatgacgaaatttaaaaaatttaaaacattatgccaaatattaaataaacattatgccaaaataatatttttggcattttgaattaccaaaaggcaaaatttcgttttttcggtgttcctctgctaattccttccatgttaagccattgtacatgtttaatcctgcctttctttaattctctcaacaattcctctgtaggcagctgtcactgtttggtcaatggtttggattaagcctgaacggttgttatttggacacagtttttggtaaaaaaaaaacaaattgcaaaaatcgtaaccttttcttttattaggcattctgaacgtgccaacccgtatttttgtgcttcaacgtcgaaaaggccatcgtgaagatgagcagcaacggttttcgcatcagcaaaaacagcacagtgacgtctcctcctcatcgaagggttgaaaatgaattttttaaattttgctaaattataaattaaattccaaatttcagtgctcagcggaggactgtcggctttgtttgtgtccaccatcgactcaatttttgacactcgtccgccaccctatcgcatcatttaccagcgagaattggacgagggccaaattgcgtggggtcagtcagaggctaatgactccaaaatttggggatgggccaaactgggaattttggctaaaattatttttgtaataaatttaatttctaattttcgcttttttctgaaattaatcatattaatgcgatttttaaattttacaaaaattcatccaaatttttcttccgtttttcatctctcccaatattttccagtgattgcaattgccgtcgattggcgcgatgtgttggacaattggcaatgtttggagacttcgctgttgccaattttggaggtattttcaaagtaatagaaaaaataacaaaaacaattcctttttaaattttccttttcttagtcattgggcaccgatgagaacgaattggagaaatttgtgctgacaaaaattgacgggtttttggcgctgcgcgatgaaatggaacgccgtgaacatttggtggccgacggtggggaggaggacgatggcgccgagtcggctgccggtgaaattttacaaattaaattcaaaattccataatgttattgatcacgcacatatttttttttgaaaaaataacttcgcccaatgaatttagt

SEQ ID NO: 36312 - DNA, 1201 bp, Heterodera glycines
  misc_feature (220)..(221): n is a, c, g, or t
tggcgtttcttgctccgtttcgctgctttcatgggtaatttggatgtgtgcgaacttttggtccaacacggagggcaatgacattggcatggtgaacatgacaatggccttttacgctgcatgttatggtggcggcataccggccccagaatgcaactgcccagacgcaaatcggccaggacgcaacctggctcgtttcgtatgatggaaacttggacanncgtaaaagaaaaaagagaaaaaatgtgggggacacattttcaatctgtttctaatatgaattttcggaattatggcatctcttttgggactcccacaaaatacactaaaaaaatgaaaattttcgggaaaataccataaagttattgtttttcaaaattattagttggccaataaacttttagtccaattctttatggaaagagtccatttctctgatcaattgcgtcgcgctgcgatcactgccgcgtcctttcacgggcgaatcgaagttgtgaattatttgctgtcctttgaaatgcgtgcaaatgccaaccaaagatcggcatcagaaacggagggtaagccatgaaaaagttattccggaaagatttcccaatgccattgttttaatgactttggtcataaaatcattttctttttaagccaatccatcttcatcaacatcttcaccttcttcttcttcccgttctccatcttcatcaacaacttcatcttcttcttcgtccagttcatttttctcatcagtttttgccgtattcgaaaatttggctatgaatactgtcaatctactggttactgtaatcgacgctgtgatttggctttgcaagacgatcattacatgtgtgaagtgtgcctggtggtgctttaaaaaattgagacaggtgggtacaaatttcaaaataaacacttattgttaactattttctgggtttctcctttaaataattacttattcaaggttattggtacctcttagactttaatccaaaaacttagcagagattccagcaaactcagataaaaatttaaaaagtttagggtatttttgaaacgaagaaaataattaatgcctaaataagtttttcacaggacttcgtcgtattaataattaattacctattcttcaattgatttttttattcttaagactgcatatgtttataataatattgttgctctcttggcacgcatcaaactg

SEQ ID NO: 36313 - DNA, 903 bp, Heterodera glycines
ctaactcacgttctcaaaattagttgataaattgcaaatctttttttgcaaagtctgtggacactttctgaaaataaattctatactcatgtattttccacttattagattttgcaggcttattgcttcatgttcatttgacacttcttcaaaataacctattccctttattcgttcaaaacagcatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctatttaattgattcgaatgtttttatcgcggttaattagagcaccgaaaactggtttgaatcgtgaagtttatcatttctaactcacttctcaaaattgttgataaattgcaaatatatttttccaaaagtctgttgacactttttgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctttttattgattcggatgtttttatcgcggttaattagagcaccgaaaactggcttgaatcgtgaagtttatccatttctaactcacttctcaaaattgttgaataaattgcaaatatatttttcccaaaagtcctggtgacccttttctgaaaataaa

SEQ ID NO: 36314 - DNA, 892 bp, Heterodera glycines
aggaattgattaaatgcaatgcaaattgaagagaagggaaaacaaaggaattgccttgaggacgcgttccttttttgttctccgtaatgactgatcggctccaatacaaaactgttcttgtggcattcgattggatgtggcgaaagtgtccaataattcggaggtcggttcgccattctgcgcactttcctcgctgctttcgccctgaatttgccttggccatcaatcagcttcatttgcccaaaataaccaaatagaatttgtccggcgtgtccactacatttttcttatcgttttcgtaatatcgtggaatgaatacggtttcccggcgaacattccttcgtggaaattctctcataaaattggctttcgtttggtccgtcttttgtcagcactttcattcagtgaatattttttgcttttttaatccgcttctttttgagcaattggccaattgttttctctttcttttttgtgtttttgtctgctttctctctcactttccatttctttctttctttctctcaattctttggcattgattttttcattttccttttgcaaaaagccaaaaataatcgattctttattttatttaagtcagctggtgcttgtttttattttatatttcgtgttttatttttgcctttaatattttggctgtggtgccacgtgaaaaaatttggcggagaagggaaagaaaagttttgctgaatgagagagacacaaggccagtgctaattgcattttaaaaatgaaaaacaaatcattcatcacagttttcaccctcagaatttctgttgttgcaagctggaaaattggccatttaagacgaactttggcgtgagaggaaaagcgatccccaaaagcattccatggactgttccgccgc

SEQ ID NO: 36315 - DNA, 805 bp, Heterodera glycines
tgggaaccgcccacttcggcgccggccttttcggcgccgttgctaacaaccttcttcattatcaaccaaattaaatatttttgttatcattcgatagcttttgagatactttattagcctgcaaaatttcaaaaaatttagtcagtttataaaaagagcgcacccagagctttcgaatgatgccagattagctaaagttaatgacaaataaaaaagttatagcgtttcaaaatttgcggcgccgaaatggtccgcgccgaagtgaccccgaccccataagcctcgccctaaactaaccttcaaaaattgtcgcaccccaagaagccaaatgatcacgctgtggccgacctcatgcgaggcggtgccggctttgtttgaccggagcgtcttccgggaaatgctggcaaggcgcgcgaatttgtttgcccattgcctgcgcatgtggcgctggatttttctatttttttttaaatgaacaactttttttgccattttctgttgtgctaaatgctttaaaatgtaattaattattaacaaaatgaaattgttgctttaaacggcgtaaaacaattaatccctgcttaaatgaattaagcattttagtaataatgtaaacttttttggcgttttgtttattgtttttcaaaatcaagtgctgctacgatgggtgcaaatccgcgagttgtcaactgcgtgccgccgacagcgtgccagccaattcaagaagccgtgacggaatgattggatcggcgtggtgggcgtaagtttgcatttgagtaaatcccattgatcacttgtaaattac

SEQ ID NO: 36316 - DNA, 822 bp, Heterodera glycines
  misc_feature (771)..(771): n is a, c, g, or t
aaaaatgttaattattagctcacttttcaagtttcaaaatcctcgacccatccgccggcgccgttgcgtccgccaatggcatttccgtccggcacccgccctttgcctggatgctcatcggcatgctgttcatcctcagcgtgcagtcgctgatgctgctgacggtgctgcgctgtcgttactttctgtcccagcgcgaattgcacgcgatggcactgcacgtggcgcagaaaagcgtaagtcacacaatagagagaacaaaacattggctaattaaattggaatttcaaccccctgcctccaatttgtgaggattcaaaaaattcctggatttacaaatatttatgaattattaattaattaaaagtgcccccaaaaaacttgaaaaaatgttcagcgccaggattacccgaccatccaaattgtggtgactaatggctccgttctttcctctgctgctgcagccgccgaaaatggctttgttgcaccgccgcaggggaacggcgttgtggggaacagtgccggcacagaaatggccaatggacacgcgacaacggcacaaaatggacagcagcaacagaatggggggcagcaggacgaaccgcaggatcagcccattctcaagggaattgtgtgatcagttttcagggattacccaagaaaaaaaaagacgaatttgtcatttatttatttttacggatgacgaaaacttcgaaaaattaatttttggcccatttttttttgtaattgccaaaaagtaaggcattgtgngatgaaaatgcaccaccaaattctttattttctgttttcgtccttcctttt

SEQ ID NO: 36317 - DNA, 670 bp, Heterodera glycines
ttagtcaatgtgcagagaacagaatagccaaagcgatttgtgctgtataggagaagccaaattttttattacctttacaaagtcatttttgcttaagcttttaaaatttaatttgcatttgccagttaggagggcttgtgattatcaaagatttctgatgaatgacccgcagcagccgctgtggaagaaacagtcaccgatttacaatcgtacaatggcactgggaaaagggggagggcatttacacagaagaaaatggcattcatttttacaacaattgtacagttctcatttcatttatatactctgatagcaaataatccctaagattgatcaactgctgattagccctgtgaaaagattaaattttacattatgcattaattactccgaatgtccatccatgcgcgtctttgactttgccgcctcgccaaaaagccgacaaaaagaaatttcacattcccaaattatgtcattgcttttcggcatttaacctaattatatatttccaaagattattttatcactagggttccaattttggaaaattcttcctttcgggtgaaacaggcacaaaatgccataaaaaagcctacataggcttagaatcacattttagtatttaaaaattaattttttatatctctttttttgaaaacagccgattttg

SEQ ID NO: 36318 - DNA, 1018 bp, Heterodera glycines
tggtgtaagtaaaaatcgtaattacgctcaaagagctcctcaaacaatttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgaacgctaaaattatcagagtgccgaaaatcgcatgtgatctaagcctagaaaaaaatggtgtaagtaaaatcgtaattacgctcaaaaagctcttcaaacaattttagcgcttccaattccttctacaatcgcctttatacatcccattatgaacgctaaaattatcagagtgccgaaaatcgcatgtgatctaagcctagcaaaaaatggtgtaagtaaaaatcgtaattacgctcaaaagcttctcaaacaattttagcgcttccaattccttctacaatcgcctttatacatcccattatgaacgctaaaattatcagagtgccgaaaatcgcatgtgatctaagcctagcaaaaaatggtgtaagtaaaatcgtaattacgctcaaaaagctcctcaaacaattttagcgcttccaattccttctacaatcgcctttatacatcccattatgaacgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgcatgtgatctacgcctagaaaaaaatggtgtaagtaaaaatcgtaaaacgctcaaaaagctcctccaacaattttagcgcttcccattccttctaccatcgcctttatacatctcattatgaacgctaaa

SEQ ID NO: 36319 - DNA, 911 bp, Heterodera glycines
  misc_feature (613)..(613): n is a, c, g, or t
aatcgcaaccatcagtaaaatgagtcaataaatcaatcacaaaatcgaaaaagcataatatttgaaattaaaatgattaaaaaaataataatgatttaaaatttgaaaatcgaattcgaacaatttataaaacccttaattattatggctaatttgtcagagtatggatgaggagaaattctggcaaagtcgggcgccggaaccaatccaattcgaagtgcaagttaaaaattgcgtgtgctcacaatgaatgattttctatgataattcttggcgccaagcaggaataacttttattcaggcttctgaccttgttctatcaaattttttagccataacgtgttttacgtgaaattttcttggacacgagaaaattaatcaaactgatactaaataatttggtttttaaattttatgttttcatataaaattaacttaattagaattattttatttgtgtgtccgtttcaactatgaaactttgcaagtgtctaacaaaaatgcgacacaaaagtgaagcaagtgtgtgaaaatgagataataaaataattaataataaaatttaaaaaaatgaaaataatttcataaaaataatcacaaatatttttccttntttttgtttttctcttttaaaacatttcttttgggatcttttgcgcccctaaaaacagggggacccctattgtggcacttgtgcccttattttcgccacactctttcggcattttgtgaaaaatttctttagccgaaaagtggaattaaaaaatgcaccaataaggaccgacctcttgaaaatgtttcaataagttggaaaaagtacaaaaattttcaacctatgaaaaaataagccgaaaaatcgaattttctataaaaaatttttttttcttttggttttattcaaaaaatgatgg

SEQ ID NO: 36320 - DNA, 446 bp, Heterodera glycines
aatataattttgaagtgccatttctcacttttctccaccgtatttcttctgctgttccttggctgttctgccgttaaatgtttctgctgctgctgctgttcgttgtcatcagcgtcgcttcgagaataattatacgctaaatgagcagagaaatccacacagaagccgatgctctgatgggggaattgattaattttattgaaaaggaatatttaattgggcattagccacggtaatcagagggcttttaaattaatattttcaattgtgccattagtgggttaacaagaaatgagtcaaacaaaaactaggctaatggtgcgccatcatttaaactgactaattaattgcactaattaccattatgatggtgaccatggacacaaagtcaagtcgaatggagaggaacggcatcaggccaagaacgcccaaattggtcgagactg

SEQ ID NO: 36321 - DNA, 904 bp, Heterodera glycines
ttcaatgtgaaaaaaatttccatgggatgccaacctttattttttttcgcctctttttgaaaagaaaaacttgttagcaaggggtgtttggaccaatttagaaacaaatcggggtaattaatttaatctggctttataagataaatgggaatttaagcggaaggattcatgcaaaataataatctatagaaattctcaaaaaagtagttcctcgcagattcggggaccgtttctataaagctagagacatatgcgctaaccataaaaaagatgaatcattttttgaaaaatttatatagttcgactaaatttgctaatcgatttatggtgtacaggatgtttgtcgaaacataactcgtcaggcctttaagatagacctgccattgctattcctgcaaatatggagtctagtcagcccaatcgattgctattcgaatggtttggggtcattggcccaaacaaaagttgtgctgcttcttgcaaataagacgtagccaactgtaaacagcaagccatacaaatgcttcaatgtaaaaaaaattacatttggatgcaacctttatttttcctcgcctctcttttcgaaaagaaaagctattagcaagcgtgtttggaccaattctaaaacaaatcggggtaattaatttaatctgactttataagataaatgggaatttaagcgaaggattcatgcaaaataataatctatagaaattctcaaaaaagtagttcctcgcagtttcgggaaccgtttctataaagctagagacatatgcgctaaccataaaaaagatgaatcattttttgaaaaatttatatagttcgactaaatttgctaatcgatttatggtgtacaggatgattggtcgaaaccataactcgtcaggcctttaagatagacctg

SEQ ID NO: 36322 - DNA, 948 bp, Heterodera glycines
  misc_feature (36)..(36): n is a, c, g, or t
aaatttattatttattaaattttcatgttgagtccnagagaatctggtaaatatcattgcatgcacattcttttctgtatcgacattctttgatttttatttatttattattagcatttttattttcttatctccttccactatttcatccactgtttcatttttatttatttttaataattaatacaattttttcatttatattatttttaatatgatttgttaatttatattcttaaaaaatacatttttatttctttcaaaaattgtatttttcatttttaaattgatatttttattaaatttgttctttgattatggttaaatttaattaaattgtcatatgcttttaccatcccttgaagcagaattactgatattaatttaattaaattttctttaaatctgtagtgatgcctttaattaaaaattttttaaatttaaatcttttttatatattttactgttttgccaaagcatttacaaatttttattatcattttttcaattttaaaaaattgaacttttcttattattaatttaatttagccaatagctccttattacgtgaatatattccttttataacactccatatattcatttaagcctcttctattaatcatttttttaaataaagtaatctaaaatttttaaatacttataaataattatccttaaaatacatcgaaaatcaaaaaaatttatgatttttttatctttatttttttaagaatcatattttacgaaaaataaatttttaaaattaattattgttaataatattttttttattaactttattttatattttcataatgtaacagatttcatcatctttttatttagaagtacacaattcttatgacaataaaagttactgtgtcagagtttaatttgaataaaaattaaagtgaatgaagtaaagcgaaatatttaaaatactaa

SEQ ID NO: 36323 - DNA, 924 bp, Heterodera glycines
  misc_feature (51)..(51): n is a, c, g, or t
  misc_feature (873)..(873): n is a, c, g, or t
  misc_feature (894)..(894): n is a, c, g, or t
ccccccccccccccacgcgacggtctgtcccctcgcgggcaaaaaatgttntaataatatgatgtacaacaaaagatcccatgccaaaatgacttggaatgtgggcttaatccccggcccagtcaggttttaattccgattccatttgcttgccaaatttacaaaggcgtaaatcatttacatgatggttagtcgagagtgtcgggaaaagttgcgactctcgagtcaccccgcccaacaatccctcatttttcgatcgcaattaattagaggtgagattctgaatgtggccagatccccgtgacaaaacatccgtggcgccaaaacgactcggaccctccggcttattcccgacccaattggctgccaattttaatcccaattccctttgtttgtgaaattttcttgatgttgtaaattctcgaattacatcacaccaatgtttttatctcgaaccttcaacacccctcccctgaaatcagcggcacttctgtgccattcttaagaattttgtgctttcactctcgtgtcacatcgtcaacccactcataatttagagcgtaattaattaattgtttgtttatcattttgttggcacaaaatgaccatttcctatgaggaggagttctcctcactgatgctccgatggcgcggctccatttggaaagcggtgctcaaagatctgatcggcttttacattgcttactatgtgattctgttttggcaggtatttattatcatggtcttgtggtctcttggtgataaagaaggactcggaattaccgtattttctctaattatcccccgggggattattttaaaacttcctcagaatgagggggataattagagaaaatacggtatatgcacganaaattgcaaaatatgaaaaanagtgaaaaatatgcacataaattttcccaa

SEQ ID NO: 36324 - DNA, 784 bp, Heterodera glycines
agaagaggtacaacagtgattagaagaggtacaactgtgattacaagagatacaacagtgattagcagaggtacaacagtgattagaagagatacaactgtgattagaagagatacaacagtgattagaagaggtacaacagtgattaaaagaggtacaacagtgattagaagaggtacaacagcgattagaagaggttcaacagcgattagaagaggtacaacagtgattagaagaggtacaacagcgattagaagaggtacaacagtgattagaagaggtacaacagcgattagaagaggtacaactgtgattagaagaggtacaacagtgattagaagagtgattaaaagaggttcaacagtgattagaagaggtacaacagcgattagaagaggttcaacagcgattagaagaggtacaacagtgattagaagaggttcaacagcgattagaagaggtacaacagtgattagaagaggtacaacagcgattagaagaggtacaacagtgattagaagaggtacaacagtgattagaagagtgattagaagaggttcaacagtgattagaagaggtacaacagcgattagaagaggtacaacagtgattagaagaggtacaacagtgattagaagagtgattaaaagaggttcaacagtgattagaagaggtacaacagcgattagaagaggttcaacagcgattagaagaggttcaacagtgattagaagaggtacaacagcgattagaagaggtacaacagtgattagaagaggtacaa

SEQ ID NO: 36325 - DNA, 905 bp, Heterodera glycines
tattttttaaaattctctatagtgtcaaaattactcaatgtcgaaatggtccagtgtcgaaaatgcaggaaaacagtgaaagttttagaaataattccgtgtcgaaattacttagtgacgaaaatgtagtgtcgaaattacttagtgtcgaaaatactcagtgtcgaatttacccagtgtcgaaattacatagcgccaaaaaaactggtaattaccggccagtaccggtaccggtaccgtgcaactctacctgtgagggaatcaaaccctcggcctctggtgctgatatgagaaaatgagcaataaaatagagagtaaatttgtagttccagaatcagactttattacttttgagattttcgccggtgagttttagccagggcttccatttgttcttatttatagaaatgttctgattttgggctattattattattttgttcttatttcttaaaattgttcataaatttagaaatttatggcataaatgttcttattttccctataaattaaaaaaaaatttccccggcggcgcctatcgacaccgccggacgctaaaatactttattttctttaaaattggctcaaaaatcaccaaaattggggcaatttttagacaaaatctgttaacaaatcgcattaaaaattacaaaattttttcccggcggcgcctatcggcgccaccggacgcccatgtccaacccccaaaattttttgaaaaaatgtcgcaaaaaaccttttgaatgtaaaaatggtcgccaattgtctcaaaatcgcaaaaaatgataatttttgatgaaaatctgttaacaaatcagaaataaattacaaaaatttttccggcggtgcctatcggcactgccggacccactcccctcccctgttctccaaaattccttggaaaa

SEQ ID NO: 36326 - DNA, 742 bp, Heterodera glycines
tggacacggaaagaaatggacattttagttctaaaaagcaaccatttttgaccactgatttcggctgtggtaccatggcgagcaatgaggggaaggtggaggcgggcaattggttgtccatttggaaattgtgcaatttcacgtgaagcgtctgctgatgagtggtctgacgatattgacaccagaaaccggtggccattttgagcgactcttcgtcacttttcttctgttttcctgcagaaatggcctaaatttggtattgaattaaatatgtactgaatcaatgaccatgtaaatgacttcaatgcttttcaagttgttgaccagggagatgcccagcccgtgcaagtgcagctccaattcgatgtccggctgttccatctgtgaaattttaatgattgaaaaaccgatggaatgtgaaaacaagataaatggttctgcccctctgtccactcacttcatacgcttggtgagcaatgaaagaaactttttcgtcagcagtgaactaaacaaaaagaaataaggaattatcgtaaatattaaaaatgattacgagcaaaacgcgctggcgcccgtccaaaaaggacacacaataatggtaaccatcattgttggctggcagataagaaatgtcgcggttgcgcaacaattcatccgaattttcagcatcgcccgactcccattccaatttacaatctgaaaaagggctaaaggattattgaaaaataaaaagccatttaaa

SEQ ID NO: 36327 - DNA, 1667 bp, Heterodera glycines
  misc_feature (1200)..(1200): n is a, c, g, or t
  misc_feature (1653)..(1653): n is a, c, g, or t
  misc_feature (1665)..(1665): n is a, c, g, or t
aaaattcaagttaaaaaccaaccatccattcccgcaagtgattgtcgcacccacttttccttgcgggaatgttcccacaccgttcatgcgcccctcggcattttgcacgacggcaccaggatgcttgatggtgtaaatcaatgcaccgaatccgtcactggtcagaaaggcacgccagtcaggctcaacctgcacgaaaaatggattacctataacataatcaccagttaatttttgtcaaattaaggattaaagggatgatttcatcaaaattaaattttgttttgccaaatgattttgtaaaagaactttttttttaattcatttttttttgctcttttataaaggtgcattttttgtattttatttaaagcgcttatgtattcattagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaaccaccaaaatatggatttatatggactaaaaaccttcaccaaatcaaaaaattttaacgcagaaatgctatttttaagcccctttcttcatagcatatgcgcagaaaaaatatgttaatccatataatttacaaccctaattattaatgaagacaaaaccgattttaaataatctttttgttcctgccacagccgagaattattaataaaaaaatttttgtttgcatgacacaagaaggcatacacaacccnatgcatgtgcaatgggaaacaatttatatcaattcataagtaaatcatctaaaaaaattctaaatgaaaaagacaaaaagttcatttattttaaatatattttaataatacagaaaaactgaaatgttctaatatcaatttataatatccatcaattaccagaaaaagaatttcagaatgggtgttaaaagtccgaatggacaagtgtcttttttcaaaaatgaaatcaaatatttgggtgtgatcattgatcaaagtggacgtcgaccggatccaacaaaatcacagccattgctgaaatgcgcattccttcaaatgtcagcgaattgcgctcatatttgggcatggtcaattattaccaggaatttgtacgaaatttccgattcattcgacagcccatggatgaactgctaaagaaggaggtgggatgggattggtcacccaaaccaaaantgcgttcaccanaa

SEQ ID NO: 36328 - DNA, 698 bp, Heterodera glycines
  misc_feature (56)..(56): n is a, c, g, or t
aaaagtcgttaagggttttaaaagcaaaaaaaccaaaacattttttttaattattntggtaaaaaccaaaatttagaccatccttttacgattattcggtaacaaaacccctaggggtttaagaagcaaaaaaatcaaaaaattcttttaattattcgcaaaaaaccaaaatttagaccattttttaaaattaaattttcttggatttatgactctcagaaatgtaatcacactgtattacgtggggcttgatgggaagacagccggagaaaattttgaaatttttagtgcactttgttaatagatttagtccaaaaatgacatttttacgattttaattgttaaaattgtgtttgaactcccatcgaaaaaaagattaattttgaaaaatgagaagaataaataatacttggaggggaactgatccaacgcaaaaataaggaacaaaaccaagaacacaacccgctggaccacgcatatattaacaactttgaacaaaaaagaacctaaaatttataaaaatagaagtttaccaaaggccaacaatcattaggggtgtaaaaaagtctcggtctcggtctcgagtctcgaaaatcgagaccgagacttgaaaacccgagactcgagaccgagaccaaaaaaacccgagacttttctcgagtcgagactcgagaccgagactctcgagcatcactact

SEQ ID NO: 36329 - DNA, 162 bp, Heterodera glycines
ctcagttctaatttttaaaaacgtcacatttcctaccccccattctccaactcaaaaattttgagaacaaagtcagaattttaagaatgtttctcaagaaacaaaaaacaacttgcgagagttctcactaattatcccattttcttggcaattaattaatta

SEQ ID NO: 36330 - DNA, 113 bp, Heterodera glycines
cgcgcgcccaggggccgccgtgcggatgcaccagcgccggaagcggtgcgtcgccctgtttccaaccggccggaagatcgacgatcgccggaatcgagcggccgtcgcgcgcg

SEQ ID NO: 36331 - DNA, 796 bp, Heterodera glycines
  misc_feature (504)..(504): n is a, c, g, or t
  misc_feature (550)..(550): n is a, c, g, or t
tagttaattaattattaattcgccggtccttaattagttccctaattgtttcttcccaccattttaaccggaagttgctgcgcgttttgaagctcttgggcgagcaacacgttcagatcgtccatgtagaacactttgactttgctaaagtccacatcctgttgaaaggcgtccacctttttgccggccatcacctttcaagacaattcatcaatttgacattaattgctcaatttaatttgggtaattaggactatttaataaaaaataacggatttaaaatttaaagtggggaagccctttcattaaaatataataaaggttattgagaaaattcatttattttcataaaatttcttgaaaaatgatgatttttgtcgaagggggcgggtcatttttcatttttttaaaattaatgaattttatttaaattaaataacaaaaaaaatacaaaaggttttacaccaatatttaaatttaaaaaaatttttatataaaacttanacattttggctaatattagagccctaattgtttttctgctaattanaaaatttgattggagaaatttatttttatttttttttgtcattttttcctttgaaatttaccgcaagtgccaacggcaagtcagaggcgtagcggcacattggtccattgctgagcatgttcagggccggcttgtataaaaggcttttgggcaaaatgccctcggtcggcacgacgtcttaaaaatagtcgtccgtcatttttccgtgttcattttaaatgtcttgcaatttttggttaccgcatt

SEQ ID NO: 36332 - DNA, 558 bp, Heterodera glycines
agcacggtttttggcaaatcgtcggacgacgaagcggcaaagagcgaccgaatggtcaagggcagcaacaacaacagcacaacggagggttcttccggtggcaatcgtttgccaaaactttgccaagtctgatgacgcaacaagcgaattcgtacggaaattcggcagaaagccgagggggaaattgcattttgaatgagaaaaggaaccaaagacaatgggaggagagagagatggtggatgcgaacaacaacaacaattacaacagcagtgatactgataatggtgggtggagaaaaattggacggattaaaagccgaggaaaaaagagaaaatgccatgggaaggaattgtgccgtttccatcccattaaatgcccggctttcagaggcggtgctcgacagtgcctttctcgcgccgtttgtgccttcctccgtctcttacagtgctcagaaccacaacaaatgccatctcccgcaacgttttacgcatctgatgaccgatgagaagaaagtttaaaaggaacacggcacaacaataataacaatgaaaaggtga

SEQ ID NO: 36333 - DNA, 881 bp, Heterodera glycines
atttatttaattgttgataaaatttatttgaaggattgtgtgccgtttttatacaagctttgagagcattggccggaaacgaaaacactgtgacaatttattcgcttattatggaattgctaaaaaagggtgccaaaaaagacgacgaaaaaatcaggaacaaatttaaaaacttggcaaaaacattacgccaaatggacactcgagaagttgagggaagactttttgaaattaaattgatcagagagggcaaaatgggcgaagtgatcagagaaacccaagcggatgtggcaattgtttttgacaaaggcttggaaaagtgaggggcaatttaatttaaaacataaatttaaatttaaaactaaactttaaatttgaaggatgggcaaagaagcgggagggcataatgccaagcagcaaatctttcggaaaatgaacccgctacagattaagttcactgacacaaaagttggccatcgcacgaaatttctgcttttctttttgcgtctgtacagaaaaatgatcggacaaattggggcaccataccaaggcagtgccgaactgtacgcggttacggtaggcaccgcggggccaaaaatggacataaaattagggagaagcaaaacgaaattagcttatttaaaacaaattaaggaaaaagtgaaacggacggaccgcgaagctttgctaattttgatgagcatggcaaaagacgaaatcatggcctattttgggggatatttgaacattaatgcatttaagcaacacaaattggtaaataaaattttaatgctaggaaattcagaaaaatattttcctaattaaaaatttcattttttaaataaaatttaatttttaataaataaatgaagaatatttgt

SEQ ID NO: 36334 - DNA, 1259 bp, Heterodera glycines
ggatataaaaagacaagtaagttgtttttacgtgatctgctgtccattttttgttgcgtgccattatttttgtctgtgcccattttttttgtccctttcggcgatatgcttccgtccgaccgcaacatttgttttttcttccctttgccttccgccgtttgtttttccttcctctgaaactccagcaaaacccaaggacttctcattgcccgcaagtgttgatcatcatcctcatcattattatcaccacgccctcattatggctgctcctccgtcggattttgctttgggccctctgccggtgaaacctgtcgtccgacgactaccgtatgcacccgaagacaatccaaaaccgatactcgcgtctttttataaaactaatcttttgagaattgacttcataacaagcaaaaataaaaatttaaaaaaaaaattgcatatagcggattcgaacctggtgcgactgttactaacgcattacctctacaccatttgacaatgcgaatggttgcaaataattatttaatttgtttgttcattaaaaaagtttggcacgtcatatctcggcacagaagctcatttggcaaaaatggttaaaatttcacaatagaaactaggggtgatttacccacccaccaaatttcatttggaaatcccacggtcacttgccgacccctcctttgtcagggttattaatgttaggttcggtgtcaggatttgagattttttaaaataagtaaggtgagattgagatttatttaatttgtgaatcgtgctttaatccatgtttcattattcgaacatatttttgactttgagtcgattctgcaaaaatttcttaaaatgtagcggtcgggatcctacgaatgagaaaatttaagaatatgtaatgagtccgcttcacgccagctcgaaaattgggcataatgtatagttttaaaaaaagaaataaagcaatcaaaattcgagataattcaaaaggttatttatcggtaaggccttagaatgaatattttctgctgttttttcgcgagaaatgcaccaaaaggcattaatctacttttgagatttgtgcatttgattaataaaattatgattttcactggatcacgcagaacagcgattttttttggaaagtttatttaaaagcaaaagtaaaacggaaaggtagaatgtgattaatgagaaagacataaataacagatgaaaatggttactttggattattctgagttaggaatgtgaggcaggcccgtagc

SEQ ID NO: 36335 - DNA, 1077 bp, Heterodera glycines
tctcggttctcgattcccgactcgggaaatctctcgggtttttttgggtctcggttctcgtatcgtttcctggggtcatttcccggtctcggttctcggtaaaaatcacttctcgcacagccctagtctatgcccaaaatcggtttaaaattaagcgatttcaatcccaaatagcgtagagtcttaaatttaaatttaatgctgattcacaccagtctttttttctggcggtgcttttttaagagataccttcaaaataccaaattctcaaattctgtttcgaggcctaattttgatttttttttcatttcaatttttgcctattttttttatatccatttatcgcaaattatctgtttcatgttttgttttttttcccatcattatgccaatttttccacaaacacaactaccaaggaatgctgctgctgaatgatggccattttgtttttgttagtgttgttcaacggcgaggtgtgcaactgctgttgctgctgctgataatgatgttgcatatgagtcaaatgatggtgatggtgacgaatgtccatgtccaccttgaacccgtcaacgacgacgccgccgtcgtcgccatgctccgttttgccgtttaacaacaaatcatgatgatgatgatgattctgctgatggtggtggaatgaagcccggtggtggcaccgcctccgtctcctcctcgtcgtcatcctcctcctttatgactaatggtggcgggtggcaatcggtggaaggcagcgacggtggcgaaagttcttttggcggcggcggcggcgccgtttttccgccgccgatggtcgtcggggcgcgccgagtgcagcagacggaggcggcggacccgctgaggtcaatggcctcctccttgtgctgctcctccttcatcaacggaacggtcggatggatggactgcttttgttgttgttggttcagaaagcaacaaaaaaatggtgtgatgcgcgcaaataatataaacaaaaacaaaaaaacaccaatacaatctgggcaaaatattggatgaaatcgggggataaagatctcggtgcgtcttgtatatgtgtactg

SEQ ID NO: 36336 - DNA, 446 bp, Heterodera glycines
tttctaaaattttgattttgcttcatttcttttgtgaatctgcctttatcttcgtcaatttgattatttaatttgtttgccacgttttttaacaaatttattgttgatgggcggtcattgttggaattttggtcatcatcaccatcatcatttgccatggaaaattgaaaaagaacggcaacaaaaagcggcaaagcaattgcggccacgaatttaactttggggacatctgaaaatttcattttggcgctatgtttttctaaaaaaaagaaaaaatagtaataaatgagaatgaagaatttatgccaccatatgaatatgccaaaattgggatgggaaagagtgaatgagtgtaaatgcatgatcaacaacatcatccccattattgatatgcgtaacatgctcctttattaaaaatttttgaggcagaattatggcaaactatt

SEQ ID NO: 36337 - DNA, 866 bp, Heterodera glycines
tattaaaaaaatatatttaatcggaggggggggggggggcgggtgcgttccccacaaaaaaaattttttttttttttggtacttttccgtcatgatataccccccgaaacttttttgtttacatatttttttcaacacctattttatgtgctgaaaacaaatccggcatttttttttacaagaaaaacgtgaaaaatgtgaacaattttttttcatttttacattttccacgtaaaatttcacgtatttttttttgttgtaaatgacgtaggaccaaaaaaacaccgagatttttttttaagtgaaactgacactcgagcacctaaatttaagatgtttttacacggtataccccaaaacacagtcgggaacaaatttttaaaaaattttcaaacagaattttttaaagaaaaaaaatcttagaaaaattttttcttagaaacttcgatgaaaattttttttaatttcagcgatttttttgaatttttttttgaaaaacttgtaattcatcagtaaattttaaaaaatcgccagaaaattttcaaaaattgttttcatcgaattttctaagcaaaattttgcttatacttttttgttgaaaaaattggctgtgttatgtcttgactgtgtttctgcggctgtgttttgtcctgttccggtttttacagcaattaaagatattactttaatttttgcagttattacataacgccagaattggttttaattttcaaaaaacttgataagaaaaaaaatcatgaaatttaaaaaaaaatatatatttctccttgaaggaccagcagtcgtctgctgatgaatggaagccaaaataagggggcgccctggcacaacggcgcaagaagtga

SEQ ID NO: 36338 - DNA, 117 bp, Heterodera glycines
ttaaccctcttcgaagggaaattggggtcgcatcccaacaacaatcatgagcgcgagaaatacaaccgaccgaccgattgacgcccccccccccggcgccgtcccccgccgcttacg

SEQ ID NO: 36339 - DNA, 578 bp, Heterodera glycines
ctttttaaaaaattgttgaattaaagcattattattctctttcatatattttaaatatttttaatgtgcaaaatttctccccactacctaatcagaactgctggtccctttgtataatatttttttttggacctgaaacctcttagaaaacaatcaccttggtaatgcatattgatgagggatttagaaacggattatcgccagacacgcacataaaaaggcagaaaaatcctattatacgcactatgacaccatagacagattattagctcatttttaggtaacggaacccatgacaaattccagatcggataaacttttttctaaaaggagaatttttgtaacgacaaattttcatgaataaaaaaatttttgaaaaaacaaactttctgaacatttggcattctatttttaagaattttcaaaaaatcaatgcatgatcctgctgaatcctgcataaaaatcaaatttgcgggtcctgctgcaggattggaattcggaattttttacaggacaggatccggcaggattaatcctgcaaatcctgtaaatcctgtattttccaaaatatgcaggat

SEQ ID NO: 36340 - DNA, 888 bp, Heterodera glycines
tttctttttgattattttaattgtatttcatccctgaactttttttaataaacattttcaaactttcaccttattaatttaaggcgaattttgccttttttaataaattctcttgtgaaaaggcaaaaaaataggctcttttaaatatgcctatttaaatgactttaattgctgtcctttcgcttacgaccataccacgttgaaagcacgccatcccgtccgatctggcaagttaagcaacgttgggccttcttagtacttggaacggagacgtcctgggaatcgaaggtgttctaagcttttttacttttttcacttttaaatttatttaaattttcaattttttttggcttttttgaaaaaattttgtctattttttaggcaggcactgcctctgacaatgttttttatttatttagaaaaataaatttattttttttctttttaattattttaattgtatttcatcctgaaatttttttaataaacattttcaaactttcaccttattaatttaaggcgaattttgccttttttaataaattctcttgtgaaaaggcaaaaaaataggcttttttaaaatatgcctatttaaattactttaatttttttcacttttaaatttatttaaattttcaattttttttggctttttttcaaaaaattttttgtcttttttttcggcaggcactgcctctgacaatgttttttatttatttagaaaaattaatttattttttttctttttgattattttaattgtatttcatcctgaaattttttaataaacattttcaaactttcacctcattaatttaaggcgaattttgccttttttaaaaattctcttgcgaaaagcaaaaaaataggctttttttaaaaaatgcc

SEQ ID NO: 36341 - DNA, 921 bp, Heterodera glycines
ctctccgcgcccctctgcccatgctgggaacatttgtctggtacaaaatttctcacaaaaaagagataaccatttttctggcatagagaataaatttaaaaattcccatgtagaatagaatgggcattgctctccgcgcccctctgcccatgctgggaacatttgtatggtacaaaatttctcgcaaaaaagagataaccatttttctggcatagagaataaatttaaaaattccctgtagaatagaatggccattgctctccgcgcccctctgcccatgctgggaacatttttatggtacaaaatttctcacaaaaaagagataaccatttttctggcatagagaataaatttaaaaattccctgtagaatagaatggccattgctctccgcgcccctctgcccatgctgggaacatttgtatggtacaaaatttctcacaaaaaagagataaccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctccgcgcccctctgcccatgctgggaacatttgtatggtacaaaatttctcacaaaaaagagataaccatttttctggcatagagaataaatttaaaaattcactgtagaatagaatggccattgctctccgcgcccctctgcccatgc

SEQ ID NO: 36342 - DNA, 1094 bp, Heterodera glycines
  misc_feature (138)..(138): n is a, c, g, or t
  misc_feature (970)..(970): n is a, c, g, or t
  misc_feature (1041)..(1041): n is a, c, g, or t
  misc_feature (1058)..(1058): n is a, c, g, or t
aaagttttttgggaaaagcggcgcctcgaaaaaagcttttttattgattttttaatatttagaaatgaattttacaaaaaaaaggatttttgctttatgattttgactattaaaaaagttgtagaaaaaatttcgctntcgcatttcgcaatttcgccttttttggatttcgcgtttcgcatttattttcctttcgcattttttactttcgcaaatttcgcgtttcgcattttattttccgatttggcccatccctgttatacaaggaaaatttgagaattgaataaatcatggtttatatggcttgcttaaggcctaacaagcggatgttactggataacattaatcttattataaattcattgacacgattcattaatttaattattttatcaatcattgagttttttcgggtcgctcaaactgcatttttttcgcatcgtctcagtacgggtgtgttccagggttgccgcccgaatcccgaaacccgacatttttctcgtcccgaaacccgacccgatattcttttggacccgcggcaaccctggtgtgttcgaccacgcggttgtgccactccggggtacgcagaagggaacggcagtaagaaatggcggcactgacggtggacgggaagggaaacgggagatccctcccgtctgaattggggatcgagaatgcgaagcgtgtgaaaaatgatcgttatgcctttttatctttccattttctctaatttgtataatttacttttgttcccatttttcttccaatttttagctacagaaattattcctctttgacggatttacaattttgctccttttcccctttttcgcatatctgcttctatttctctcttttgtattctcgaaacaatattcgtacaatttcgaaataatgcaatgtttgtcattctccctttatttatttaaattcctccgcaacattgtcttaatatttgtgaatttattanataaaaaaattttaaatcaaaaatgtatgaaaataaaaatctgattggataatttatttttacacaatatntttatggttttatgcgnaatcaacaaatacatgaaaaaatatacaaacgaata

SEQ ID NO: 36343 - DNA, 1311 bp, Heterodera glycines
caaatgggaacaccgtttggaaggcctggcgatattccttactaaaaaaaaataaaaatttaattaatttaagtaattattctaataccttgtgacgtacaaaatgggtgcatttgatgccgcaccaatgttcattgggattgaggtcaaaaagtgggcaaaccaagcagtgatcggtgatggaattaagggcttgatgagagtgagaaaaaacaaacagataaaatagcctccaatattcactgcgatgatgcaacaaagtgatcgaaacgtacgataattaatctgatcagcggaaggcaaacctaaacattaaataaaatagctaattcaccattattattttaaaaattattacctgccgatttaattcttataatgagtccgacaaataaataaatgaatatggtaattacgatgagaaagagacatattaaactgtattgagaagaaccctaaaatattcttttttgttgatttgtgaccaagaatttatttaccatgaaaaaatcggcataagtgccagtgatcatttgatcaccattcaattcaatattctgataaaatgtcagacatgaacctaaactaaaagtgcagcaaataattgttatcgtagccaaatacagtcggattttgcatttgctatgccttaaaacagtggaattaaaatatatattttttgaatatattccttacatttcgccaaatataattccaatcattctgtcaattccaataaaaaacattataggaggaatgcctcctaaagtcaattatgataaaatttaattattagtttgagtaaattacctaacccaaacaaaggaatcattaaaatctttgccgccaaacgatactcaatgaaattttgtcccgaaaatgctgtataaacaaataaaaaatggccaaactgatggagcatttcaaaaaaggaacaaagtgccaaaaggtaattaacggtgccacggaatgaccttaattaaggttcaattaaaaataattaataatgcttttccaagattttatcgatattaatttcacgcactttgttaaaaaggttacaccaatgacagaagaattgaaaatgatgccaattaccgcaatgattccaaaaatcagtgcgcatccaattaatgaccagctgggatggacatctttgaaggccaaataaaactgcaaaaaaattttaaaaaagtaatttttaaatatttcaattaatgactaccgtgttgttgttcgttgagttgtcattcattttgctgaatttttgtttaatggattttttttaagataaaacaacaaatggcaata

SEQ ID NO: 36344 - DNA, 1113 bp, Heterodera glycines
  misc_feature (711)..(711): n is a, c, g, or t
taaaaatttggtggaagagagaggggtccttgcgttggcaaaagtcggcgtcatggaattttgttttggatatttggaagtggtattaagaaaatttttaaacatggggatgggatttttgacggaggtactagcatcaatttcaaacagtcgttttacctgcaaaagaccaatgttcagttcctcaggggtgtagccacgctgcagatttcgacggacataatcatggtagtcgcggacaatgcgcgtaatgacgtcactggtcgacacgccctcggtgcgctgagtttcctggggacaaaaggacaaaccaattaaaaaatttcgaaaaagctagaattattcaattctttttttaaaatttcgatggcgaaattttgaggtaatccattatcatatcttataatatcttcttttccaacccaatcataatccccgcgttttaaactgaccacaaacatatccgcgcgacggaatttctcgtacaagtcctcctcgtcctttgccgagtagggaagtgcatcgtgtgcaatgaaatcgatctaaaaattttccgataccatttccatggttgacaattaccatccaaaactcataaataacatcaagcctaaatagaaaatgaaataactaatccccaattttttttgaatgattcgaatgtctgaaaatcgacggggaattgtcagtcagtgcgtgggacgaggggcncctgccatccctggcgagaatggactacgtttcccttcctcccgctaacctgcaaatttttaacagttatttcaaaatgaatttctcaccttatagcgcttgaggaaatcgaccgagacataccaaggggaatttgggagaatttcgtcgacgtaacgacagtggcgtactccttcatagcgttcctgtcagaaaatacatttaaaaaaataaaattccttttggaaataaatgaacagctcaccgtctcgttggtcactgtcttccctttgtacttcttggtgtcctcgtctccattcactgaattgtaaacaaaattttaaaaacgatttttcaataaatggccaccacccccaaccatttcacctccgacgatcagataaacattggaaacgcattctt

SEQ ID NO: 36345 - DNA, 921 bp, Heterodera glycines
ccagaaaaatgggctttctttttttttgagaaatttttatcccttacaaaatgctctcgagcatgagacggagggctgtgcgcaatagcctttttatttctgagagaatttttatatttagacgctatcccagaaaaatgtctatctctttttttgataaattttatacacatacaaatgctctcgagcatgatagggagggcggtgcgcaatagaccttttatttcacagggaatttttaaatttatactctatcccagaaaaatggctatctctttttttgagaaattttatacctcacaaaagcgcttgcgtatgagacggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgatgaaatttattacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaa

SEQ ID NO: 36346 - DNA, 987 bp, Heterodera glycines
  misc_feature (956)..(956): n is a, c, g, or t
cagatacagatcataatagaaagagaagtaaccgagcgtatggctgtaagaggaagagaaaggctggacgtgacgaaagaaagaggaaaagtgccggaggggatgatcggaagcggaacaagccctgagggagtgaatggaagggatacagaaaagctggaagagacaagaggacgaataatcagggcaatatctgaccggatgaatggaaggattgatggaatagagggatcaatgccggagcaaaagaatgaaggaaattcggatgaaaagccaaactcgtccgccggcaatgcttctccctcctttgcacattatttctcttccggtgctaaaaaaccttcaacaactgcttcatcctcatcctcatcatcgtcgtcatcttccgcgaagcgttcgtcctcctccgccccaagttccgccgctaccgtaacctcttccagtacagtagcaacatcttctaaaacgtcgtcttcaaaaagctcatccgatcaccggcagaagaagaacaaaagctcaaagtcatcagcgtcttcatcttctgcatcatcatcctcaacattgaagggtaatgaaaactaattgctgtgaaaagtaccaagtaatttcaatttataaaattttttttttaatttccctaataagctaaaaggctcccagacaatccgtcattggacaatccgtcagcaaatttattttaatgtacaaaattaaattattaacaatttaaataataatttgtttattttgtaaatgggatttttaaataagttcatttcaaaacccttcaagtttagtggatgcaattttagcagatttttaacagattttggtcccaaaattagcaaattttgacaatttagctaaattaattattaatgagcgtttaattttgccttaggctcttccccgctaaacgagtcgtccattgccacggaaatgtccaaaaatggtgngaaaagcgcttcttcggacagacaaagcagc

SEQ ID NO: 36347 - DNA, 666 bp, Heterodera glycines
tgaaaaaaaaattgaaaaaattaaaatttaatactcaaaaattttactgtcagctaacaaagcaaagtccaagtttttacggaaaaataaaattacgcagtggcagaaagtgctcaacgaggaagaagaagcggaagggacacagcccgggacagagccgacgaatcagtacatccaaacgacgtttatccaccgggacgcgaatagttggagagagaatcggacccacaaaaatgaacaaccaatgccaccacagatgatgaccgcgagttcgcgcagttcacccgccttatgttggcctacgttcggccccatctgttggcgcttgcccatgtgactgtggacaacgaaaacatcgactgctccgtggacgatggtcatccccgttgtggggaatatccaatggaaaagcctttccattttttggtggtcgaagactcgtaagttggcacaacatttgagtgacataattttttcattttaaaggcgttccggtgccgctgtgtatagcattgaacgcatgcggaattggcacgccggcggaagccgagcgcgcacaatggcacggattgaagctgcccttttggagtaagagagaatgaatgctgcgtttgttttcgcttccattgtgtcccccttttgcagtgctttgtcccgtcacagtgt

SEQ ID NO: 36348 - DNA, 1261 bp, Heterodera glycines
  misc_feature (91)..(91): n is a, c, g, or t
  misc_feature (133)..(133): n is a, c, g, or t
tttttcaacaatccaaaaaaaattgaaaatttaaaccccacccgcggcgcaaaaaattatagtaatttaaataggcataccaacaaaaagnctatttttttgccttttcacaagagaatttattaaaaaaggnaaaattcgccttaaattaatgttttgaaagtttgaaaatgtttattaaaaaatttcaggatgaaatacaattaaaataatcaaaaagaaaaaaaataaattaatttttctaaataaataaaaaacattgtcagaggcagtgcctgccgaaaaaaaagacaaaaaattttttgaaaaaaagccaaaaaaaattgaaaatttaaataaatttaaaagtgaaaaaaattaaagtaatttaaataggcatattttaaaaaagcctatttttttgccttttcacaagagaatttattaaaaaaggcaaaattcgccttaaattaataaggtgaaagtttgaaaatgtttattaaaaaaatttcaggatgaaatacaattaaaataattaaaaagaaaaaaaataaatttatttttctaaataaataaaaaacattgtcagaggcagtgcctgcctaaaaaatagacaaaattttttcaaaaaagccaaaaaaaattgaaaatttaaataaatttaaaagtgaaaaaagtaaaaaagcttacaacaccttcgattcccaggacgtctccgttccaagtactaagaaggcccaacgttgcttaacttgccagatcggacgggatggcgtgctttcaacgtggtatggtcgtaagcgaaaggacagcaattaaagtcatttaaataggcatatttaaaagagcctatttttttgccttttcacaagagaatttattaaaaaaggcaaaattcgccttaaattaataaggtgaaagtttgaaaatgtttattaaaaaatttcaggatgaaatacaattaaaataatcaaaaagaaaaaagaaaaaaaaaataaatttaaataaatttaaaagtgaaaaaaattaaagtaatttaaatagtgttggagtgttaaagaatttgaatttggcgcgcatcgattattgattaatgttgtgacgtgtcaatccctcccccttattcattttgctattttacattttgtactgcatttgacctccgacataaattgtgttttattattttattgtgtgtccgacattgagacacaacaattggcgcagtcagcagccgtgcttcacccattcgaagacacaccgaactgcaacccaacctcaa

SEQ ID NO: 36349 - DNA, 311 bp, Heterodera glycines
ccggaaaattttttgtaatttcgttctgatttgttaacagattttcaccaaaaaatgccaattttgcaattaaaagccaagcgacttttttttcgcttttaaaaacgcttttttgcggggcccttcttccaaaaataacagatttttgtccaaaaaatgaccaaattttgccataaattttatatttttttgtaaaatagttaggccataaaattttaaaattatgagtttgtttaaggaatcagaacaaattttggtcgctaccccaaaatcagaacatttctgataaatcagagcagatcacacccctg

SEQ ID NO: 36350 - DNA, 978 bp, Heterodera glycines
actgaaaatccatccttaatcgtagtcgtcctatcctccgcttcttctggttgtccttccgccccaacatcctttttccctttcattagagccctctgcccctccccccccccgcccattcatcgttattaccccgggcaaatgcacaacaaaaagcagccaacgcacaacatggcccaataggccgaaaatgtgtccacgactaacttgtggagctgatctgctgatccaagcacaaaaagtccgtgtgtatttatcgttctgcagactgattactcactcctccgctgtccctctctttctctctctctctcactcactctctatttatccctctttctctcactctctcgttatctctctctctctctcttaaccgctgattttgtgagcattggcccgccggtttaaaatgggaattaaatatgaaatgtctgctgcacagtgagctcactcattccatccacgtcacacacaaaaaatggaaatgataataatttacaataattcttacaacaattaaattaattgggaatgaatgaatgggcggaggtgaggaggcaaaaaagggtgtgcacgaagaaaggctatgacccgttttggaattgcataatcgggcgaaaaactcattgggcacggtacgacggggcagggaaagaaatggtttctccctcactaattagttaattgggtgaggggggtgggcgaatccgaccagtgatccccatcaattagcagaaaatgatcacccaaccccgatcattcgatttatcctgtttattcacgtccaatttgggtgaacgaacgcaatgaaacgaataatagccaatttttttttcaaatattgctgctaaacattcggagtcccaattaactaatgggaggaggagctccatttagtggatgtagtggatgtccatgcatgtacaaaaattggtcaccagaaaattgaataaatggcgaaaaatgttcgagtgg

SEQ ID NO: 36351 - DNA, 198 bp, Heterodera glycines
tttaattaaattaattaattagtttttgccacaacatggcaatttttgttggccactcgcttcatggtcggcttgtccattggtggcactttggtagttgtctgcagaatttttagagcatcagaaatttgaagaaatatttttgcctatttttaaaaaaatgaaattaaagcctttatttaatcttagaattaagac

SEQ ID NO: 36352 - DNA, 1088 bp, Heterodera glycines
ttttagtgttttcggggttgctgatcacgaatctgccatttattttgaccaatttcgaataccggatccgaactcgaacaaaaaatcgaaaattcattttttgttcgtatctttacagattgaccattttttggttttgaaacggtttttgtctaaggttaacgaccccgaaaacacaaaacaatgttttaagagaaattttaaaaaaatttaaaatttaattctcgaaaaatgttcgagttcaggttagggatacggaattggccgaaattgtgtccggattcgtgctcagcgcctcaaaacacccctataaaagtgtttaaaaaatttttagaaaaaaaaattaattaaaaaatttcgggaccaatgatcttcacaaattgccaaaaaccacagaccacgtccctgcaccccacgcttcaataccacgggaaagtcaacttccgatttcttaatttgtttcttctcgttggctgccacgacttctgatttcttattttgtttcttctcattgccagcaacaaccacttgaagctgtttctcatcggtggtagtcatttcagagagagtcggacagaaatttttaaacgaatggactgaatgtttaccattaataaacaccgatttggaaagcgatagtcaaaaggtgttaattgcaagactaataagtaatcagaaatcatcagggcgtgtatcagatccaaacaaaggcaggtcaatgttcatacgaagtaatatgcatacaaaaagccaaaccgtatctgtttgcttcgctagtttgatttaaaaatttattcaacaggaattgagttgtgtaagtaaaaaaattttgatcccatctacctaattgtgtaattttatcgttacatactggtaattaaatcttaaatctctttcttggcatactgctattttttaaaaaccggcgaaattagaaattaccgtacttggaagttaccgtacttctaaaataaagccccgccgggggctttattttttaacccccagttaaagccacgggattgaaatagccacttaagccaaaaaattcgatatcatagaaaaacctaggctcttttctctttaat

SEQ ID NO: 36353 - DNA, 1333 bp, Heterodera glycines
  misc_feature (1240)..(1240): n is a, c, g, or t
  misc_feature (1290)..(1290): n is a, c, g, or t
cgaaaacccccgggtattactccgaattgcataaaaacaactttttaatctcttttttttatgggaccaataaaatacatgattaccggagcccttattttctttgactgtagtatagaattagtgccgcttaaaaacagtaaatagtggttttgtaattctgcgctccgaaagggggggggcaaattacagaattaccgttgattggttctgcgtgttcccttattagctatttgacacaccatcccagaaatgagctcctgtaccagaaaagatttgcatatgtggctcagtggtttttgtaagatagtaagggacaaagggtggtggttcgagtccgttgtgcaacatgaatattttcatttatttttgtccaaaatattaaaaaatcacgatatttgggaattatttttgaaggtttttgccaaccaaattggataatcttggtatctttcgaaagctcttgataatgaaaagctttttctaagcaaatgctaagcgatttggtgtaccagagaaaagttatgaggctttaaaattttgtttttcttataacttttgaaatagagcattaacaaaaataaattcagcattaatcgatgcagaatttttttctctaacgataaacaaaatttcctgtggatctaacatatagaaagctaaacatagcgaagtaaatgttgtttttcctaataataaaaatattagatagtacgccaaaaggagacaaaaaattagagaaaaaaagataatgtttttctctggcactctctatttattggtacacatctcgttttttcggacggtgtgttaagaagtatccgaaaaaataaattttctctttttgcacgttttgggcccaaattcttaaaatgggaccaatgatctaagcgattgccatatatttatcacaataacttggcaaaaatactcgcctggtccgtgacatcgctttgaaagtcattttcactattatgtaattgacgctctgcaattttccataaaataaaaaaattttatttcttgaaaaatgttcgaatccgggttcggggtccggcgcggctattgcaattgtggcaatagtaacttttttgagtcaatgtacatgacatttttaagagctcactaaagatacaaaatgttaccaatgaggcagcagcggatgcatggagcgaatcatgaggaatctacgtttaagtcacaccttcaagacgaagtgagacaaattctgctcacttgngaaaacgaacaccggaacaatgatttgggaaattgagccatctttgaaancgtcagtttcccaaaattagttcacagctcttattcacgcata

SEQ ID NO: 36354 - DNA, 1070 bp, Heterodera glycines
aagtcccggtttggccagtttgatcgggacgggaaatcccggctttttcccggttcccagccaaaaagtcccggtttttcaacccaaaaagtcccgatcccggtcttgcccaaatttcccggtcccgctgcacactattcaaaataattggaaaataatttttcctttttaggaaatgttaaattttgtgccaaaaatttattaaaaaaataaataaaaattcaccaaaaattcgcctttgaacaatatcctcttctttcgtctctcatgcacataggcaacaaattttgaggcctataaataaaaaaaaatataaatttacatttacattttgatttttttcaattttaatttacatcgattggtgctgtcggtgcctgcaacatggccttctcctcttggactgaaaaaagaataaaaaagatttgttaaaaattgttttacccaaggcttacaaattttaaaatggaaaaatcttcgtttttagggaaatattaatattgaagttaaatttatcaaattatttataaattgttatgtaaagttttttcaaaaaataaattatttgaaaatgaaaattttatctcgaaaatttttcattttttattgcattattataatattttttaaatttaatataactaaaaaaattttaaattttttccagcaaccttcttgcatttcctgcattaattttgagaattgaattcggagtttatttaaagaatccatttttaggggtaatttttattttttatttttttgaagtgatcccatttttagaaggaaaggttaaaaatgcctatgaaatttgaacccattttcacaggtgaaagaagtaaaaaatattcccatacattgtgatgagcgtccaaatattttaataaaacaaaaacatagagaaaatgtgccaaatttatattgaaaaatgaattttaattttgtatttatattatattttaattttaatttaattttttatcaataagcaatgagaataaatatcaataataaaaataaagaatgaaaaaaagcataattagtttatctctgtatccaacagagaaaaa

SEQ ID NO: 36355 - DNA, 1035 bp, Heterodera glycines
  misc_feature (1011)..(1011): n is a, c, g, or t
acgtggcgaagagtgtagccgttttcacgctcctcctcctccgcacgccacttgaataattcgtttagcaaattattttgttcattccgtttaccttgagatatttccgcgcaatggtgctttgcttccctcgcttctcgtatcccaagtggggaacgatagcaatgcgttcatttcccatatggccaatgtcacgaagaacctcatacaagcagactgaaatattgatttatttaaataaaatacaaaaaaattaccgggattgtgattgaatccgtaatgtcggcacccgtcttttgggtgaagagttcacgcatcttaatcagtccatgggcaagaatttgaacgtctaaatgttgaaatcattattttatttatttatttattttacctgttttacagtagtcggcgatgacctctcgcagatcaaagcgagtctcacggttttccgcataccagctctcgagggcctttctgtcgtccggcaacatgcttccagggtggtaactttcgatgggcggcaaattgtccaagacatttccgtagttttccgcctaaattaataattatttgaatatttaaaattagctcaaaccttgttgaacccgtgcgggaaatattttttattctccactccttcaatcgataagccaaaggtcttcacaaaggatgccaatttgattggaatcaatttatagctgaaaacgaaaataattagtttaaaaagggtaagtccgatttacctgtccctgaatacggtacgggtaattgttccccttttgctcgtcgacatctctagcagatggtttccctgtcgaaccaattttggccgaacacccatgcgcaacatttcaccgaagattaggatgtggtcgtaacgtgagcctaaaattatgggtggattttgctccccatttgtttgcgcttaccggcgtgtgcgtaggcgtacgtagtgaccgaaaccggcttctcgccttcctcgtcatagcctatgaagataattgttctccngcgtcgttatcgtcgctctcatca

SEQ ID NO: 36356 - DNA, 607 bp, Heterodera glycines
actcggccttaaaaacaacataatgtgaataaaccaaagccgaaactcaacgaagccaaattgtttttcgaagcacaaaattaaagtccaaaaagtctcaaaattttctaagcccgaaactctgctgccccatgttttaagcgtaggccgattcacccacacagccaaaagtgtatcatcatcgtcattttatacacgaacactcaaattaataacgtatctctccatctgtagaagactgagtaacgatacatttccggtgcatatgtttagggtcactgcacgctatttggtaagacttggatttaaggggtaaagcaaaaacacgtttaatggttctaaaatgacttataattaatagatatcatcatttttttataaaaaacttggtatttcccggtgaaaagcaaatttttttttagagacattgtatcataggtaatttaagttaataaattgcgctaaaaaaccgccgcacactcgtttcgactttttgttcgaattcgggtccggggttcggaattagtcgacatggatgccggattcgtgatcagcgatccaaaaaacaccaggaaaattaaaattttgaattttttttttccaaaaa

SEQ ID NO: 36357 - DNA, 529 bp, Heterodera glycines
ataaaacatgaacaaattttcactttattgagtccgctaacttccaacaaaatccaaacaattcaataacaaaagatcggtaaacaacaatttccgatgatcgcaaaaagaatcatttgagtgggatgaaacgcgaactgtgcgttgcgccgattccgggacgaccgtgtttgacaggcttgtacgtaatagaaaattcgcccaagtaatatccaatcatctcagctcgaatttcaaccttaagaaaactttaatcataacgaatagaaaccgattccacacaaaatttctgggtatagtagatggtttccccctcttttgagaaattttttttttgttttcaagtcatgaaaacatatttccaagggttttcggggtcgctgatcatgaatcaaggatctattttggtcaattccgaatcgccgcacccgaattcgaacaaaatacgaaaacacaaattttttaaatttcgcatttttggttaaagcttcgtttaaaccatgaaatacgaatttaaaggttattagtg

SEQ ID NO: 36358 - DNA, 1116 bp, Heterodera glycines
gagagtgccagggaggtggagggggaggatgaagcataggagaactccgagagtaagagtgaggaaaagccgaaaatagacatgtgtgagtgaggaagcgattgtatgtactttgtgtgatctttctgcctgcttctgatggtggtgggtggatcagcggatgaaaagccggggctatagcagagggggacgaggtcatccctttctagctcttccgggcccttcccttcccttcccttcccttcccttcccttcccttcccatcgcttttctcttggacctcttccggctcacaaatgctttctctgctcggattgaccgcctgtgaattgtaacaaatcattgccatagacaaaggcaacaaaaggagaagcgaaaggatgcgggacattgacagaaactgacggaaaaggcaaaaaaaaattgggggggggggagaagcgaaggcaatggacgaccgaagcgacgcattcattcggccgacagccgaggcacagaggcggaaaatcgccgcgccaatgccatcggcggtgatgggatgtcgccatgtgaacggacaattgaatttggccaattactgcgatgacttttggccattaaacggtcagcctaatcggattcgcactttcattagtcctcgtcccatcatcgattggcaattgccattctttcgaattaatttccattcattttttcagtgttccgatcgattgctttcgaagtgtccaatcgcaaggaaaagaaagggaagggacagctgtcctcggaagagtttttcactgatctgctgattttcacgcacttcccatgtttttgcccattcaccgcttaaaacaatgggcagcgatcaatgcgatgaactgatcacacccccgcgggttggcttggatcatccgcggcggaagacagatcaattccaactcattttttctttctctctgtttattcgttttatgtatgtttcttccttacaaattaaaataaaataagaaattctataataaatggaatatttttaatttttggttgtacggtcttagttgtggcattaaatgccacggcgacgactcgtatcgtgctatggatgagtttggtctatggatgagtttggtctat

SEQ ID NO: 36359 - DNA, 914 bp, Heterodera glycines
ttatttttaattagccaaaaagtacaacatccctggccttgctgaccaaatgtttggatgttcccatttcaaatttgcgcaatgttttctttgcatatgcccagactcgcctttttgacttggaggtgaaacttaagcggatttaaatgaagttcttattcaaactagggttccgggtgtcgagtccaaccaggtcttgaaaaattttcataatttttcaaaaaaataactatttacgaaagagtttataatttctatgtattaaaataaaaatattttttcgaattcgacagtatttcaaataatgttttcaaaaaagaaggacttttccgttttgggaccaaagcttgaattttttttaaatcaacagcgggcgcgtgtaatttctaaagctacgcgccaaaattatttcggaggcataaatgccatgtcacaatttgagctaagatttcttcgaatgggtctgcaatcctactcgcccgttgttgattaaaaaaaaattaaaactttggccccaaaacggaaaagtatcgaattttcaaatggtcgccttttttgtccgttaatgcagacagatattttaaattttattaaaacttttttgattcgctttgcctggtccaaaaagcgaatgtattcggtagcgatgcgcagggtgtgaattttgctcattttgtccgatggcattgaggggacaatgcgtcacaactgattgtaagcctcattcaactcctggaatggtactgaatgcacacgggccaaatgcaatgagattcgtgatacattttcaggtaaagttttatttagctgctctttgaaaatccaacacgaccccttcccgacaaagagaaaaaattttgcgtattattatagacatgaagcgacccacttgaacaataagtggtcccaaatgc

SEQ ID NO: 36360 - DNA, 427 bp, Heterodera glycines
aaaaaacccaatctatatataaatttttaagattaatttatgatcagaataatagatctgcatgtttattgagggggaaattccaaaatatgggcctaaaccgggagaaaaatagcaaaaataggggtaaaaatggcagattcggagctgtggtcgcaaatttaaaaattttttcattaattatcaatactctcacccttttcgaagcccttttaaaacaaaattaaaaagattgtcctggtttggcggtgccgaaaggcaaataattataatttgtgacgtaaaaattcattctttttgaatttttaggattgattttggaaatgatttgtgaaggaatcccggctatatttttgatttttaaaacagcttatttcgcggtgtgctttttccaaaaaactggggaagatagggggttgtcaggcgg

SEQ ID NO: 36361 - DNA, 794 bp, Heterodera glycines
aatgaatagcattaaaacaacaatcttctttagaagcggactacaacatcaaaacatttggggttgtaatgtacgctttaagttagtttttcaatggaaagtgaacacaccatcctgctcatttgtcagccctactcttcctcctcctcttccaccactgtttttctgcagttatgccctcttcccatcagttcttctcattgatgagcacaaaaaaggggccatttgtgtctcatctcttccattcggaacccaacatgaaagtaggcgggacaacgcatctcatcacacggagaaggtgcccataaattcattagttcatcttcgattccttctcgaagagacttcccctccgaaagcgaagaatgggaaaaacatagagaaaggcgaaagtggtgaagagccatcgaagaaaccacccaaagagcaccgacaagcctggatttttgttagacttcgaaaataatttattgatttgcgcaaccaccagcgcagcttaagctggtttttaaataatgaattggatgcatacaaaaaaggcaattgggtaatttttgaggaattttaacatgttttttttacgtttggaaagtgtaaaaaggcaacctgccatgaacagcgtgatgacaaattagtcaccaacattcgataacgcgtctgtataagcggtccataactagaacttaatagaaagctctcttcgttaaaaaatgaatttattgatagggtaccagaattttggacgattattaaaacataacagataaaagtactaaccttataatgtttttaac

SEQ ID NO: 36362 - DNA, 1010 bp, Heterodera glycines
tatcaaaaaaagagatatccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaagtctattgcgcaccgccctccctatcatgctcgagagcatttgtatgtgtataaaat

SEQ ID NO: 36363 - DNA, 535 bp, Heterodera glycines
ttcgtgatcagcgacctagaaaatccctgaaaacttattttcattaatttctaaaacacatttataggaatttgaaaatgtatattaaaagtaacccgtaaactgcacaagtaccaaattttcttataaaaaattttctaagaatttttccttgaaaaatttctaagtttgaaaaaaaaatttttgtaatttctgcggcgagcttttgtcccggcgagaggcgagatttcgggaggcgagattttggcggcgagattccggcggcgagatttggggtgatttcttatcaattttttcggccagaaaattttaatgggcaataaaaaaaatttcacggattttggtaatagttcagtttgcaccccccccccatttttgaaatttaaggggtttttgggattgcggatcacgaatataacatccatttgatcaatatcgaaccccgaccaggggtgggcgaagctcggcttagtactcgaagccgaagctcgaatcgaagcccaacttttttcgaagcacgaagctcgaagttcga

SEQ ID NO: 36364 - DNA, 884 bp, Heterodera glycines
  misc_feature (35)..(35): n is a, c, g, or t
ttatttctgggactttttcagaaatcagaattaanttctcctatggtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttc

SEQ ID NO: 36365 - DNA, 1045 bp, Heterodera glycines
  misc_feature (1007)..(1008): n is a, c, g, or t
ccggaaggattgcgtgcgattgttgtggcggagatgcgcgaagattttgcgccacaaatcctttcggttcgtttcattgcgtccgtcgtttcattctgcgaattccgtcggtgttttgcccctttaatcggacgacaaaaaaaagtttcactttgctttttgtattcattttgttttgccattttcgaaatttgtttcatcgctttacttcagctgctgcttttcgcttttcctttactttttgactttctttttcttccctctttccttcctttgtctcttctcttttcttcctcttatctttttccttcccatctttctcttcttccttcctttgtctcttctcttttcttcctcttatctttttccttcccatctttctcttcttcccgcttttgtctcttttcttcctctttatcttttttccctctttcttcttttgtctcttctcatttctccaatttcttttcctccttttgtgtcacaatgtttccacgtctctcttcttcttgttcgtctctcgcttttgtgtgtgatcgctgttcagagcccattttgccaaaagaggagtccattttgactgtcggcaaatgtttcttccatcgaaattgtttcttttgcagtaagattgttaaattgcttacctacaataattgccattttctagtttatttattatttcaaaattaatatttttaagatcaaaaacaatgcggccgcgcgctttccttggccgagtacggcgtccaccaaagcgaagtgaatcggggcaattatttttgggcaaaaattaatgtgccaattagcgatgccattgacccatcatttgcaggtattctgtgctaattgttttgtctcgctgttttctgttcaaagggatgtttctatttcttatcaatccgaaaaaagtgacggcggatgcaacggaaatgccattaaaaaaaacaaagtggagaaggcaattgtggcacaacactacgaaagacaacttcgaactgtccaattgnngggacgaagagggacacggagaagagcagcaggaaac

SEQ ID NO: 36366 - DNA, 1358 bp, Heterodera glycines
cctcggcagttcctcagggcggtcctcaaacagcacaatgcggtacattcccggatagagccgatcctgttaaaaaaaaaaatttgccaaattatgcggcagaaagcattttcaaaaatggcactgacccaatggttttggacatgcgggacatgctccaccccgtacgcttgcccatcagggtcaatgccggcatgcagcatcaacccccggaccgcttcttgcattcgacccgggctggacagaagacgattcagtacttcatgatttgcgcaaaaatccggcctcctcatcactgctgttgcagcagcggacggcacgttaataagatgatcactgctgctgctgctgctgctgctgcttacgtccccttgttggcattgttgttgtgttgcaatcatttttgtcaagtcatgatcagtgtaagaacgggcggcaatcaacgcgtggaacaggcagaaatggtcaccgacattccgtattcggatcaactgcctctcgttgtaaccccagtgctgataatggtggaagcgcggagctgctccaaccggcggtgcaatgcaggtgatgacaatttgaaccggttcactgagcaacagggatcgcttgctcattcctccgccatgcacgtcttcgtctccgtccgactgtcccagcttttccagttcacccatcagagtgtcggctgtgttctgctcaggtggccgtatcggtagcacaatagggtcagtcaggcctatatgatgatgatggatgttcgatggggacatttgccaaaaaaaaaaaatgagtaccgtttccatccagaaaaattccaatctttgtcactcgtcgtcttgggttttgttgagcggcgccgccaccgtcttgtggctgctcctcctcctgattcctagactgctgttcgttctgctgctgctgctgctccgcattgcgtattgctcgtttgatgatgcgctcaaatgcgtcgcggagagcctcgtccggcctctcatgctgaccgttcagcacaaactcggtgacgtgccgctgcagtgcgaaacgctccagccgatgcacatagtgctgcttctcttcatacaattggtcagcagtagcgccgcctttttcatcatcatcatcagcttccggattgctggcgttgttttctgcttcgcttcggcggtcattaccactgccgccgccgccgccgccgccgctgtcatctttgttgttgttgttgttccgctgtgaattacctgctgctgctgctgctgctggtgctctaccgtagcctatttgcatacaatggtcgacttttgcgctgcttttgctgtactgatcagcatcatcaaactctgatgaggaggaggagcgct

SEQ ID NO: 36367 - DNA, 1281 bp, Heterodera glycines
tttaaattacaaaaaagggttgtgggcctgtgaatcaatggctgagatttgtttggcggttaatcgttgcatggaaattgcttctcctaaaatggcacgttttctattcgaaggaaaacgcattttcatttggatggttagtttaaatattatttatcattttaattaatttagaaaggaaacgggcgatgcgattgccaaaatgcaaaaaaacgggcacatgaattcaaaaatggacagttttttaaaggcttggcaaaatgcacggttttaagggccttctcgcaaagctggaagaaaccgggatttgcttacctataccagttttttctaacactgaccgcatatcgctacttacctaaagattaaattctaaaattaaatcttacgactaatgcctgcacatttttttgcccgatggaaaataaattgctgaaatgtaaatttaataaaagcttttgctcaaaactataaataaaaatcatgaagaaaagacttaaaaaattgaaaatatattgaaaataaaatattttatttatattttatggaatttgaaaatatattgaaaataataatatttaatttccttatttttatttttcagttgtttcctgctgcgtatggcctgtatttgtccatcttcaccaagtcgccatgtttcagtagcatttacatcgcttggttctcgaacccgcacattggttatatcagtggttccgaggaaaacgtaaaaaaatgctttcacgactatttggtttataatgacctatattaattgggtgctaggtaatgatgctcaagagtctcgactcgagaaaagtctcgggttttttggtctcggaaaatttttggtctcgagcatcactagtgttctgcctttgtttttttaatccaattaaatttaatttttttttatcattcaatacattaaattttctttattattttcaaaattttttaattttaaaaaagatatgtaaacttttaggcattgctggtcacagcttatttgaatctagataacttgcagaattttgctgactgtgatatttttttggtttgagcaaagttatgattttgaaaattttcaaaattatcgcctacggtaatatgtttaagacttattttgtaaaaacaatgtcttgaacccaataaaactcccaattagcagaatttaaaagttcaattatttgaaaaaatatttgaaatttgactttcttagataagaaattaatttaatcacgatttatcgattgttttctacttctgaatatataatac

SEQ ID NO: 36368 - DNA, 1033 bp, Heterodera glycines
  misc_feature (877)..(877): n is a, c, g, or t
  misc_feature (938)..(938): n is a, c, g, or t
aaaaagagataggcgttttttccaaaatttttgccaccaaactcccccagaaagaaattggaaaaaattaaggtcggcgctatcattccgaaaatgtggttggaattcttcagactgatgatcagaaaaagagataggcgtttttccaaaattttcgacatcaaactcgcccagaaagaaattcggaaaaaattaaggtcggcgctatcattcggaaaatgtggtaggaattcttcagactgatgatcagaaaaagagataggcgtttttccaaaattttcgacatcaaactcgcccagaaagaaattcggaaaaaattaaggtcggcgctatcattccgaaaatgtggttggaattcttcagactgatgatcagaaaaagagataggcgtttttccaaaattttcgacatcaaactcgcccagaaagaaattcggaaaaaattagggtcggcgctatcattccgaaaatgtggttggaattcttcagactgatgatcagaaaaagagataggcgtttttccaaaattttcgacatcaaactcacccagaaagaaattcggaaaaaattagggtcggcgctatcattccgaaaatgtggttggaattcttcagactgatgatcagaaaaagagataggcgtttttccaaaattttcgacatcaaactcacccagaaagaaattcggaaaaaattagggtcggcgctatcattccgaaaatgtggttggaattcttcagactgatgatcagaaaaagagataggcgtttttccaaaattttcgacatcaaactcacccagaaagaaattcggaaaaaattaaggtcggcgctatcattcggaaaatgtggttggaattcttcagactgatgatcaganaaagagataggcgtttttccaaattttcgacatcaaactcacccagaaagaaatcggaaanaatagggtcggcgctatcattccgaaatgtggttggaattctcagactgatgatcagaaaagagataggcgtttttccaaattttcgacatcaaa

SEQ ID NO: 36369 - DNA, 991 bp, Heterodera glycines
caaattttctgtaacgttactgttatgtccgtacgcaagctaattcggtcctgtcaatttttaggcaaatactggtttttgggaaatttattaaaagtcaaaaaggtttaaaaagaaatgtttacgctcaaaattaagataagcaaagtaaagttaaaaaggttttagtgagtttgatcgcttcaggcagggcacctgagattggaaaattgtgggtagaattgataagaaccgacaaataaaaaaaggacactgaagaaattaatcgaatgattgtgagagttgagcatcgatcagaaacactttgtgcatacctattccccttcttatgtagcgtaaacggcaaataaacgaagtccatcggttcctttgttgttatttcccttttcatcaatcatttcattgtggggaaatgtcgataaaaaggccaagagataaccaaacccatcgaacgcagcggaattcatttttgctttttttacccgtctttcctattccccccccccccccccgagggttcactttcccattcattttgtttttctttggcatttctttgttcctttctggcatttccatcttttaatctttccaatttgctcagatgcgcctttctccgccttctttcccccctccctctcctccccctcccccgcttttccactctcttctgtcccctaagttcttcctcctccgatcactccccttctcctcccctccaaacaaattcgtcttcttctgtcctcgattcgaattctgagtccaatcgcctcctcctcgacacttttggacgctttcacaattacctgcgcgtgtctctcgtcgaaaagtgcaatttgcgctgtctctactgcatgcccgaggagggggtgcccctctgtccctcctcctcttacctcggcgccgctgaaattgttcgactcggtctgccggcaatgaaacaaacggaaaatgcttttgctcaaacatttgtccgttcagttcgtctttt

SEQ ID NO: 36370 - DNA, 811 bp, Heterodera glycines
tctgtcacataaatgtaataatccgccatttttttgccaggacatttggtctgaacgtgccgatcggatggcggacaccagcgccctgtacaacaccagcgacatcggcgaacgcaaatggctgctcgatttgctgatggaggagtcggacccggactcgggcggcgaggagcacatcacggagcaggacttgaaggaaattgtcaaggtttggctttggactgaaaatttccatcaaaaatgccatagaattgccaattattgaacatggttttattgtcagattcatcacaagcgcaggaagttccaaaaggagtaccacaggtgcgtcattttgttggcacattttgttttgtttttggtccggggattgggaattgcttaggcgtaggcagaaaaattaggcgccacaaattttaagattgtattaaatttaaaaaatgcaatcgcttgaaaatgaaggatttttggtacttccgtgttttgctacctcccacctccattcgaaaaagttttaaaaattaatatttttggggttttcaaggtcactggtcatcacaaaatgctgtttgttttgacactcttaatgacacctggtcatagatttaaccaaatatctatgatttttaaatttttcgtggctgggggtgtagcaagacaaggaagtactggatttttaagtggaaagagctgtccaaaaaagtatttcgacgcgataatttttaggagcacatttaactcaatgataattatactttgagcacattaattggcaatttaaaatgttgcattcgacctgtaatcccgtaaa

SEQ ID NO: 36371 - DNA, 868 bp, Heterodera glycines
gggcagtgttcattgatgttgtggtggtttgacaaatgattttcttgtttttatttaaatccttccttaaatatgtgtcctgcattgagtctgtgaaattcagatgaaccgatttaccgatgccatttgggattggaacaaccaaggcaagcagtggaaggacatcaaacatttgtacgaaaagtcggaggaatgaatgtaaaaagactacgcaaaaataggcaacaaagaatcagacagacagtcaaacactttgatttttgtttcacctgacaatgagaatattcatttcttgttcaatagaggaataaaaagttgattttaagtgtacgaacttattatacgtaattaataaatacgaagccgattttcgggcctcgcaaaggatcgacgattttggaaaataaatcggtttgaacggttttggaggggctttgtttttgaaattgtcagcccggttcggctgatttgaaaatcacggtcatgtaaaaatggtgaatagcagggatgcgctaggtttcgcatttcacctttcgcattttttggcgtttcgcatttcgctattgattttaaatttggaataaaattttaaaaaatgatttttgctttatgattttaactattaaaaagttgtataaaaaatttcgcatttcgccttttcgcatattttagcttttcgcatttcgcttttttttcatttcgcatttttcagtttcgcaaatttcgctttttatttttcaatttggcccatccctggtgaatagtgaggcgagtaaaatttaggccttgaattcttaaatgttgacaatttagcgatcgaaatttccagcgtttctctcgcggaaataagcgcgtcgctcttccgttt

SEQ ID NO: 36372 - DNA, 1117 bp, Heterodera glycines
  misc_feature (12)..(12): n is a, c, g, or t
ccccccccgccncttcagaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcatttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaatttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaactaaaaaatttttaaaatttaataattttcctgcaccgaaggtactcactcggcctcttcgc

SEQ ID NO: 36373 - DNA, 1267 bp, Heterodera glycines
ttttttatcataaataatttatgcctgtgcaagacactgacaaattttttcagatttttgaccattggcgccaaaaaacactttatagcgtgcgccaaaatggccgcgccaaaatggccgcgccaaaatggccgcgccaaaatggacgcgccaaaatggacgcgccaaaatggacgcgccaaaatggccgcgccaaaaaagctcgcgccaaaaaagctcgcgccaaaaaagctcgcgccaaagtgggcggattgcgaaataagtaccaaaaagtcacgtgacgattgcgaaatcaatagggatattacgaaaaagagaaccaattaatcagttttgattgacaggtgacctaattttgggaccatattgcgaaatatttggaccaaaaaaaagtcacttgaagattgcgaaatgaacagggaaattgtgaaataaggaaccaatcaatcatttttggtgataggtttgcaaaattttttgagagttttttccgtcctattttatttattcattttcaattttatttttaaattgaatttaaataattaatttattgtcaattcattaatttatttatcgtgctgccattataaattaaatttgcacttacaattccattatcgattaatttgcgctgcggcggcatcgcggcgcggggcggggagggagggcggggagggggaggggatgataaaaacgcacggttttatcaaattttcgaaataagttttaatttcaggatcagaaaaacatcattaaaaaaatctaatgatttgagaaaataaaacctcccaaaaggtttaggatcaaaagataagggatttggaattaatttgcaaacgaaaaattgaatttccttcacctgtcactttggtgacaagtggatgattgatgaccttctgcggcgcggcgcgggagggatgagcaaaaaaaaacaccgcggggatttggggaatcggatttggttgaatggcaacttcaaagggggtcctaaaggttttggatggtcggcagcatcaaaggaccgcacccctcccataggcacggatgtgcgggaaactgtccggggcggcaacatcaaaggtttcacccctcgcataggcacgggtttgtgctgtaaatacccgtgcacaaaccgtgcgcttttggtgctttatactactcccgttttttatttttgaacccatttgcgtatttaagaaacgcactagcactattttattttttttttccatttaaatttttttttctttgtttaagcacaaat

SEQ ID NO: 36374 - DNA, 693 bp, Heterodera glycines
aaaaagtacaattttaaaaggaattccctttttctgactttggcatttgtcggcgggaggcggaggccaaaatttatttacgtcgtttcggtggcggagggattgaattgatttcatttgattttgatttgattttaactcgaattggccggtaatttgggaaatttggacctttgtgggctttcttttggtcatttcgaatggacaaagcagcggaaagaaatttattgccttccattgaaagagcagcggaagaagggagccgtcgcacaggcggagatttgacgacggaagaagtggcaaatagccgagccaatgaccattcgacgccgtcggcgatgacatttgacgagggggggggggagcaaagggggcaaaggcatttatgggcggggaatgcttttccttttcaaatgctttttcaaagaatggccaattttaatttcaaagacaatcaaattttattaaggcaatatgttttatgtttgcatttgcacatttttcattgtcaaaggctggggattcgctctttttgtgtatttttgctgaagcgttcagatcaaaaaagtgaaacaaaaaaccgggaaattttatttcgaaaaaatctttttcataaagtgaccagaggtgtcatgacaactcgtacaaaaggcaactcttacaattgcttaggttaagcctaggctataggct

SEQ ID NO: 36375 - DNA, 794 bp, Heterodera glycines
agcataaacaaaaaaatattatttcattatcatttgactttggaatataataaataaagttaaaatttattttatcatgaatttgtgaaaattttagttatttcaacaacttaatgaataaaaatataactttatatatttcttttatttatctcctgcgttttatcttaagaaattattgtaaactcgcttttatatttttttagattattttttgttgctttttactttttttgaattccgtacattctggttgaattaaaccgctggacatttttttaaatacttgtttctatttcgtcgctcaattttattaattaatatttaaaaattttattctttaaattaaattcaattttccccaatttattaaatgcaatctttcagaaaacttttaaaaataaaatcgttgaaaagtttaatattaagaacattcgccgcttcgcggccgcaggactggcgcttagcgcccgttttttaattttttgggggccattcggcagcttcgcggcctcaggacgggcgctttgcgcccgttttttaattttgtggggaacattcggccgcttcgcggcctcatttgcattgttgttctaaggtatataaactagcgtgtggcacagtaattgctcggtgtagacagtatactttttgtatatatgggcgggcgctgacatgagcgcctcgcgcaaaggacttcgtttctagtgcgtgcgcgtttgataagtgataagcaagtgcattcggccgctttgtggcctcagacggtcgtttgcgtccgtttcttaattttg

SEQ ID NO: 36376 - DNA, 702 bp, Heterodera glycines
aaggaaatcaaccggcgggcaatctcagatttatttggccaaatacaaaaagccaaaggtcaaaaaaaggaccaaaaataaacaaaaaaggaaatgaaaaagggggagaaaaatgcaacagcaaaattagtattttcccactttaaatatcgcaatttcaatttcaaatgctctctcttatcgaaacactttcccgggcaataaatgaaagaaaagtgaatgtttggttaattaataaagggggaggggtcatcagatggcaaacaaagtacgcatttaggtattaatgagcactaatgacaagccaaacaaaaaacaatgacaaacgctgccgaacggtcgaaggaaaatgagaaaaacactcttttaatgagtttggcatttgaaaaaacctaaaaccctgagagagagaaagaaagaaaagaatggaaaatgaagaaatgtagaaacaattatttggggggtttcgggaaattgggcccatacaaatgaacatttttacaaattgtcccttcgcgcagtcgacgacgacccttttgtgacacattccgccgatgaattgcgaaaatggaaaggcggaaaatagcggtcaaaattgggggagggaaggggggaacttttagaagaaggctcacttatttgaaaacaaataataattaagtggtggtttcggtagacgacgcatttgagtgagtgattttg

SEQ ID NO: 36377 - DNA, 668 bp, Heterodera glycines
tgcttaatcaggattaacattaaatattactgtaacagaatcgtctcaccccctggattttcagattattacaacaaacaggcgatttttttttgttgataacagtattaaaaatgaggcaatgcgaaaaatgatttgaataatgcaaaagtgaattctctctccatcccgcgcccaaaaaaaaaggggaaaaagttggaatggaatggaaaatttgaaaaaaaagcatttgataatagaaggaataaatagacagacggatggaattgcccaactttcaaacccaaaatgctcaatgacaacaaaatcccctacccattgttataacaaccatttgaaatgttggacattgtacaaggccccagacaataatacacacaatgaatgtgaatgggttttgaataaagacaaaacataatgatgggaagaggaccaataatggtgggcctttttcaaatgtttatattagagttgattaatttataatgaaacggggtttttgccaagaattttaaattatttaaattttagattaacaagagtgcaaaaataagggaataatggatttttgtaaaaaataaaaaaaaacgaaaagatgccccaaaaattttaataacaacaccaatggagattatgtttttaataacaattacaattaaatccccccc

SEQ ID NO: 36378 - DNA, 760 bp, Heterodera glycines
tattatgagttcgagaccggttgactgtttttccttcttcttggatttttatatgattaataagatttttgaaaccacctttacccattaatagagaccggatcttccgaatctgccgggccgggctgatattttcagaagcgaccggtttccgggcccggcctctcaaaacccggtcaacccggatttttccaaaaatcgtcgggccggttttgccgggcctggtaaaacccggtatcgggcccgacccggtccgttctctagtttgtaataataatttaatgattccgatccctcctctttatcccacccccctggctcgttttgggtatgtttttttaagtggcgaatcttttaaaaatgacaacaaacagcggctctcaaaatgaagctaacaactgttaagcccaggccaaggctagcctatgtctgttggcctttcttggcttattatggccaatggtcggtgagtcgtgcttttggcactttattcttccctttttgttcaccctttgcatgcgctgtcttctccgctgctcctttccctcctccgtctcctcctcctcaacttttgcgcctttggcactcattccattcgaaatttttcaaaacgaagatgaataaaataaaattttaatggatatttttgttaaagatttaattactaccttttcttcaaataatgtacataaataaatgagtcgcctatttgtcgcgtaggatgataatttattatttgggaaacaatgacacaaaaatt

SEQ ID NO: 36379 - DNA, 1344 bp, Heterodera glycines
aaattataaacttcacaaaaaaaattactaatataataattgatgaatgaattgttaaaatattttcgattaatttaggaaatgcttttcaacgctaatcattgccaattaaaaaataatagcgttggattgattaccaaaacgaggacaaaaatatgtaaatataggacaatgattaaatattacaaagaatttcatttcctcaggaccaacataaaaaacgcaacaacaaatttatgaaaaatgagaatatctttttaatatgccaatttttttttacaaaatttaatcaaagaataatatttcgtaataaaatataattccttctgatcactgccgacccggcagctgaaatcaatgccaatttgacgcgccaaatttagcggcacttttgtgcaggcggcgattggcggtaaaacggccacgggacagccagtgaatttttaatggaaagtcaaaaccgggaccttggtactcagttgtcccgttttttcagtaccaggtcccggtcccgcttcactctaatgagaaggtaaatacatttgagtactaattgcggtcaagaatctctcagtatcgagaactaattttttactctcggtagttgttgtaagaaaaaagttcggctccatttttgaaaccattctaccaagtacaaatataataccacacaaagttattcaatagagggtaagccgattggaaaacttaacttgcacccggcgccgagcccggcttcttctggacgggtaatacctggactcggtttttgcccaaacacacggacccatccaaccgaagatgaaatcaacctactgcaaaaatttattggtccatttatgaaaccattgacttcgtaatataaataaattaaataattaatagctataaaatgagtgtttctcatttttttaaattttggggtgccacaacgctgaacactttaattaattcgcgggtaaaaggaaatgaatactctgttaaatgagaattaataatttaaattaatgaaaaaatgtaattatagcatcttggtaaaaatgaaatgaattctctgaaatggatttttggtttcttagtaaattgtccattttaatttccccaacattttttaaagacgtgctgaatcgttaacaaaacaacttgtttttcgattacatgccctttaatgagatttttaattaacttaattagttatttgaaatttattggctaactttttttctttaatcaattctggcaaaatgccaagacaggcgaaaatagagtttttaaaatgtttgatttaattttcaagttttcagcattgaaagaccgaaaaaataaaattaaaatatgcttctt

SEQ ID NO: 36380 - DNA, 952 bp, Heterodera glycines
  misc_feature (883)..(884): n is a, c, g, or t
ggctaaaatctacttaaaaaattttcatttttcctataaaaatcagcggcgaagggacaatcaatcaataaacaattaattaattaattaatcaatcgacggacactttcatttgattcattgtcattaatcacagtttcacaataactaaatacttttatttaaaacacaaaccatttttattgacgtatttgaatttatcctaaattttgtggtttatttgtgcttttccattctattattgtccattaaaaagtgtatgtccgtaatgagttcgaatgccaatgaacagagcgatggtttgtcgttgtgtcctttttacattttaatttaattaaaaatttttaaattaaataattgtccaaatatcaaaaactatgaaaagcgtaattttgcagaaatattcgccaccatcacaatccatgaccaccaccaaaaacaacggaatgagcagcggcaaattgacattcggctgatgcgtgccgaagaagtgcaagcatgtgccgaaataatacgagatgcttatttgggtagcacagcacaaaccagggatggcatggaattccgacttccagtttctggcatttttggtgtcagaattccgatttccgagaaattttagatataggacttccaatttttgaaaaaaaaaaatcggaatcgaatttttttttttgacaattcaaaatgtttaatttaaaaatgtgaaaaattttcttaaaaaattggcctaaaatcgcaaaaagttagcaattttcttacaaatgtactaaaacaagttaattgatttgaaaaagatgatgaaaattattgaataattttttcaagcaaatatatataccaaaatatttttgaaatttcacctttcactttttaatttatnnggttctattttaaaaattgcctattaaagagctagaaatttctttatattttacaaaattccaacttt

SEQ ID NO: 36381 - DNA, 1680 bp, Heterodera glycines
  misc_feature (1631)..(1631): n is a, c, g, or t
gggaaagcagttaatgtcctcgacccaagcagcatagttttagcatgtggctctcctggtgaggagtttagctgtgccggcaattatgaaattttggtttatagagaagaatccgatttagaagaagcgcccagttcatacgcatttgttgcggttctgcatttttcttttgttgcggaaagatcaaacgcattgctgcggttctgctttttaacgcattgctgcgaatttcaccgatttcgtcccactgctaacgcattgctgcgataagtgaggacttggtaccgatttattaacgcattgttgcgaacgtcttggacttcgaaacgccgaattttatcaccgccgcttagagggatgaccgaacacaacttcgagcagattcgccggactaattcgtcaattatacacgaaggaaatgtgcaattcgccaacgaaatggatgaaaacgaaattcggcgtcgacttcttaaagtaatgatgagacaagatggaagtgcagatttggcgagacatggcaatcagaacattggccacggagaaaacgaaaggccactttttgatgaggcccaacggccagcaattccgcgacggacaccaccaaatccacactcattgatgcagagtggcaaccaaattcatcagcgacataacagtcaaaatattgccacaattaaccatcggccaaacggattcgaagacaacgagcgacccgttccaaatccagggcttatatttgacggcatgatggcacaggccattcgaagcatggatggtttttcatacacaatgacgctgaacacaattccgaatttggacggcagtagaggctccgattcggtgaacgcctttttcaagcaatttgatattgcgaatgaagaatggcctgaacagaagcgagttcgggcgctgcgttccaaatgttttggcaaagctgagagagctttcaattccgcggttgctgaaaatcgccatgactaccaactgatcagaacatcgatcattcggcaattggacgacacggacgccaaacaattgacggcgtttgaccaactgatcaaaggagtttggcttcggccgaatgaaggcattgatcagcttggcgaacgtgtttcgcgcttggtccgttgtgcatatccggggctcagcgaacagctctacgacgaatattcggccatgcatttcattagggcactccctaactcagaattggcaatgactttggagatgactcgtaaaccgggtgcaacattcgatgagttcatcgcacaagcagcacgagccgaggcagttcaaaatgccgcacgaaattcttggcgaaacagccaaaacaacggctgtttccaaaaccaacgaaggcatattgtttgctataattctggccgagtcggacacacttctcgaaattgctattcacagccaacacatcagacgcatcagttcagtaaaaactgcaatctccggtcgacaccaccaccactattgaatcaacaaaatgacgaaccgccgaaaaagggaaatttgttagttggcgccataaacttggaacaccgtcccgagattgagaaattcttcggaaaagcaacgaatgagtcggataagggtcgatttttggaagaaagcccggcggntggtaaaattttggcgaccaaagtttccggtgttggacgtaagttggat

SEQ ID NO: 36382 - DNA, 1164 bp, Heterodera glycines
aggtcccccccatttcgcccgcaaagggcccaaaatgtcggaccaaaagcttaaaaaacaacaacagcgaaaatcctaacaaggcgagtggtcagagcgttgtcaaagccaacgtcgattccccacccatttgcgattgtcttcaaaacgagtgtggcgcggcgtacaactgtgactgaaagacaacaagctattaacttgaggaaacgagcaccatcacggctgaggttgcggagaaaagacaagatttgaatgctgttcctgtccgcaggcggatcaatttggagacgcaacgcagtgagacattcaataggtcgcaggacacgctccaattgaagatcagaaagctgaaaatttttttgtgaacagtaaaacagccagaatcacctgagttgagatacgcataacttgatgaagaacacacgaaaacaaactgactttctaagaggacaactcaaatataagatttgattcaatgatatataacaaataatgttgagcgatctaacagttaaactgaacttatcaaagcaaccaaactgattacgggaaacatccccattattctattggcttaacgaggaactcagcacctaattgacagatgaaaagattccgtgatccattcctacatggataaagaaaatggatagtcagaaaaagaaaacagggtgaagaagcgaatgtgtataaagtcatcttcgaaacaaaacacagcgagcacggaacaccatgacgggcaaatgtgctttgacgatgaacatcggtgtgtcggcaatttggttctcttcaaacacgacactacggcgacggttcaacactacgcgaatgccaccaacagccgcttcgggacattgtatacgtcgaccactcaggcaatgtttccggacgggacatcctcaatcggttcaatgtaacagcacatcatcagaattgtgctaaaaaaacgtggattgaatgtaaatgaaaaccagaaatgaattgtcgtataccgttagatggtcttctcgtagaggtgtacttcttgccgaccacataattcggcccttggatgcgcgctttcatttcgcccgcgccggcaatgatgtgctcaccggactccctcgaaatgcattggaccatcgggtccgacttggcaaaacgtttcagtccttcgaccttaaa

SEQ ID NO: 36383 - DNA, 1003 bp, Heterodera glycines
gaaatcacacaaaatgtttaacccaaacatacaacaaaccttttttgacaaggtgaaataagcatttttaatttcttcttttgacgccgtcggtggaacgttcaaaatttggtaaaaacttttgctaaaacttattttacattaaaaattttcgggttttaatcaaaccgtttgcgagttgtaaatttgcgaaaaatacgcatttctatagaggaagcaccagcacaattagggtgtgaaaaagaaatggaataattaggaaaacgcagaattaacgcatgggaagaaaatggacgaaaatgcatcggaaaaagacgacgaatcaacattaaataagaaaaagggattacaggacacaaatcaaaatcagcaaataattttgtattcacaaaattagcatttgcatttgcaaaaggaaaaaaaaaagttgaaaaataaaataatacgccaaaatttaaaaaaaacgaattatttaaagaaaagtcaattgattttggagtttcccaaaattaaattcggcattcaaaaaaatttgatcatttttagacaatttctttgcaatttatgccaaaatgaattgaatcgaggcgatatatcgactaaaggaatgtggagccaaacacatctttaataaaaactaatttttttttgagattttttggagctaattcaaatcaaaaccccaacccctgcccccgcgactctgacccccgcccccgtgaaaagccaccaccccacggggctcgaaccctaatataacatactgtaaagagcattttctttttttttctttaatgaaagacaaaattaaaaataaatcaaaagcaaaaatggatgcttcctgatcagtgctaacaaacagccaaacagcaaagaatttgtgattaaagaggcatgggacacaacgaaagcagagagccgaatgagaaaagaagctattgaatcatgctggttgatcagaataacagcagatccgaaagtctcgagtcaaagcacatttttt

SEQ ID NO: 36384 - DNA, 850 bp, Heterodera glycines
ctcctagccctggctgggccttttttctgaaatccaagaaaactcctagccctggctggacctgttttttctgaaaatccaagaaaactcctagccctggctgggcctattttttctgaatatccaataaaactcctagccctggctggacctgttttttctgaaaatccaagaaaactcctagccctggctgggccttttttctgaaaatccaagaaaactcctagccctggctggacctatttttttctgaaaatccaagaaaactcctagccctggctggactgttttttctgaaaatccaataaaactcatagccttggctggactgttttttctgaatatccaataaaactcctagccctggctggactgttttttctgaaaatccaagaaagctcctagccctggctggactgtttttttctgaaaatccaagaaaactcctagccctggctggacctgttttttctaaaatccaagaaaactcctagccctggctggacttattttttttcctaaaatccaataaaactcctagccctggctggacctaatttttttcctaaaatccaataaaactcctacccatggctgaacctgttttttctaaaatccaagaaaactcctagccctggctggacttattttttttcctaaaatccaataaaactcctagccctggctggacctatttttttcctaaaatccaataaaactcctacccatggctggacctgttttttctgaatatccaagaaaactcctagccctggctggacctattttttcctaaaatccaataaaactcctagccctggctggacctatttttttttctgaaaatcca

SEQ ID NO: 36385 - DNA, 653 bp, Heterodera glycines
ttaaccgacagatgccttcaacagagggacggagaatctcgatcgacaaagtaagcagtgaatgaaatgatatgttcagagaaataggctcaaattgggagggattatgatcaataattggggaaagaaaacaattaattggccaattccgacaatttaacgtccgaggccccctcccccctaattaggtgaacatcaccgaactgtttccgttaggcattgagcgcatcgagaagagcaagcagcagttgctgaagagtttggcaggtgggccaacgaaaggagattttggagagaaaacttataaattattaagtgggcccaatcaaaaaggtgggtgaactgtgctcatccgtcaacccatccaaaacgacaacagattatggacacgtccagcgattttggcgtctgtgtcagagacagttttggacagcgaaccattggaatttgaaagttcatttgttaaggactgtttcatggccaagaatccgaatgagtattgcttcgacaagaaagagtcagttcgtctgagctgttgactccaaatcccaattttctgagtgcccccccccccccaattgtcagatgccaaccccttttggtcggagcaaaggcaaccaaatcgctgaggaaatgcaccaaccggatagact

SEQ ID NO: 36386 - DNA, 577 bp, Heterodera glycines
tggggtaggaatttcaaggacaaaaaaagggaaataatatggaattataattaaattaaattttgttttaaatttttagccgatcatttggcacataagcaaaatgagcagaaggaactttgggttaaagttgacgaattggaacagagacaaacagcggattcggaacagtggaacaccgccaaagaagggattctggtgaaaattgatgaggtcgacacgaatgggcaatttaattttaattagaaatatttaaatgatttcttagagatcgagccagaccggatccggtaccggattttccggaatccgttccggcgattttttggaaatagggattgactggattatgagagaccggatccggaacccggtcgtttttgaaaataccagtccggtctggtccgacagatttggtaatctcagtctctcatatttctattgatgattccaattttgttcagcggttgcttcaagcggagttaaagcatcagaaactgctgaccgaacacaacgcactgatggtgaaagtggccgagatggaaaaggaaagaaatgtaaaaggagaaaaaaatga

SEQ ID NO: 36387 - DNA, 1083 bp, Heterodera glycines
ttttagaatgtgtctgttaaatgcaaacctgttgtgaaaaattgttataactccattcagagaagagatagaaaaaaaataaaaataggtttagagagcccgtgaccagctgcatcggatgcaagtgccgccgttgctgtacgcctaacagttggtgagcaatgacggaaaattgcttaaaaaagaaaccaaacaaactcatcaattgtttgctcccgttgacaaaccgaagggtacattggggcaatggatgttgggctaccgtatcagttattaaaattgttgtttttcaaaaaggatactaaaactgggataacccattcagacactagtcaaaaaaaataataataggcttggactaccatactaattagaatttttagaatgtgtctgttaaatgcaaaactgttgtgaaaaattgttataactccattcagagaagagatagaaaaaaaaaaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttggcaaaccgaagggtacattggggcaatggatgttgggctaccgtatcagttattaaaatttttgtttttcaaaaaggatactaaaactgggataaccccattcagagataagtcaaaaaaaataataataggcttggactaccatactaattataaataataaaacgaagaaaatgcatttgatgcaagttttgtcaaattgttacaatcccattcttacacgatcttgtcagacaataacaatgtattctgaacacatgaggtgcatgggcgcttgtgttgctacttcagaaatccttcatagcctaatcgcaaattcaacaaggcataagcaatgtaaaaagttcaatgtttttaaaaattgtctcaccacatactgtatatgattattataaagttttaataagaggttttcattaaattgaaaaatgaaaatatgccacggggggagaatgttcatttgccgttcactatcacaaaatgaaa

SEQ ID NO: 36388 - DNA, 549 bp, Heterodera glycines
ttggcaaaatgccatttcattatgcaaaacacttatttttgccaggctgataatccaatattcccttctcaatttgtcctttggccagtgaattggccaattttgtgccggaagggataaatgtgcgcattttatgccttccgggcacaattaagtcggccaacgcgcgaatccattggccaatttgggttcatttggccatttggccccttttccccctaattttattttctcacattgtatttaccaaaatttccattgtttttctgagattgcaacaaaatttacagttttaaagaaggccaaaaggggggggggatgccgaaaaagtgcaaaaaaaatacagcgaaaaaccaatcgatgggaaaaacgattagggaaaagttgtcgaaaagggaggacgaacggacggactcactccatcaaaataataaatctctgctgctcattcaatcacaatcataaagacggtggcggtgtccccccggcgaagtggcgaaacccccgccaaacctccccctaaatacccccccccccccaattcctcca

SEQ ID NO: 36389 - DNA, 954 bp, Heterodera glycines
ggtcaaaatggcggcggttggttcgccgctgcaactcgccaggagctgaccgactccatcaccatcccgtccgcctgcacgaagttcttcgtggtctcgtcgcacgtcggcaaagagagggtggccatcatcccccaccttggctacgagaagcgtgggaagcagagtgccatcgcccgcaagtacctcaagtggcgtgccgaggaagagatgcgcgacaacggatggactcttcgccatgtggaaagccctggcggcgagtacaaacatggcaacttcctgctggacggcatgctggagcggatcggcgaggacaaaaacttggcgattgaagtgaacgggtaaagaaacacttgccaaacttatgctaatttttctcccttcaggtgttattggcacgcgtgcccgcactgcttccccgaggatgacgcaattgttggcggtggagagacggccggtgccattcgagcgagggatgagaagaggattcggcaaattgcgcgggatttcgaggtggagatcgtgtgggagtgccagctcggccgaatgctggaagtggacccgccaatgaaggcattcttcgacaacacgcccgactccggcccgattgacttccatgatgccttcttcggaggtaatttttcccatttttagttaaaatatgcaaattttgtttacaggtcggactggcccagagtggctcggagcatcgatcatcccggacaaagaaggacaggctgggcgaaccatcaaagtcaaggacttcaacagtctgtacccgtccaggtagaaaataaattaaataatcacaaataatcaataattaaggaacatgttcaccaactaccccgtcggtcatccaaaggtcatccaaatggacaagggacgtcactggactgcgaaggacacattgtggacgacgacggcgtgaaatggaggcatcatcaagtgctt

SEQ ID NO: 36390 - DNA, 919 bp, Heterodera glycines
ttcatgaggtcacagatttggtagtggtgggtgagcagtgccgtttcctgcccatccggcacaatgcgcagcggcggaggcgaaccgatgggcaacaggtcgacgggtgttgaacctatcgccaaaaaaggcttatttaaaaaaaaattttaaaattcattgggtggccgaatttaagtcagttatttcttggaaaaaaaattgaaaatttttgatttaattatttatgtaaagcccaaaccgattaataaacaaaatcatggattcgttcgttcagcagaagatgcaccactactttccaccccaaaccaaccctcgaaaattttattttaaaatttttaaacagaaatttttaaaaaaatatgtaagaaaatttttttattggaaaattttaagaaaaaaaaaattgaaaaaattgtcaacgatttgtttgattttttttgaaaaaacttagctaaaaattctttcttcaaacttcttataaatttttttagactttaaaaagtttttcgtggaagagtggataaaagggtaatttgaaatttataaaaataaaattaaaattattatttattaaattttaaatttttgtacggcttgtcgacggttgctgctgctgctgctgctccatgatgatttcgcattggcattttggctcttcatttgggctcaaaacagtgatgctgttgcaggtggttgtggtggtggtgttgagcacatccatcggccgaacacagcacaattcattcggcggaacaaacgctgagaaattaaattaatttaaaaaaatgtttttaaaaaatccaaaattaaaaaaatatataaaaattgaaataaaaataataataataattccattttgtaattcaagaaaaatttaatggttgaaaatggcaaaaaaatgaattaaattataaaa

SEQ ID NO: 36391 - DNA, 975 bp, Heterodera glycines
tagattagactacaaaaaattgaaaatttcgaaatcatgtttcccactcccttctcccaggggtcatgtttcccactcccttctcccaggggtcatgtttcccactcccttctcccaggggtattattttgtaaagtctttttttccccaataaacttttcataccccattttcgcaccgtgaatgttatttttattgaattctgaaccggtttgagtagattagactacaaaaaatttaaaatttcgaaatcatgtttcccactcccttctcccaggggtattattttgtaaagtcttttttcccccaataaacttttcataccccatttttcgcaccgtgaatgttatttttattgaattctgaaccggtttgagtagcttagagtacaaaaaattgaaaattttgaaatcatgtttcccactcccttctcccaggggtattattttgtaaaaagtcttttttcccccaataaacttttcataccccatttttcgcaccgtgaatgttatttttattgaattctgaaccggtttgagtagcttagactacaaaaaattgaaaatttcgaaatcatgtttcccactcccttctcccaggggtattattttgtaaaaagtcttttttcccccaataaacttttcataccccatttttcgcaccatgaatgttatttttattgaattctgaaccggtttgagtagattagactacaaaaaattgaaaatttcgaaatcatgtttcccactcccttctcccaggggtcatgtttcccactcccttctcccaggggtaagtctttttttccccaataaacttttcataccccatttttcgcaccgtgaatgttatttttattgaattctgaaccggtttgagtagattagactacaaaaaattgaagatttcgaaatcatgtttcccactcccttctcccagggaattattttgtaaagacttttttccccaataaac

SEQ ID NO: 36392 - DNA, 802 bp, Heterodera glycines
catgctcccttttgcgaaattttgcttttaaattgttatttcccgtttagtatttttcggtactgaaatgtttttttcactgggactcagttgtccaggtgctcagatggcgtcggtttgacttaattccttgatttttagactcagctcgtcaagagctttcgaatgatactaaatttgtccgaatttgacggttttaaatggtcaggagcccccattttcactcaatttttcgagtattaaaccggttcaaaaaccggttttttgccatttccgcacctcaggagtatttttcctgagcattacaggccacgagagaacgaatggtatcaattttattcattttttttgtgggtggtagactatagtacagcctcaaaaagttttgattctatgacttcaatgaatgatttgaaatacaattggtaaaatcaaaattagcgcaataatgcgttatttcacttgtattccattagatttttatgtttgattttctgaattttgaaagtatttttttcctaattttccaactgatgacctcgaatttttctgaacgatgtatttaaactagtttgatatttcttttcttatttgttattaatgttatggtgttaaaatgtgtcaaaatgtttattaaattactacattttttattattttttaaactcgatttaactcactgataacttaagagttcatcttaaatcattattgatagtaattaaagaataaaacataactttttcttactaataaaatttattggaaaaattcagtaagatatttaaattcaattaaaatt

SEQ ID NO: 36393 - DNA, 1171 bp, Heterodera glycines
atttgtttgctcttttatacgatttatcaaatttttataaatttttattcgttttatataataaaaacattttgatattataattctattatctgtatgattaattatatttaaattaggtcatctttttcgcaattattagagaatagtaattcctttaactgaattttaaaatataattattattttaaatatatgagctttcaattgttaaaaaatattgctttatgggggtattaatttactttgaatctcggcaatacttttacaactaaggcgcttaatttaattttcttttttatatcaataaattttcactgaatttctaatttttcttctctttcgcctcctaaattatttattaccataccattaactaaatttgtattttttttgtcaatgattacaactgtaaatgatgagaatccaaattttttatatattaatataaaatttattttgatttaattttagcttatcacttacatttacgaaaatttagtttagcaataatacacacggataatgcaaagaatttattaacaaaacaaaaaattataaggaaaaagaatagaatagcctttcacccttcctgcaaaagagagattgtaattaattaattaattattttatcttatataataatacaaatttaatattcagaaaatttttcagttcattattaatttaaaatgtattcataaactaaaataaattaagcaccaaaacagcaaaataaaaaaagagaaaataaaattgaaatcaaaaatgaaaaacaattaataattaaaattttagaaaatatttaaataggtaaatcaaaactttcgctcattattcgtattataaacatttattttcgaagataatttattaagttggagaggataaaataaaatcataacctatataataaaaaagtgtatttatttttttaaaaatcatcgcaattgaattgggagttttttctggaaatatttattcagtcaattagaagacaaaaaaattgaaaataattatgtctatattttaaaaattagaaaactagtaacattaaacaaatctaatattttttatacatgacgaggattttcaaaatattaaaatcgttcgaaaataataaaaatgaaaaaagaaaatattatgaaaatatcaaaaaataataatacta

SEQ ID NO: 36394 - DNA, 931 bp, Heterodera glycines
aatatgatcccacttaaaaagagtaattatatgaaatattcttttgaatttttattagagaattttattgatgctcaagtaaatttttgttattttgacgcacataggtaggaaaatgaaacgacttaaaaattatttccagtaaattacaaatagcacaatttaaaataaacatataaatttcaacaaaactgttaactgatgtcgtgtaaattcatatttcattttctatgcagaatatataaaaaataaaatatctacaaaaaataattaagcaattccgaatttgaaaagggacttgaaagtataatataaaaaaaaatcctcagaaatgcatttatatatttcctattgttggaatgcagtcaaataattcggcataaatatgatcccacttaaaaagagtaattatatgaaatattcttttgaatttttattagagaattttattgatgctcaagtaaatttttgttattttgacgcacataggtaggaaaatgaaacgacttaaaaattattttcagtaaattacaaatagcacaatttaaaataaacatataaatttcaacaaaactgttaactgcccccgtgtaaattcatatttcattttctatgcagaatatataaaaaataaaatatctacaaaaaataattaagcaattccgaatttgaaaagggacttgaaagtataatatcaaattgtggcacatgcgcaacaaatggctattcagcaacaggcaagcgaatgccaaaaccctggatagactttgccaacttcgttcttttcagcaattggcagcgtttgcccatgttgcggctgttcaccatcaccagcaacagcagtcggctgcggcctcgtcttcggaaagggttaaccaacagctgcagcatgaatggacggcgtaattttttggaaaatttgccattttca

SEQ ID NO: 36395 - DNA, 911 bp, Heterodera glycines
  misc_feature (878)..(878): n is a, c, g, or t
atcggtttttctgaaatacccagataagtgtctattcttctaaaaaaaatcatgaaaaataggtcaaaagcaaaaagaaaagtacctaattgtgattgttggttgacaatggaatagtaatttatttaatcaaaatgtgaaatagttggcattaaagaactcaaaaaaaaagaaatatttaatggatgaattaaaattggcatgattttcatattttaatgtgtagctaaatatagcatatttaaaaatggaaatcaaataatgttacttcacattttgttgctgaccttcgtcctatgtttcactttgatttatgattattgagaagggcacaaataatttacggcaaaatgatgaccccaaaaaagcttaaaacccaattgggtgatgcattattttttgaaaatttttagtcggcatcttagagggtagtttttcttttttatataaatattaatgattttctgaaaactcaaaaatcctcatgaaaataccgaggggatgccttatttttgaaaaattttaaattctcttcccagggtaattttttcttttttaatatatgtattaaagaaatatctcgaaattccgagaaaatgtcgataaattttttacagatgccccgtccttttcacttttgccaattttgttgcaatttttttgtgcttcagcatttataaaaaaagattggaaaagagcaaattcaattcaaaaaatatttctgttctttttcactttgttgggtcatcgttttaattttaaaaaataaattgtcaaacatttatcaagttatgctccgatacttcttgttaagtacattccaagaaataataatgtcataattttgtgttatggggtttcataaaagttctttttgngtcatcattttgccctgaattattttatcccct

SEQ ID NO: 36396 - DNA, 1282 bp, Heterodera glycines
  misc_feature (31)..(31): n is a, c, g, or t
gtccgctgccgccgcgtcctatttgaaccancagctcggtgagtgggtgcggtgatttgtgccatgaaattagtgcgtttcggatgatttttcatatcctacgtacgaataattgggaaaatcgttacccatttatcaaattggtggccttatccgttaccgtatcacctttttgcatggccgaacgcaactttgattacagtataccaataggtcgaatgctctttttaaacgacaaaaaagtcaacggaagcactgggtgaatggaagggaaaattctcgggaccggcaaaatttaaaagcatgtttcgcgggattaatcgtgtaggatctcgtccagcataagaacttgttgagataactcattaattgcatgggactcagagctccgttgcttaattaatatttttaaaattaactccggctaatgtctctgatcttttcgtttcattatttaaatcattcttcaccaattaaatggtcattaatttgtctgttaattaattaatcaatcggatgtcccttcaaatttccacttttcgctgcttcctaattcgatttccttcatccgtccctcctttcctttcttcctctcgttgtcagtgtttctgttccatctcttttttggtgatcactccgtctttgtccgtgtccagcatttgttccgccaccgtgtaaatgaactgtttccactcggcaaagtccaatttgccgttttttggcgctttgtccgccgcttcggcaaatttcgccgcttcagccggcaaagtcgcgctcatctgacaaatgccgtctattttgattctgctttttttctcttttcacttgttccactgatatttctccgccatttgcgtcgaatattggcactttaaagcgctgtgcaaacggcacactttccaaaaagtccctcagctccgtcagactcacttcgccatctccgtttttgtcagccaattccaactgattgaagcattgaaaattatttcatttcatttaatttaaccaattaaatttaatacgcaattccaaccaattaaatatttatttgaattttacgttaaagggaagaatgggaatgtttgttgcttcttgccgagcttcttcttccttttctccaatggcaaagccaaacaaaaataatgcgacaaaaagcacagaaaggagagacattttggcaaaagcgaataggatggatgttaagagaaaatgttattttggttattgactcatttatgattcatggtataccaaattttgtccaagtaaaattttcttttgt

SEQ ID NO: 36397 - DNA, 758 bp, Heterodera glycines
gggaatcctcggtgggcaaaaaacgattttataaaataatttggaaaatttattcatataaaaagaaaaataaaaaatgaaagggccggaaaaaattgaatttaaaaggaaaagacggcacgacaatggtgggcattgttagttggcattggatctataatattatatgaaaaggctcccaaatgaaatttgtcattaagtgggaaagtgagggggggggggggaaatgccaagaaaatgtcactaataaattaaattggcggagagaaacggaaagagaagaaatatccatttggcttttgacaatttttgctcttttttgactttctcttttttacattaattctctttttttggcttttcgttaatgcttaatggaaaatgcactcgcattttgggggaggcgaagaattggcaaatgcccaatttaaagcaattcaattggtgacgaattggctaatttattttaaatgctaaccttttgggtttaattcaatttcgaatgggttggaaacaattgccaaaatccgaggcgaaagtgccagaagtggtaattcgatccacccttaaaaatcaatgaaaatcgcttatgccactggaaaaggccctaaaaatgggagcagattcagcaaaaggcgccaatatgccaattgcctcccccggggcttcgtccaatgtgccgacacccccgcgggcgctttgtcggaatgcccccgggggcgtcgcattctctccttctcttttcatgcccttataaa

SEQ ID NO: 36398 - DNA, 803 bp, Heterodera glycines
tgaaaacataaatcttgttatgtttaagacacaaagtcaattaaataggaaaataaaacaaattatggcaaaaaaattcatttatataaaacaaaaaaatgaatgacaaacaattccaaaatttccgcacctaaatttccgttccaacaacaattcgcttcatacacatctgaactgctcgtgcaaccgttcgccatgcattatccgacgcatgtcaaacttccgcaaattgaccgtcgaataggcaaagtcgaagatgcgttccatgaacattcggccagcagcgattgccatttggggcccatagccgccgaagccgcacaattggaagaacgactcgtccatcaaatgctcgccaatcactggcaaattgtcgaaagtgttgaagtcctcgtaggagttccaggcattgatcaccttggacagaaaggaaaacttttttcattgaattttttgattttaatttaggctttgagttcattactcgggaaaagatttgttcatcaactgcatttttttctgtgacctttgacgaaaaaaacctacaaattgtaagttttaagaaaattgcatccggcataattcttgccaccactccaaaatttgatcgctatttctgcgttacatccatgacacttctgcaactttagcgttctccttgcttttttctagggtatggcaccgacccttcgaggtgagaaaagtcggagtttttcgggctcagctaggccggagtcgaagtccgggtcggggtggaccaaatcggtcagagttggggttcggagtttttcatttttgccttt

SEQ ID NO: 36399 - DNA, 923 bp, Heterodera glycines
  misc_feature (841)..(841): n is a, c, g, or t
cgctgcaaatcctcaattttttatttaattttcatttatgaaagaatatataacatatttttattaaaataaaataaaagagaattacattgaatggtttaatcacatgaatatgtataaaatagcgaatttatcgatttcaatttaagcatattgcaatttttattgctttgtttattatataattttaatttaaaaaaattctaaaaaatctgcataatactgcttgtcaccaattcattcatttatgccttattaataataatcatcataatttatgaatttcctgtaaagttaatttctttgtttttcatattactggttgtcaccaaattgtttaccttttaggcattatttattaatacaactcatattgggctttatataaagccaaaactccgactaagaaataaataaattaggaaaaattaaaagcaaaagcaaaaattaaaattaataaaatttaatttttattaaattttgatttaatattaaattttggacattttaaattcaaaatttgtcggcacattttttgactttttaaaaagaactattctaatgatttggattttaaaaaaaactttgaaattgacgaaaaattataatagtttgaacttttggccaggaccaagttaaaaataaattaatttttatctaattaatttaagagacaattttaaacccatttttatcatgcttttcaattagaactaattaaatttctcataataaaattatttaaaataatttttacaagcattttccccattcttgcatgttttcagtcaaaattaattaaaattttcattttagacacattttttttctcatgctcttncagctatttttgccattttccattttgtgcggattgatggaattaactcaattacaattgtcacagcaaatctatcccatcg

SEQ ID NO: 36400 - DNA, 1038 bp, Heterodera glycines
agggctgtgcctatcgccattttatttcacagaggacccaccccgggagaggttatcccagaaaaatggctatctcttccctttgataaattttatacacatacaaatgctctcgagcatgatagggagggcggtgcgcaatagaccttttatttttgagggaatttttaaatttatactctatcccagaaaaatgtctatctcttttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggatatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaaattttatacacatacaaatgctctcgagcatgatagggagggcggtgcgcaatagaccttt

SEQ ID NO: 36401 - DNA, 764 bp, Heterodera glycines
tagagaaaaatcaggagaattttatggaatttatttggaatttctatctaaaaaaggaaaaaagttattccagaatttctggaaaaattcgaattttcagaaaaaaattcataactcggttttgaaaagatattctggaaagataaaatactacaaaaatccgcagttttttgctctattatataaattttatttggcatttttatcatttttttaagaatttttataaaaataaaagtgattttgagattccagaccaaaggggggagcacatgatttttgagttgagaaattttttcaccaaaaatcttccaaaaacatgtctttaggggttatttgggccgatgatcacgaatacatgatcacattttacctttgacatcgttaagacctcagaatccctgtgtgattggggattctggacatgttctgagggggggggggggagggggcaggttcgaatccggacggtgtaacattatttttctgtgcatttttacgttattttcaatgattttaattaatttaaaatattttgttgagttaataaataaaaaattatatttaatttaatttttttttgataaataaattttataagtttaaattaattttttttttaattaatagaatttcatgtattttttaattaaatttgttaaaaaatattttgattttaatttaatgattctgaggtatcattttgaggattgtcacatttaattgtaattatatgaatacatattaaatgtcccgccatataa

SEQ ID NO: 36402 - DNA, 795 bp, Heterodera glycines
ttgttttcttctttctccaatgtcagcaattcgttggtccgttcgttcgtcaattcgaatgggtcaatttccgttggttcaaaaaattcaattcgaatgatgaagcaggcaaaagaagaggtggcatcgagaaatttctaaaaaaatggaaaacggaatcaaatgcaatttttccaaaaaatttttgaaaatattgccaccatacctctttgaaacttttgatcattcttttggtttctgaggtatgctcataatcaagacaactcaattgctttggctttccattttttgtcggagtccatttggataacgcttggccagcctttgcttttggcctatcatcagcaattgaatcgggtaacaaatcttcggaatcgattgaacccaactgattgcaatcggtgaaaattgtcggtgaaatgtgacgacgcaaatcgtccaaatgatggccaccggaaacagtcaaatggcgaatgtttggcgcaaaaatgggccaaatttcatggacacaaaaatcccgaattggctggacaatgccgttgttgtcacgatgcaaatcatccaaaaccaaatataaatccatattggtgcctttctcaaaaatttgccggttggaacgaagaaattcgatgacagaatggtcaatgtacctgaaagggaatcatttagctatatcatttaataattctttgaattactcaattcgaaggttgttaaagcggattttgatgggcaacggattgctcttcgtaactacagatacaagttttgttccattcttggcaattctgattt

SEQ ID NO: 36403 - DNA, 93 bp, Heterodera glycines
aaaaaatttttttttttttttttttttttaaaaaaagaaaaaaaaaaaaaaacgggggggggggggggggttttttttttttttttttttttg

SEQ ID NO: 36404 - DNA, 970 bp, Heterodera glycines
  misc_feature (905)..(905): n is a, c, g, or t
  misc_feature (947)..(947): n is a, c, g, or t
ttattgatattagtgaaattgaaatgaaaaatattatttttgactgcgcggcgcaaatgtccatttttactaggcggcgcaaatgtcgcggcgcaactggctgaggcgcaaatggcgcggcgcaagtgtcgactttgctgagcggcgcaaatgtccatttttgctgtgcggcgcaaatggcgcggcgcaaatgtcgcatcaccaaagggaaatgtgtgaagggttcgtcttcgctcatgggtaataatttgaatatgttacagatgtttaacaataaaaaataatcactatgccatgagagcgattattgaaagatttttattaatttccttaatatatgacgtaattcgtcaacctgcatgtgtatattgagaatttatagaaattttttctgaaaaacgaaaatttttttttgaaaatatatccctaaaaattgaatttttttttcaaaaaaacagatataaaaaattaatatttaaagtactaaatgtgattctaagcctattttggtcatttttgtggcaaaagaagcgaatgcaagaaattagagttgcacgggagcggaaattttgataaaatacgggaccgggactttagggttaaaaaccgggatttttgcctggtacaagcggaagaaacccgtgactagtcatggtcccggccaaaaacgagactaggtactcgtctgtacgttttttcagtaccagtccctgtcatgaaaattatttatttaaattttatatgcgaattaaactaaaaacatcagaatgctgtttgagatagaagaaatataatttattagatagataaaaaattatacttcatttgtttttaatataaaaataacataaagtcaattcacgaaaaatacgaaaaaaccattgctcaaatgcagaatttgatanataaaaaagaataatttgtctaataataagataataatatanaatttaataattatgtttaattc

SEQ ID NO: 36405 - DNA, 1005 bp, Heterodera glycines
acatttcaatcactgggactcaatccaccaacattccaatcactggcactcaattctcctacatttcaatcactgggactcaatccaccaacattccattcaacgggactcaacccaccagcattccaatcactggcactcaacccaccaacattccaatcactgggactcaatccaccaacattccattcaacgggactcaatccaccagcatttcaatcactgtgactcaatccaccaacattccaatcattgggactcaatccaccaacattccattcaacgggactcaacccaccaacatttcactggactcaatccaccaacattccaatcaacgggactcaacccaccaacattccaatcactgggactcaacccaccaacttcaacgggactcaatccaccagcatttcaatcactgggactcaatccaccaacattccaatcattgggactcaatccaccaacattccattcaacgggactcaacccaccaacatttcactgggactcaatccaccaacattccaatcactgggactcaatccaccaacattccaatcaacgggactcaacccaccaacattccaatcattgggactcaatccaccagcattccaatcactggcactcaattctcctacatttcaatcactgggactcaacccaccaacatttcactgggactcaatccaccaacattccaatcactgggactcaaccctccagcattccaatcactgggactcaatccaccaacattccaatcaacaggactcaatccaccagtatttcaatcactgggactcaatccaccaacagtccaatcaacgggactcaatccaccagcatttcaatcactgggactcaattctactgcatttcaatcactgggactcaacccaccaacattccaatcaacgggactcaacccaccagcattcaatcactgggactcaaccaacgcagcatttcaatctctgggactcaatccaccaacat

SEQ ID NO: 36406 - DNA, 1082 bp, Heterodera glycines
attaggtctttgttgcatttaggtgcttgattaaaataaatatcatggtaaatatatgactttgacctcattttatgattttttgagaaacaaattaacgcttcatttttgaaatgttttttgtgtatgtggttttaagaaataatcaaactttgcatttctttttccacgtataaattgttcttaaggtacaaccaaattttcgcgcaattttttcttcaatttctattttcactttcattttgaatttttcgggaaaattgctctttcactttgtgaaagtgctcaattattctcaccttttccaagaaaattttttggtggaactaaaaatggtaaaatttaaatttaatttgtctaaaaatagaaatttaatttgtctaaaaatggaaaatttaatttgtctcccctcctaaaacgtttatttcacttacaaaattccctcttctattcgaaaaccatggcacgtgatgtgcccaattgcttggcaatggcacattctattttgattttactttctccaccaaatccttttttgtctttgtactcttgaatcatttcgtcatactttttaattatttccattttctctccgtcgtcccattctttgctttgcttttgtcttttttccgctgttttctgggttttttgtatgaggttatttaaaaatccatcaaaataaaaatttttgcctataattttgttcaaaatcaaccaaagttttaaatattactatcttagatagcactaaggttttctattagcttacaaattgacaaaaaaattgaaaatttggttatccataaacagtgctatgacaaagtattaaaagtgcaaagaagctacattgtttaatggttaatttatttaaattccaaaaaacagcaaataactttttccattttgcgttaattttatttataaaaaaatgaaaaactacgctttcgagacccgcttttgtagccaaaattataaatgcttcttcttcatagcctgctgaatgccagagtcatcataacaaacaatggtacttttccgttttggggctagagtataacatcattttttaaattaacagcggt

SEQ ID NO: 36407 - DNA, 848 bp, Heterodera glycines
  misc_feature (6)..(6): n is a, c, g, or t
tatatnaggaaatgaaatatttaaatgccaatttatttctttttgtgcctattccagcaacaactgatggatgccgccaattcaactgtccgtgcgctgcacacactttgccaagtaattttcagagaattaatttggccatttaaaaacgcaaaaaaaaatctttttttccccactgattttgaataatttttttgttcgcttattgcttcgctattcaaatttaagttgctccaaaagaaaaatttaagagaaaaatttgctttatatttttaaggccgttaaaaatttggatttttaatgatttttaagggtcagtcaaaattttcgagatttcccggccaatttttcttcaaaagtctcatgcaaaaaaaaaaaaactaattaaggcacgcaaaaagtacaacgaatgcgtgcaaaagggctgtggtgcggcggcggcggtggcggagacggatttgcaccaattcattttctccattttcaacgccatcaaagcggacatcaaacggggccgtctggcgctgacattgtccgttttttttgggattaacctctaaaaattggggaaaaaaacaattaaatttatcatcgctaaaataaaaattttacaaaaattctgtaggtagtctaaatgtaagcaaaacggaccaggccgttttcgcgccagcccaagtttttgtggactaaaactttttttgtttccaaccaaatcaaacaatcttggcagcattcaaaagcccttcacatgctctattagcagtacaaaaagcaaagattttcaggcctgtaaaaaagttatttaagaaaaaatttcgactttttagcataattttcatgttataact

SEQ ID NO: 36408 - DNA, 946 bp, Heterodera glycines
ggggtactcaaacaattatgggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctcgccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggtttttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaaattttttagagcaagctagctcggcgctcatttcagtgtaagttagtcctttaccggggagtatccctgcaaagtttggtatgcttctgctcaatagcaaaaatatgagtgatcaaacttcactaaaagttaagcctaaatttt

SEQ ID NO: 36409 - DNA, 964 bp, Heterodera glycines
ttgttattaataaaaacaaaaaataatttttttaatttaaaaaaaaaataaatttaaataaattaaaacgaatcttcaaattaattaaaaacagtgaaaataacccaaaaatgcatagaaaaataatgtacaccgtccgggtccgaacctcatcaaaaaaaaaataatttaaatataattttttatttattaactcaacaaaatattttaaattaattaaaaaatgtaaaagtaagcaaaaaatgcatagtaaattaatgtacaccgccgggattcgaacctgccgccccccccccagaagatgactcagaatccccaatcacacagggattctgaggtcttaacgatgtcaaaagtaaaatctgatcacgtattcgtgatcagcggcccaaataacccctaaagacatgtttttgaaagatttttggtgaaaaaatttttccattcaaaaatcatgtgcacccccctttggtcccgaatcccaaaatcacttttatttttatatctttttttaaaaatgagataaaaaggtcaaataaaatttataaaatagagaaaaaaaatgcggatttttgtagtattttacttttcccaaatagcttttcagaaggtagttacgattttttttctgaaaaatcgaaaatttccagaaattctggaataacttttttcatattgatgctagaaatttcaaataaatcccataaaattctccttatttttctctatttttaaagctttattatagttaaatcgatgaaaccatcaccgagttatgaattttccaatattcacccaaattcccgatggccaaaaaattgccaaaaaataaagaattttttaaaaattccaaaaattctgaaacttaaaatagacatcatattcgtactcagcaccttattttaccccagaaaaatatttttcacccccatttttgctcacaaaaaaaaatttgaaaatttct

SEQ ID NO: 36410 - DNA, 1021 bp, Heterodera glycines
ttattaaattttaaaaattttttaattgctttttaaatatgtcaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacagacacttgaaaaaatcgatttttttgttttcggggcagtccccccgaaccgacgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatcctccgggatagcttcctatagcctgtactttaatctgcgttggatttttgctcccataatgtatgagaccccaacagacactgaaaaaatcgatttttttgttttc

SEQ ID NO: 36411 - DNA, 897 bp, Heterodera glycines
tttgttcgactgcggggtgggattcgaaaattcctttaaatgaatgtcaaatttgtcatcagcgacccctgaaaacctagtaattttttagctttttcgcgattttttcgtccccttttaaggtgtttttgatttcaaattttggaggcttgtaaaacaggacagtttatgcaaatggaaacaaaagaaaatgcataaatcaaaaaccaatagaaaaggaggaaaaatttggcaaaaattccaacgaggtccaaaaattttttgggaaatcggaattccgtgccatccctgcttggtatcatcatccgtccatcattcgatggcactaaaacatgaacacaatggacccttcgccaatgccacatttgtccatggttttttcggcgtcagcatcatcataccattgctcaacatcctccacacgcatttcttgtccacatttttcggcacatttaaattttttgacgagttgaactatgctgaatggcatttttgttgggtaagccttggtgtacgcctccctgattttgtgtttcaatgttgccaaaatgtccgttcttttgaccataatgtactttttgccgaattttttgtccggcaaatactccacaaccacttcatactcggacatggacggtaaaaaagaaaaaaaagcggcaataaatcttttttatggataattatgggaaaaaattggcgttctgtcacatttactttttatctttatttctctcacttttacgtactatctcttcattcttaataatgtaaagaacaacatttacttctctccatataactttttttctatgcatacaagttgcaccaaattttgcatatcgatagagaaaaaaattctgcatcaattaataggtcaagttaatattaaaatgggtc

SEQ ID NO: 36412 - DNA, 889 bp, Heterodera glycines
ttcccccccccccttttttgctttcagccgtacaccgcctcagcgacgccttcacaatttgctcttcttcaccgccgtcgccccagccgatccaatcgtctctccgtttacagcacgacggcggccaaacacccccacccccttccttggccaatgcactgttcgtttgcccttcgactcgccactgtttcccccgttcgcttgtcttccccctgccactgttccctcgctcgctttccctcgttcgctctctgcttcatcgccgcgtcgtcgccctttgtcccgatgatgaccggccatcagataaaacgccattctcaccatttcaatttgttgcgatccatccgcccacatttgtctcttcttcgttttccccccgtttttgctttttcattctattaatttttgctgaacatttaacaacaataaatttgtcttacaaatttcttgtggggagggaaaaactttccttgcctaaggcacgaaaacaacaccgagtttctgcccccttaatcaattcgaatcccggggatcggggaatagcctattgatttcggcacttcaaaattgcgggactccccctcccgctgatcggaacaattttctgatcagtcccaaaggactcaaagggacaaattcgatcaatccaattttggactgatcagttgtaaatttcgcctcatttcaatttgttgtctgattggctttttagccaggctccgattgccccatcggaaaacccgttagcttttcagcgaccggtccatctcatttgtttttcgtggttacattgttggcatttctgaacattcccttttccctttttggaatctgatcaccacgcctgatccacctttggaccctctgctcttcacgccaaattgccttt

SEQ ID NO: 36413 - DNA, 935 bp, Heterodera glycines
  misc_feature (19)..(19): n is a, c, g, or t
  misc_feature (83)..(83): n is a, c, g, or t
  misc_feature (908)..(909): n is a, c, g, or t
tttctccaatgtcagcttntcgttggtccgttcgttcaccaattcaaacgactcaattggcgatgattcagaaaattcaaatntaattcgaattatgtagctggccgaagaagtggtggcatggagaaaggcctaaacaatgggaaacgaaaagcaaatggcaattaacccaaacacatttcacaaaaatgtggacacacctctttgaaatcgttcagcaatttagtggttccacactcagaaaaatgccaaaaagacaattgctttggctgtccatcttttgtcggagtgtgcaaccatttggacagcgcttggccatcagttgcatttggcccatcatcaccaatcgccgtgggccccaaagtatcggaattgattgaattcaattggttgaggtcggagagaattgtcggcgaaatgtggcgacgcaaattttcaagatcaccattaaacttcaaatggcgaatgtttggtgcaaaaatgggccaaatttcagcggcaaaagcattccaaattggctgtgtatccttgtctttagcgtaaagacggaaaagcaaatccatgctggtgcctcttttgtcaaaaatttgttggttggaacgaagaaatgtgatcacggaatggtcgatgaaactgaaaaggaatcagtcaaaatgatttgtgaaaatgaacaaagtctttgtgatttacctgatccaaatgtcctcaaagcgaattttattgtgcagcgaacggtccggcaatggaaaatatttggaattgccaaagccattccgaaccaccagtttcgttgctgttttcattttggcaattttgattggtctccaaattgtcaattctgtttggccatcgaaatgtttgtcgaccaacgcatgaaacggggcgaaaccattgccaatttgaggccnngagttgacgagactctagaggtcccc

SEQ ID NO: 36414 - DNA, 322 bp, Heterodera glycines
ttctttgccaaccaaatgcaacataggatggtgtcattcgatagccctatgtatcctctattagcctgcaaaatttcgaaaaatttcgttaaggttcaaaaaagttatggccagaagaattcaaaaaaccaaattttccaacttttttggctcgaacttttttgaacttgacgaaattttttggaattttgcaggctaatagagcatctaaagagctttcgaatgataccaacaatgttggatttggttggcaaagaaaaaagttatagtccaaaaacatgtgttcatacgaaaacggcccgtacgaaaacggtctggcccc

SEQ ID NO: 36415 - DNA, 885 bp, Heterodera glycines
atcaagctttcttttaatgccaagaataggcattcacttaagtgattttttttgaaaaaaataaacttttcccatggtgacaatctttgcaaacagacgacaaaattctccaaagtttagaaagatgaaaacattgttttgcgttttcattgtcatcttttaggcgtccaatcaatgatcatactcagttttttaggccataactttttacttaattggtcagtgcctaaaaattatgtatcaaacgaaaacttaaagtctctgggacctaaacaaatactgacattatgaaaatacaatgagaaaacagaagctagcttttttgagtatattcaatataatttttgtctgttacctttatcccaaaatttagttatcgaaaaaattctacaaacttttaacctttagtttgataccaagaaatgtaggcattgaccaattaaaaaaaaaagttatggcctaagaaactgaggatggtcactgattggtcgtttaaggcgcaatagagccctaaacatgtctttacaggtatcctaattaaaaatagtttaaaattagcgcataaattggtttcggcgtagatttttttgaaaaaaaaacttttcctatggccacaatctgtacagctgtgcacacagacggcaatattctccaaagtttagaaagatgaaaaacattgtattgcgttttcattgtctgtttttatcgggaggccgaccgaaacaggaaatgcaatgcaaatccgccaaaaaattttcggaaaatttatgcgggaaaataaatccgtcccccgcctaacacaacaaaaaaaaaagaagcacaggaaaaacaaaagtaaaaataatattattgttgtaaatatatatagaggaaattttaaaatat

SEQ ID NO: 36416 - DNA, 1058 bp, Heterodera glycines
  misc_feature (1031)..(1031): n is a, c, g, or t
tcactaaattaaaatttgcagcaatttttaaattgatccttagttgtacattttttcatccaaggcaataaatttacattgtcatctccttaggtgaaagcgaatttagcagaatttatgattatatgtacgaaattttcttttttacgtttctttttttacttgtttgaaaattattttacatttgcactttttataatcgcagaatcagcaaaatacattcattactttgtagataattaagtaaacacttggaatttcgaggatttatagacgttcataccttttacatatttttactttctaatatcgttaatacatttttttgaataagttgtttaagaaatatatttttgatttgtatatggtatgataccatttttttgcctttgtaaaaagatatgtattttcaaacatttatattttaattgcagataatttaaaagaaattttatttgaaatttaaaatcattcagagaataattgattcggtgctttcggtgtgttcattctcgctatttgaacatttgtagatttcatttacgttctttttctttttaagtttttatttaataatattttaattttatttatcttaatatatgctaacaatgagctttattgtggtaattttttaaattgaaaatttacctcacattttgtaattattattgaaaataaaaatggaatttataaaagttgtattaataattatatttttaggtattattacagtaatatttatttcgaaattggaattattggcattttccatccatccaaacccatcaaatgttattttcttatatacagataattttttggttatttattaaaactattatattattatgatctaatttatattcgattcagtttatatcaccaatcaaaatcagcagttacctttagtaataaactatcaaagtatttttttgtttaataatattgttgtttatgtttatttaaataaactttgtgctttctttaattaattgaaaatttttatattaatttatatttaaaccgantttaataatttaatggttccattctta

SEQ ID NO: 36417 - DNA, 727 bp, Heterodera glycines
aataattaacaaattccattttaattgtcatcaaattccttttccgtttgtccattcttttccattcattcttttttgtttttgcctttgttggccaatgcacactttactgaacgcacttttttggtcaatttggcgacagcgttcacctaaataaatcgttggaagtactgtaataaaaggagatagggagggtacacgttagcgaaacttcgatcaaaaatgaaaagcgtagctgagcgaaactgaccgggaaggtgacggcatgacaaatcagacgacggcatttggcacggccacgaacggcactgatcgaagtgcaaccgacagaagcaacgccaatggcattcggcgtagactgaacctgcgtcataatttattttagaataattaattggttattgaatgcaaattcgaatagcattatatggcttttttcgtttgcacaaacatttttttctagcttgatttttgcgttttcttctcgttcttctcgtctgtgttgttctcgtcgcttttggaaccacacctgaataaaaataaatttttttaaatttggaatttaaattcccctaattacttgaatttggtaaaccgtaatccccgtctcccgtgccaattcctcgagcataaaaatgtccgggtattttctctcctcaaatgcgcctttcaaaatgtccaattggtcggacgaaaggttttgcagtttggtctttataaaatagaa

SEQ ID NO: 36418 - DNA, 988 bp, Heterodera glycines
ccgacaaattgttggattattattctagacgattttttttatttcctcaatgcttgactatcgcctttttgtttggcaactggtagaaattggaagtgaaaaaaagtttgtttgtaactatttacaataaaaatttatgtagcatttctaaaaaggatgtaaaaataagttcttgcgtaatatttttatattgtgtgttgaagaatttgagtctgcttctgatgcaagtggaaaatttttcagcttttctcgaaaagttttttcccagaaaaaggatgggacaaataaaaaactaaacatctctcatgaccaatttaaatttccttacattttgggtttactttattatgctggcccatgaaaaaatgcagtttttccggtgccaaatttttgtgaattttcattcggcgcgtcataagcggattgtttggtggcaaatgcaaacaaattttgtgtaattcgaatgcgctaggcgggctcaacatttccaaatgtatcaacaaagggtctatctccactctctggcaaggtatggccagccaaagcagagtggggcataaacaagaattttttaatctttggtatttcctctattttgtgcctgctctacatttatgtcttgtgccaatatgcctattgcaacagaaatttattcagctttcccgacaaattgttgagataattattctagacgatttttttatatctcaatgcttaactatcgcctttttgtttggcaactggtagaaattggcagtgaaaaaaagtttgtttgtaactatttacaataaaaatttatgtagcatttctaaaaaggatgtaaaaataagttcttgcgtaatatttttatattgtgtgttgaagaatttgagtctgcttctgatgcaagtggaaaatttttcagcttttctcgaaaagttttttcccagaaaaaggatgggacaaataaaaagctaaacatctctcatgaccaatttaaatttcctta

SEQ ID NO: 36419 - DNA, 1269 bp, Heterodera glycines
  misc_feature (60)..(60): n is a, c, g, or t
  misc_feature (1253)..(1253): n is a, c, g, or t
taaattttttatagatttttaaatgtttgattttttttggcttaccaaaacttcatcgancctggttctttctattctctttcaaatcgccccaaatttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagccacgaggccgcgaagcggccgagtgagtaccttgggcgcaggaaaattattaaggaggagggttcattatttatttatttttgcaaaattaattcataaatttttttcagaaactgctctgaaacgcaccaaaatttatttacaagttgaataaggcactctgactcttatattatcaaaaagggagatgaataaatattttaaaaatttctaattcctttttaaacaggccgaaaaagtttaggcttaactttttcagcgggtttaaaaaatctagaaaaattagtaagcatttgtagtgctccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaaaattagtaagctttttgtagtgctccgatacgtatctctgcaaaatttggtgagccgctgatcaattacaaattatttatggacgatcaaattttttgaaatttttttaagtgcaaaagtggtgggtgtttgcaaaaaattttcaccgggtttaataaatctaggaaaattagtaagcttttgtagtgttccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaaaattagtaagcttttgtagtgctccgatacgtatctctgcaaaatttggtgagccgctgatcaattacaaattatttatggacgatcaaattttttgaaatttttttaagtgaaaaagtggtgggtgtttgcaaaaaattttcaccgggtttaataaatctaggaaaattagtaagcttttgtagtgttccgatacgtatnctctgcaaaatttggt

SEQ ID NO: 36420 - DNA, 956 bp, Heterodera glycines
tcatgaaaattgtaaattgggagattattggggacttatcatctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctacagtaaacttatacagatcggatcaggttgataagcgccaataacctcagatttactattttcgcgaccccactttttgaattctgacattttcagctcattacgctctaaatataaacagcatcagtgttccgaaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaacactgattcagtttatatttcgcggagatgagctgtaatttgcgaatagacaaaatgatc

SEQ ID NO: 36421 - DNA, 917 bp, Heterodera glycines
aatgaattaaattacaatttgaatattggctttctgctgaaggattgcaccttcttcaccaaaaaggacattcttcgcctttacaaacgctttcatgcgctgaacccggagaaagtgccgggcaatatgcaggggaatcaggcatcaattgtcaaactgacatttgaggaagtcggcaaaatacccgagctaaaggtgccgattccgtttggtactaatgtttagggggtaatagaagcttttgtgactgtcgtattttttacatacggtaaagcattttaaaattattcaaaaattacgaaaattcttgaaaatgatcagatgattctgatcaaaattaaactcaaaaaattgctcttgagtgacatggccttagttcaacagtacaaaagtgtgggtacttttccattatgagaccacaagccaaaatttaaaaaaatcaacaaaggggcgcgcaaattccacattcccaccgcataaattaacaatttgtgtgtatgcctccaaagtaatgcaaccgcgcgccttgtgggatttgcgcgcccctttgttgattttttaaaattttggcttgtggtcataatgggaaagtaccaaagtgtggataagccatgaatgaactgtataaatattgtaaaatgtcgtattaattttgacttgattaaattttaagcaaattcacgggatttatgcctctttagcctttttaaatcgccctcccacaattaaggaaaatccattcagccgacggatttgcgaagttttctccgaggatggctgtggcaatttgaccttcgacgacttcctggacatgttttccgtcttctcggagatggcaccgcttcagcttaagctcaaatacgccttcagaattttacggttttgtctttggcatgtcatgtttctgtgattttcaa

SEQ ID NO: 36422 - DNA, 940 bp, Heterodera glycines
agacaaatactaggacctcctatcagttaggcaaaatatgatcgcttgttgtccaattgagagcgctttcggaaataattgcttgaacaggtaataatgagaatgtcattttttaaacaattctacaagacaaatactggacctcctatcagttagacaaaatatgaacgtttgttgtccaattgagagcgctttcggaaataattgcttgaacaggtaataatgagaatgtcattttttaaacaattctacaagacaaatactggacctcctatcagttagacaaaatatgaacgcttgttgtccaattgagagcgctttcggaaataattgcttgaaccggtaataatgagaatgtcattttttaaacaattctacgagacaaatactggacctcctatcagttagacaaaatatgaacgtttgttgtccaattgagagcgctttcggaaatgataattgcttgaacaggtaataaagagatagtcatttttttaaaaaattctacgagacaaatactggacctcctatcaattaggcaaaatatgaacgcttgttgtccaattgagagcgctttcggaaataattgcttgaaccggtaataatgagaatgtcattttttaaacaattctacgagacaaatactggacctcctatcagttagacaaaatatgaacgtttgttgtccaattgagagcgctttcggaaatgataattgcttgaacaggtaataatgagaatgtcattttttaaacaattctacgagacaaatactggacctcctatcagttagacaaaatatgaacgtttgttgtccaattgagagcgctttcggaaatgataattgcttgaacaggtaataatgagaatgtcattttttaaacaattctacgagacaatactggacctcctatcagttaaacaaatatgaacgttgttg

SEQ ID NO: 36423 - DNA, 821 bp, Heterodera glycines
atcaaatttaagcatccaaattatttcaaattatagacgctcaatcacatagaaaattaacattctccacaccaaccaaatcagcaaacaaaacaaaagccgcaatcgtcgtcggccgtcttctcgcctcccctccccctcttgcgcacccccgcctactccttccccctccctccctcattcctccccgttacctccctctcgcaccctctcctctccctcactcactcctctcctctcctctccctccccctacctcactcctcctcgttctctccctctcccaccctcgctctccctctcttctccccctcgctccacctcctccgcctttttttttgtcaatcccttcccacccatctcctgaaacataccaaatatgtaaatcacttcccccccccccccctttggcgtcttcaattgtctcttttatgtttttacgtcaatacataaatttgttgaaaatgcgcaattgcaaacggatgacgaaggcctccccctccttccgatcagccgacccttccgtttcccccccccccctcctaatgctggcaaagtttcgcctttaaaagacgccaactgtttattcattgtttattatttttattagccattcatattccaatgccattcccagggtgtcggtctctctctctctctctttctctttcagtgggaaagatggcgcgccgatacaaaaagcatggcatagacaaaggatgtggcacagcaaacaatttcaaaccgtttaaaagcttgacgatggtaagacaaactcaggacagttgatgctttatgcatttcgttgagatgaaaaactt

SEQ ID NO: 36424 - DNA, 749 bp, Heterodera glycines
gtatttactcatgaagattcttcttaattgtaattgaattatgaatattcctgtctgctattttcattttcatttttcgtaataaattaattaattaatcaccgtgatcaccaccaagcgaagacgaacctcttcataatcactggagaacctctccttctctgctcctagtcaaatgattgacctcaccacatttactcaccacctcttcctaccactgagcctgactcattttcctttcagatgtacctcttaatatcactgaaagtacctcctttacccgcagtggcacctcctctctgccccgcccctttccccccatttcctatcactgtctctctctccattctctttatcactatcactccgtctgaagctgctgcccattgcataaacaatggccaacataccatgcaaatccccgatgccgactagaaactacacagacgaggactggaaccgcccgactgagtcgatcaaaatttaataacggccgcgaagcggcctaaaagcacaacaaaaatcttaaacgggcgcctagcgcccgttcgaggccgcgaatcggcctaaaaaggccacaaaaaagggcgcgaagcgcccgtctgagtccatcaaaatttaataacgggcgcgaagcgcccgtccgactcagcacaatttaaaaaacggcgcgaagcggcctaaaagcacaacaaaaatcatgaaacgggcgcgaagcgcccgttcgaggccgcgaatcggcctaaaaa

SEQ ID NO: 36425 - DNA, 931 bp, Heterodera glycines
tctagagtcaaataaaaaaatttttcttaataataaatcactaagcttcttcaaattaaaactataaaataataagaaaagattaataaaggacctatatggataataattattattcattcaactcgattttatatttcaaaaatattgcagtacattatatgatcgttttggcttctcaggccaaaaatgtgtgagagttacatttctatttgaaaataataattttaaataaagaaggaaaaatgctttaaagataaaattaaccagagataaatctattaatgaaaaaaatcaacaaaaaaagaccagtgaacgcgagatttaaataaaatttccagttaaatatagcactgaaattaaaaaataatacactatgaaaatataaagaaaaaaataataattaatttttaaatgtgaatttagtttatactaaattaaactctaataaaaatattaaactccaatttattagaataaaaattaatatataaattaatttaatattaatacatttaaacaaaaaaaatataaaataaaatttatttaaaaaagtattcaacatcataaataaataaatatttaaacaatacaactaaatgtaaaattatatgtaaaatatggtagaaaatattaagaaatatcgggatttataaaaaaatatacataaaaaataatacacaaagaataaaataaaattcatagtaaataatatatcggaatatatgagaccagagattgtgagatacgctgctcaacccatttaagaagtgatcaaaataatgaaaaagattaatttgaatgtttatttataatatttattgaaaattttaataaaatattgattcaataaatctattcaatattgcagatcacttcaacagtaaaaaaatgcattaaaccaaaatgattggatctcttcctatgatca

SEQ ID NO: 36426 - DNA, 524 bp, Heterodera glycines
attaaaaaatgccttaaaaatatttttttttatttaatttaatttcaatatttttgttatgatttataaattaaaatgaattgcgttcacttgaaacatgctattgtcccggacgaatcttcaagtcctccgcacattcgacattcaaatctgagtcgggccaattcccgttcgtgccgcataaattttttggacattttgcgatatttcattttctgtaatttaaatttgcttttaaaagtttaatgcaaaatgcttctaggcttacatttgcctttgcctggacccatggtaaaataaaggcaattacagtcattaattactgtttgtctgtcctattgtgatcaaatattttcaaaaattgattcaaaaattattaaaaaagatatctaaatgccgtatttactgaattattactcccggggttctattttcaacccccctcgaaagggggttctaaaagaggggggggggggtactaattcagtaagtacgttaatttataaaccttaaattttcataaa

SEQ ID NO: 36427 - DNA, 641 bp, Heterodera glycines
ccgcttccgggtagatgttaaaaaaaaaaatttcttagtttgaagaaatggtgctaggtcgatccacaaaaaatctcagtgtgggcgatccacaaaaaagctcagtgtggctcttccactttctctgcgtgaccgatttcatcacatgagtcactttgaatattcactcccttgacgaggcgccgcccggatgaaagtactgcccagcgacacccacggcactctcagatttgtcaattgatctgatatgacaatcacttctcggcacttttctccatttgaactaaacatagccttgacatcttccgtgccatcattgcttacgacaacgagatggacgacgacgacgctgagaccgaaaatttgagaatgaaaatgaacatctgccggtgatgggccgcaaaatgagcaacaattttgtcattttcaagtctcttatatatgcaagactgaaaactcgagttgcattgctacaatcattcactttttcctccctttgtgtcaacaagtgccaagtgagcaaaagatgagactcagtgttagaggattataatggtaaaagatatgccaaatccaaaacgaaagcaagtaatagttttgtctggactctgtcccgtgtcatttttagtcacttgtctttg

SEQ ID NO: 36428 - DNA, 984 bp, Heterodera glycines
  misc_feature (19)..(19): n is a, c, g, or t
  misc_feature (53)..(53): n is a, c, g, or t
tgtcgggggtcggggcggnggaggagctccaattgtcgggggtcggggccccngatcggggaatggccaaatttttttaacccaaaaaaaccattttttttttaactgctcgtaaatcttcttttcttcactttaatcatctgctgatttcgttagcgccagtaagagtgagtccaagtgggcctttaaacctggggtttccatttgtttttatttataagaatattctgattttgggggggggggggtagtgactaaatattctgatttcttaaatatacttatagttttgaaattttatggcataatgtcacatttttcaagaaattttaaggtctgccgcaaaatttttttgatcttttggtcccgaatttactgaaatttataattttgcattttcctccccaaaattatcaaaattgataataggagactaaaaatataaaatttgatcgaataaattggaaaaataactgattggaaaaatgttgctaaatgttcatatttttgagactaaaatcttattttgggcttggtgtttatattttgaaaatttttcgatggaagccctggtttaaaaagaagtggaaagaagtggggttaaaccaggggtgcgatctgtcctgatttatcagatttgtcctgatttggagggttcaaatctgataaaatgaaagtgtcctgatttgtcagatttgtcctgatttggaggtacccgaccaaattttgtcctgatttcttaaataaactcataattttgaaattttatggcagaatgtcactattttatcaagaaatataagtttacacaaaatttggtcatttttggacaaaaatctgttaacaaatcgcattaaaaattacaaaaattttcccggcggagcctatcgacgccactggacgcacctgtccatctcgcaaaattttttgaagaaacgcgccgcaaaaaaagcgtttttagaggcaaaaaaagtcgtcacttga

SEQ ID NO: 36429 - DNA, 407 bp, Heterodera glycines
attttttcttctcaaaactattcgcgctaaaaaattatttttatcgaaaccaactttagaaccatcgcaatatactcaacatagggtctttgattaatttttacacccctgctacctaagaagcctcaatacaaactctttttttgctcattttagtgcctattcgatgatttttgcgcctatctaatgcctattatgcgatttttaatgcctttctacgtgcctatttcgcggatattttgtgcttaaaaatcgcatccctaataagatccccggcacggattgttatccccaatcgaacactagtggatcactattttttcgttaactaaataatccccccgatccgtagccccccaatataaagccaaatcatatttgctgcgctttttccacaaaaaaacact

SEQ ID NO: 36430 - DNA, 888 bp, Heterodera glycines
  misc_feature (873)..(873): n is a, c, g, or t
gaaagagttgcttacgcgcatccaaaagcgaaggatggagccaattaactcgtcctgtgaccccaatccttgcgccacggcggacgaccttcgccaattgccttccttcttcaaatcccctcaaatccgatcttttctccctcaaatccgttctctcttctcttttcatccccattttcctcctccttttcccctcggttttctctttttatcaaaattttactaaattttctatcggaattttctttactcaaaaggcaagtgaaacgatttgcttctgctcctaaacacacaaattgcttcttaaatcggccactgctttatgggacgggcttttcccatttcgaacccccccccccccgatggtctttacgttcgtttcagcgggttatgtgaagtcaaatcgcgcaactttggacagaaaacgatacgcaaatataaacagcagaactttttaattttaaaatacacaattatttaattaatttaatttacatttctttttttagtaaattaattaatttacatttttttagcaaattaattaatttacattttcgtttttaataaattaattaatttacattttttttaataaattaattaatttacatttccttaatgaatttgattaatttacattttcgtttttaataaattaattaatttacatttccttaatgaatttgattaatttccaatgccaaagtctgtcctcttttcccttcccccattttcttcttccgttcctttcattccgttccgtttcctttattccttctctcaccaaactcttttcttctgctattaaatttcatccaaattcgacaaatcccttccagaagaagcctgttcccctcaccgctttcagcngggaatctcccaatc

SEQ ID NO: 36431 - DNA, 874 bp, Heterodera glycines
gagtcctgagaatcattccatgaaaaaatgtgtatatcttattacttgttagataaattttctatgtttctatcgctctcaagcttgatacgaagggctgtgcgccgcgttctttttattgttctgatattttttatatttaataaattttccttataaagggctatctcttttttttgaaacattttctatggttcaaacgctctcaagcgtgaaactgaaaagcaaagtttcgaggacattttatttttcttataataattaaatgtaatatttgttccatataattggttactatttatattttttttatatttctattttactatcactctcgatgctttatcacttttagaaacacctagttcatattatttatcataatgatttgaaattgatcacattttcttaacacatgggtagctctttttgtactaacttttgtatacaccgaaccgctcttgtaccatgactctgcaagtcgatttccgagttcattgtattattttttaaaatataaatttaataacatattacatttaaatatttatttaattgccttttatgcttgacatgaatgccacaatcgcgatctcgccactgctcactccgccatgttgggcctctaattctcgacgagttctcgtccggaatccattctcgccaccaatttctcatctcatataatgtgccaattgtgaatccttaattaatctctttattattaaaatttaagacaataaatcttaattatggtaatacattgtatcgactatcagtttgacccgtgtgttatcaaagcccatattatgcgctgcgattgcgtcgcatgccatcgcattgctaaacatgtaaataaaattctaagatgatc

SEQ ID NO: 36432 - DNA, 588 bp, Heterodera glycines
gtgctaattagccttgtcaagcccatcaaccagcagctgttcggccccctccctgttgagttggccaatgtccaattgtacggcgatgcctttcacacgtgccataatggcattgtacagttggtctccaagtagcggaatggccaaaattggcactccaaattggacagcctcattgacactgttaaaaccgcaatgggagacgaaggcgcgcattttgggatgcactttgaaattgaaatttaagaaaatttatttaagggtaattaattttagtgcactttttgctaatgtttttaattaaccaattactaattgatcaaataataattaattttcgggtctattccagtttattcgtccaatcagtaactttctttagttttttggcaaggactttttctaacttagtcaatgcctatattgttgattcttggtatcaaacgaaagctaaaagtctaaggaatttagaaactcaagaaaacatcaaaatcttcacatagaaaatagcaatgagaaaatgcggaattcagtttatagtaaattcaagaataattttttgtctattgcatttagcccagaatttag

SEQ ID NO: 36433 - DNA, 992 bp, Heterodera glycines
aaagactttacaaaataatacccctggggagaagggactgtgaaacatgatttcaaaattttcaattttttctagtctactctactcaaaacggctcagaattcaataaaaataacattcacggtagcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcgataaaaataacattcacggtgcgaaaaaatggggtttgaaaagtttattggggaaaaaaaactttacaaattatacccctgggaaaagg

SEQ ID NO: 36434 - DNA, 948 bp, Heterodera glycines
  misc_feature (922)..(922): n is a, c, g, or t
ctaacgaaaaaaattcttagcccaaaaaatggctatctcctttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacattttccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacattttccttctctagtctggctctaccaaacactcacacgatatttgaaatgctaacgaaaaaaattcttgcccaaaaaatggctatctcttttttctcctgcggatttgaccgcaaacttggtaccaacatttgccttctctagtctggctctaccaaacactcacacgatatttgaaatgctaacgaaaanaattcttgccgaaaaaatggctatct

SEQ ID NO: 36435 - DNA, 964 bp, Heterodera glycines
ttgacgacgtatccgcaacaaattcgcgacttggactgtcctatgaggtgaagcagaaagtgcaaagcaaatccaactcatataaaaaacttaaaaaacctaaaagaaaaacatagaaaaatcaattttcaataattattaaaggtaaaaaatcgcatttaaagcttttggcgagtcttgaggattttgaactttttttggataattaatacactaattgtatttaattacctaactgaaaaacaaatcattaaattaaatttcaggtggtgcacacgttcagcaatttctgcttcaaatttagcgaagtattcattttttcctttttttcattaatactttgtcttcgttagaatccgtacgcgcttaaatatgcctatgttttggccaatttatgcgagcgacccgagttggacgccgaacgtatcaaaatggcactgattgaacagtgtgccgaagtcgaacttagcggtgtcatatgatcgaatttgaaaaacgcaatttgactgatattaatcctatcgaatccattttgattaaaaaatatccgaaataaaaagcaagtttttacattttataagttttaataaatatgttgactttttgggcccaattttaaaaatgaggaatataaacataacattcaatatttaaaacataattacaaaaaaaaaagttttattatctaaaaaagatgttttaaaaaaattttcgtttgttatatgtcaaagaaatttgatggtgggaaaatcgcagaaatggatctacagaagagaacttttttcaaattcaatcccaaatatgttggaaatttaagtggatattacacataaaaagagattacaaaatttcaacaaaatggcttttgtatttgtatgatgagtgtagtacaacagtctcttcagcctaatttcgacgacccctaaaataacccaattttaggcattttcattttaatattttg

SEQ ID NO: 36436 - DNA, 1720 bp, Heterodera glycines
agcaatgagtcataactaataatcaaatttttttccttttcgcgccttctcattacacacacagatttaatctgctgcgccttttgttaatgagatgactaaaaaaatgtaaccagcagaggcacatgtttatctttcaaagatatataattcacccccctgaaactcataaataataatgaaaaccaaaattttaaatattttgacaaaaatgaaacattttttaattccaaaattccaaataattattcttgaatatataatattttagaaaattatctggtcagttaaatggcaagaaaacagattaaattaaaattattcaaaaagtaaattttctgtataaattttatatttttaaatttctattaaaaattcgtgaaaatttttagttttaatttatttaaaaattattttaatttatgaaaacacaattctattcctcatttctttttaacaaataaatgtccacgcccgctttatgtttggttgttgttcaataagttcaccacacattttccattcattccaaaaaacccaatttgaatcggcgccaaaacaaaatgaccatttttattgcccggggcactgtgtcacaaaagtcaattaacacataattaataaacaatcaatcatcattctctcgtcaattcatgcaacaataacaacacaaatacgccaccaccggcgctttttgccgcccaatttgattagttttgtctctgctgttgttgtttgctctgatcggatcacgccttgattgattttgggtccccgggggggcattcaatatttttttttttcctcattttatccccaaatggcttaatctctcccccacccaaccagccaacggcttaatcatcggcttttccattccattacacacatggtactaattagtctaccggctgctgtcagatctgcgcaccaaatattgttgctaccaaccgagccgttaatgggaaaagctttggggacccccgccgaggggagggataagccctcatttatcatgttagccatgtttaagccctttgtttattcccattttggggataggggcccaacagttggcgaaaaaacatccgcccggaaataaagggctttctttacctgcaaaattttggtttaaacaaaatttgggtgaatttttcccaattttttagccaagttatcatttatttttaaaaaatgatataataaaaagggaaaattcggttccaataatttttaatttgttttttatttttatttccattttaatcttatatttatttattttttgaattcttaacttattttgattgagtttcatttgcttttcaacaaatttaacaattttggtaatatttttagctgaacgcttaattatatctatttagcttttatttaattattttcctttttaattcagctttatcattaaaataaaatgcaatttttatttacgaaaatcacaatttttatttttgtttccgttgcgttttgtgccaaggattctaaaaaagcaggcgaattggctgttgctttgttcaaattcatctacaacaatgaaaaattatgtgagaaaatagaataatttaattttatctaaaatttaaatttttatataaaatttccttagaatttcaaatttttctcgtttaggcggtgatatttttggcaattcctcttggctaccggcacggcacaactgtgagctcagatgccgcatgga

SEQ ID NO: 36437 - DNA, 887 bp, Heterodera glycines
taaaaataaacatcagattcgtgatcagcacttaaaattagcctagaaaaaaattattaaaaaatatttcaggggggtggcaaaacccataagtacctcaacaaccccgtttttctagttcctaaatttttatgctgttgtgaaaagaatttgaaaattttgttgacgtaaaaatggggtgaacctcgtccagcatttgcttcaactccgattgggtgggcgcttcaaatgacgaagttttgtgcggtgccattgctaacagcgaatggtggtggtaatggtgaggcttttgaatgcgatgatgagcagcagaatttggcggcggcggcgggggacaatggcgtgaagaatttggtggcagtgggcgcgatgaacgcatttcaaattctataataaaaatagagaaatattaaaatttgaatttgaaaaatcagtgggattttgtaatatttttaaatgggaatgcaaatgaggaggttttcgacatttaaacaaatatcaacagaaaaattgcaatgagaaaattcggaattcattgaaaataatttttttatctgttgccctagcccagaaattagttatataaaattctatagactttaagcttcaagttgataccaagaatggaggttatggccttggaaataggatattcattgtttggacgcataaaatgaactagagccatttaatttgaacgtttattggaatgaggtgatgagctattctcattaatttacatgctagtttggattttaatggggcttacttgctaaaaaagcaaatttttattttaagtgtaattggcgtttaaacattttaaatgcatttagttggcaaaaaaactgaatttttgatcaaatcccgccttttatatagcttctaac

SEQ ID NO: 36438 - DNA, 1067 bp, Heterodera glycines
tcctatcatgctcgagagcatttgtaacgtaaaaatttttcaaataagagatagtcatttttctggatataagataaatttaaaattttctgtgaaattaatggcggattgcgcaccccccttcctatcatgctcgagaagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcattttcttggatataagataaatttaaaaattctctgagaaattaaatggcgattgcgcaccgcccctcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgcacttcctatcaagctcgagagcatttgtaacgtataaaatttctcaaaataagagatagtcaatttcttggatataagataaatttaaaaattctctgagaaattaaatggcgattgcgcaccgccctccctctcacgctcgagcgcttttgtaacgtataaaatttctcaaaataagagatagtcattttcttggatataagataaatttaaaaattctctgagaaattaatggcgattgcgcaccgcccctcctatcatgctcgagagcatttgtaacgtattaaatttctcaaaataagagatagtcatttttct

SEQ ID NO: 36439 - DNA, 718 bp, Heterodera glycines
accccgactcgtactaatttttcccaactcgtactgccccaactcgtaatggtaccccgactcgtactaagtttcccaactcgtactggtaccccgactcgtactaagtttcccaactcgtactgccccaactcgtactggtaccccgaatcgtactaagtttcccaactcgtactggtaccccgaatcgtactaagtttcccaactcgtactggtaccccgactcgtactaatttttcccaactcgtactgccccaactcgtaatggtaccccgactcgtactaagtttcccaactcgtactggtaccccgactcgtactggtaccccgaatcgtactaagtttcccaactcgtactggtaccccgaatcgtactaagtttcccaactcgtactggtaccccgaatcgtactggtaccccgaatcgtactaagtttcccaactcgtactggtaccccgactcgtactaatttttcccaactcgtactgccccaactcgtaatggtaccccgacccgtactaagtttcccaactcgtactgccccaactcgtactggtaacccgactcgtactaagtttcccaactcgtactggtaccccgactcgtactaagtttcccaactcgtactgccccaactcgtactggtaccccgaatcgtactaagtttcccaactcgtactggtaccccgactcgtactaaatttcccaactcttact

SEQ ID NO: 36440 - DNA, 932 bp, Heterodera glycines
  misc_feature (887)..(887): n is a, c, g, or t
  misc_feature (913)..(913): n is a, c, g, or t
ttttcactcaattaggattacttttaatagggcttcaaaagcatctaatatttggaattttttcacgaaaatttcttcagaggttgctaagtgccggctttgtgaaaaccaattagcgtgtaagaaatcgtgcacaaaaggattgtgggggcattttaaagcgaaacacgctaaagaatttgaaaactatttgcaaaaatccgacccgtcaacggtaatacaagcttccttttttattgaatataaaaaaattcagaaaaaccaaggcattacaaaattttttggcaatgaagacccacaaaaaaaggcggatgaacaaattgcaaggctgatgataagaacgaattgctcttttttatttgttgaggcaccggaattacagaatttgttctctttagcctatccgaaactccaagtaataattttctcccatttttactagtgaaataattttttaagcttcgcagcaaagattattttcggagaaatgtaattcccaaaatggccgatgaaattcaacaaaaaattgttcagggaattggtccggattttttttctgtgacctctgatggatggtcgcaaattacaaaatcacccgcactcttaaggttctctattccttttcatagtttataaaaacagactttagtgttactgtacaccatataaatcaacaatttgtacgcgccgattttgtacttgatgtgattccaatgacaaatcacacaggagcagacatagcggaagaaattggaaacgctcttcggacaaatggattaaacccagaaaaaattatttgtttggttcgtgacaacgcaaaaaacatgataagggccacaaatatttgcctgagttggcaggactcatttccaaaattcggtcttggngtactttttttcgtacaaagtaaggnctgtccttgctccgcgact

SEQ ID NO: 36441 - DNA, 710 bp, Heterodera glycines
taaagcctaaaaatatttaaatttagggtcatttttaggcggtgtgttttacggttttgatgcatttttgttaataagttttgggcaaaacgccatgcttttccaaaaatacttgtacttactttaattgccgctctttccttcaagttttgaagccgatcacccaaaatttctcggacagcttttgcctcctcagtgtcattttttccttttgagtttttcccttgggccttctccccaattttttgaatatcctccgacaaatttccaccatattgtttagaataaaccttcaaaacttctgtcatttcttcgacagaactgcccaaaattacttccaacaaaatctccatttctgacacctgagcatgaaaagggcaacaaataaaattttattcgcctctcaaatggacaattttccgatttagggaaattttcgaaaatttattcaaaatcataaatgatatggtaatcccctggaatgtgggaggaaaaaacatgtttttaccttcgtttgatgcttcaaacatgggtttctatatccatatttcgtgttttatgtccatgttttggcattttgtccatatttatatcggtgctgtgacgaagtgtcagaggtatcgatgtggaagtatcgatgtgggccaagtgtcaaaagtatggatgaggggtaatcggaagagtaagggcatttcagtacggaagagtta

SEQ ID NO: 36442 - DNA, 989 bp, Heterodera glycines
tgcctatgggaggggcgcagccctttgagggtgtttcccgcatgaacccgtgcctatgggaggggcgcagccctttgaagttgccgccccgcacgaacccgtgcctatgggaggggtgcatccctttgatgttgccgccccgcacaaacccgtgcctatgggaggggcgcagccctttgatgttgccgccccgcacaaacccgtgcctatgggaggggcgtatgacaaacccaaacctatgtgactcctttgaagttgccgcttcatggataagcatttccccaaatcctcgcgggtgtttttttcattttcccctccacacgctgcgcagcgccgcggaaggtcatcaatcatccgtctgtcaccaaagtgacaggtggaggaaatcaattttttttcttttgcaaattaatacccttatctttttgaaacctttggggcggttttattttatgaaatcctaagatttttttatcatgaaattaaactctttgtgaaaatttgccaaaaccgtgcggttttttttgcatatattcccttcgccgcgcagcgatgctgccgccgcgcaaattaatcgataatgagaccgccactctcatccgctccgtcgatgcgccgcgattccgagtcgtgaaaaaaaaatcgataagcaccaaaattgtcaatgaaattcgaattaattgtaagatatagaaacattaattggacaatagttgaataaataaaaattcatttaaataaattaaattgaaatttgttttctgaaatggtcttttttctctcccattatttgataatctgcctagactttacgaaacttttagaaatatttatttcttgggataaattatcaaagggttttgtaaggaattagaaaaaatttgacaaatccgtaagtctttcgtgtaaataaagaatatgtatacaaaaaatatcaaggaatttttttctaaacgaaaataatgattcactactcattttttattttt

SEQ ID NO: 36443 - DNA, 974 bp, Heterodera glycines
attgaatcatcgtggtgaattaatttgaattttcatattttcttcgatatttaaaattagtcaattgttaaattcgttaatcatcttataatcgggaatataatttttaaaaattaatttttttcagttatttaaatataaaaaataaaatatttaacaattttgaattgtttacattcatcatttacaatgcaatatcatttttatggccttttttaaccttatccccagcaggcaatcccaactagttgttatgttatgtaccaatgttatttatttatttatttatttatttatttattacaaaaacaaacaaaatcaattgaacacacaaatttttgacatttactacatctctttttttacggaattacataaaattaaatcaaaaattttttttaattttacaattcgtccgtcattaagctatacatacacaaaaaaaacccatcgctcccaccgattcattaattattccatccatttttgtccccattatctttcctgtccaatctcgacgatgtccagcagaagcagcaattgtgtgtcccctgctgtcctcgccctccgcccccccggaggatgtcctttctccgctgccatgaaaatccattccaaatggacattaccctgcttatgcccacccaattgtcatttttaatggatggcataatccattattatggatattgtggaaagctaagccccatttaaatgccaattattttgatctacgatttgtgtagcattttgaagtttcaaattcatttccatatttgaaaaaaaaaattattttaaaaatttccgcaaaagtatttattaaaatataattttaaaagaattattaaaattatttttaaaatgctattttagcttttagttttttttgaatttttcaacaacagaccggatttaaccctttttaaaattagagccaaggttaaagcccctattttttgtaattttttcacatg

SEQ ID NO: 36444 - DNA, 478 bp, Heterodera glycines
actttttggttagggttttagaaaaaaagttaggggccctcaaatgcacgaaaaaatgagaaatcagccgctgggactcagttggccgcgctgaatttttctctatagttttcccggattctcctcaaaaagttgtaagacccttccactactttcagggcgctcccggccttcggccggaagaaaatggttttagcaacgaaactccttgtcaatataacatatatagtaactagggtgctcagttggctatggtgtgcatgcgtggcttggtaatatatggccctcatttgttattttaaaacattaattgcattagtgtgatgttttaaagcgctatcgcgctatgggacgcggcttcgccgcgtcgctaggaagtgatgtaatttagaaattcatcgcagcctcaggacgggcgcttcgcgcccctttttaattttgcgagagacatttgaccgcttcgcagcctcaggacggg

SEQ ID NO: 36445 - DNA, 1255 bp, Heterodera glycines
tttgcagcacgtctcttctctgaagacgacgtgcactttagcgattcgttttgtgcaaaactgaatttggccgatgccaacgaacagaaacagcaggaggaggatgaagaggaggatgacgaatcggacaccagcgacagcaccgcaaaagcgggcccatccacgggcggacttgcggccaaagacacattcatcaagtgggcatcattcattcataatccctatttgttcatattcatgttagaccccaacgaaatgaagaagaatgtgtatctcttgggccatcaaaatacaaagaaaaaattcgacaggcccagccctaactagaaaaacgaaattttttttttgataggcctgggaattgaaagcccccaaaaaatttcaattttttttttttttttttgcatttcttcgcccttcctccatggttatggatgggcctgcaatcaaaaagttgaaggaaaacggaccctaaagaaagctgacgaaatctccctttcgctctctccggcactttcaaatttaagaaatcgaaaaatttcgcgaaaattttagggcactaattattattcatgctacctatttttgttgtttaattggtagggcagcaacttttagtgacgaaaaatcccgaaatatttaactaaaatagtgagtaaaaatcccaaaataggggaaccgcccacttcggcgcggccacttcggcgcgggtatttcggcgcgaggttttttcggcgcgggctttttcggcgcgggctttttcggcgcggccacttcggcgcggccatttcggcgccctatataaaatggctttttcggcgccgaaaaaaattttcaaaatttttttcaaaatctttagaaaaccatatcaaaagcaaaaaatttcctgctgtgaactacaaaaacactaattttgagaaaaagttaaaaaaaattgttttgcagtgttgtgtaccatcgaatactggtcagtttggaatttgtaagtcaaattcaatataaatattcgaaatttgagtccggggttctgaattaggcaagcctatggtcagattgtgatcaacaccctcgaaaacccaccgaatagtaattttttaccaaaatataaaagttaaattatgcaccacaattctgcaccattgcttaccattgcattagcacgttactttgaaagaaaatggcataagttatatgcacaatgaaaggcaaattaaggtttttttgaaatttttttgggatttttaaacattggcgc

SEQ ID NO: 36446 - DNA, 986 bp, Heterodera glycines
cttaaattctatgggaagttttaatattcaaaattctctcttctaagttaacaaaacaaaaaattttttatgaatgtacttaacgttttttcgattttttaataccagtatttatttaaaaaactccaaccagtcgaagacaaaagttgtaagttaatctcaacatgatccaatcgcctcaaggcatgttcaatctataagaaaagattcaaaatccagtaatattgcagaatgggcccggtagtattgcagaattgcgattccaagttaaaactttctctgaaataaatccagtaaaaaaaattgctaaattgcgaatctgacttagattttgcaaaaccatcgaattatttatgggtttctgttttacctttttaccgcaatttttcagtattatgtattacccaaaatcccatactgaggaatgcccatgctcaccttgtcttcactggttagcataatagcccatttggtcactttcttttccagtcgttcctcttctttatttacattcatattttgttgagaaacgattgaagttagtcgtaatagagattaaccaacaattaatctattaatttgatacaagttctaagtcccagctatggtcttattatcatcttttcgtgaaaatttgttcactatagttttatgcgttgcagatcagtgatcgcgaatccgaattccatatacagcccctaagaatcgtgccgaaattttttttaaatactgcactaaaaatagaaaacaaaattccaaaaattttttgtttacgaaaattttattcttttttgcatcattcaaaaaaggggtcctaccatcgggtatatgtattaccaaaattatttattatttttgattaaaaattgtcgaatagtgttccactccgtaacacatacatatgtacataaataaataataatgcacaaacaaatttatgcaataaataacctttaaacatatgcgaaatgtctattctaataaat

SEQ ID NO: 36447 - DNA, 970 bp, Heterodera glycines
  misc_feature (53)..(53): n is a, c, g, or t
  misc_feature (60)..(61): n is a, c, g, or t
  misc_feature (101)..(101): n is a, c, g, or t
aattttgaaaaaacgtctatctcttttctgctcaccactcacatgaattccanccacatnntcggaatagtagcgacgaccctaatttttctggatttctntctgggcgagtttggctctgaaaattttgaaaaaacgtctatctctttttctgctcaacactcaaatgaattccaaccacattttcggaatagtagcgacgaccctaatttttctggattttctttctgggcgagtttggctctgaaaattttgaaaaaacgtctatctctttttctgctcaacactcaaatgaattccaaccacattttcggaatagtagcgacgaccctaatttttctggattttctttctgggcgagtttggctctgaaaattttgaaaaaacgtctatctctttttctgctcaacactcacatgaattccaaccacattttcggaatagtagcgacgaccctaatttttctggattttctttctgggcgagtttggctctgaaaattttgaaaaaacgtctatctctttttctgctcaacactcacatgaattccaaccacattttcggaatagtagcgacgaccctaatttttctggattttctttctgggcgagtttggctctgaaaattttgaaaaaacgtctatctctttttctgctcaacactcaaatgaattccaaccacattttcggaatagtagcgacgaccctaatttttctggattttctttctgggcgagtttggctctgaaaattttgaaaaaacgtctatctctttttctgctcaacactcaaatgaattccaaccacattttcggaatagtagcgacgaccctaatttttctggattttctttcttggcgagtttggctctgaaaattttgaaaaaacgtctatctctttttctgctcaacactcacatgaattccaaccacatgttcggaatagtagcgacgaccctaatttttctggat

SEQ ID NO: 36448 - DNA, 1025 bp, Heterodera glycines
  misc_feature (118)..(118): n is a, c, g, or t
  misc_feature (995)..(995): n is a, c, g, or t
aatagtagcgacgaccctaattttctggatttctatctgggcgagttgggctctgaaaattttgaaaaaacgtctatctcttttctgctcaacactcaaatgaactccaaccacattntcggaataatagcgacgaccctaatttttctggattttctttctgggcgagtttggctttgaaaattttgaaaaaacgtctatctctttttctgctcaacactcacatgaattccaaccacattttcggaatagtagcgacgaccctaatttttctggattttctttctgggcgagtttggctctgaaaaaacgtctatctcttttctgctcaacactcaaatgaactccaaccacattttcggaataatagcgacgaccctaatttttctggattttctttctgggcgagtttggctttgaaaattttgaaaaaacgtctatctctttttctgctcaacactcacatgaattccaaccacattttcggaatagtagcgacgaccctaatttttctggattttctttctgggcgagtttggctctgaaaattttgaaaaaacgtctatctctttttctgctcaacactcaaatgaattccaaccacattttcggaatagtagcgacgaccctaatttttctggattttctttctgggcgagtttggctctgaaaattttgaaaaaacgtctatctcttttctgctcaacactcaaatgaactccaaccacattttcggaataatagcgacgaccctaatttttctggattttctttctgggcgagtttggctcaaaacgaccgattccccttttgaagtagctaaaattaatttataaaattaaatctagataatttaattaaataaatattttaacacataataaattacttctattaaaaactttttaataagtaaataaatattcttcgcctaaaattccctcgccttttgtcgtgttttcgtgcttcttctccaattcactgattttttccanaaacttttgccaattgatctgctgaagctt

SEQ ID NO: 36449 - DNA, 936 bp, Heterodera glycines
aaaaaaattcttgaatttgcttctgaattttttaattttaacccgaaaattactttttcgaaaattttgcacaaataagaggcgaagaaattcaacgaaatttttattaggattttgatttaaaatgttgagaggtttaacaaatttgtacactgaatgttggatcgtcaacaccaatgagaaatgactaacagaaaagagggagaaaagggcgttggtttaggaaaatagcttataataaaggagagacgagcagacgatgagtgagagaaaaatagtggtaaaaatggtcaactgctgcattggcagagtcagagaggggtcacaaagagttcgcacagcatcgaatatttccttcattttgggcgtcattcttccccactgcacttctttcttcggtttaattacccaagtttgaggtacttggcgtgtcctgcccataatatctgtggcatggaataaattttggaactgcgctgcctaacggcggtgcttaaagtgcgctaaaaatgatcaaatgattatcaatttttatttttcttaattccaaaatgaattcgaaacgcaaaaatttaatcataattcatgtggtaaaaaatgcatttaaaaataaaaaaaattcttgaatttgcttctgaattttttaattttaaatagaaaattactttttcgaaaattttgcacaaataagaggcgaagaaattcaacgaaatttttattaggattttgatttaaaatgttgagaggtttaacaaatttgtacactgaatgttggatcgtcaacaccaatgagaaatgactaacagaaaagagggagaaaagggcgttggcttaggaaaatagcttataataaggagagacgagcagacgatgagtgagagaaaaatagtggtaaaatggtcaactgctgcattggcagagtcagagaggggtcac

SEQ ID NO: 36450 - DNA, 752 bp, Heterodera glycines
aagatttatttgtggaatttttggtcggagattttgttctgtatcattttcagcacaagggtcatacgatgaacaaggggggggggagggtgtctagtgatgtttcaatattttctccgagtaagtttggagaatgggagggggggggggtagggttgggggtccggcggtgccgttaggcgcctccgggggaaaatttcaggattttctgaaatcagataaaatggttgttgaatttttaaattacacaatccgaaggcaatgaaagcgaattttgttgggcagcgtacgttcgggcaacggaaattcagcacgttcaacaccgacaagtaatttaggttttggtccaattcccttttcaattttgacattcctccaaattgtcaattcgctttttccatcaaaatgtgcgtcaactaaaccatcgaaacggtcggaaatcagtgccaattttaggccgagttgaggacgattaaaatgaggaaaaatgtccatccaaacatcgctgcaaatccagctgaaattatgaaaatttgttaaaaatatttgtgtcagtgaattttagaattaattttttcatagttttagaatgattttccaatttcaaactcaaaagggtacccccatttagagcccggcgcaggaccggatcctgcgcaggattttgcagggtcccaatccgcaatcttgcattttttggaaaaaacaggattgcaggaaagatccggccggatccggtcctgcaaacattt

SEQ ID NO: 36451 - DNA, 1178 bp, Heterodera glycines
  misc_feature (64)..(64): n is a, c, g, or t
gaagccgcgcatgcactagcaacgaagtcctttgcgcgaagcgctcatgtaatgcatattcttntcatctctcacaattatactgtctacaccgagcaattactgtgcaaagcatactgtctacaccgagcaattactgcgcgacacgctagtttatatatatatagagaaaaagggggactcgtcttaaaaactaatttgagtcgaacggctgtcgggaggggtctgaaagtagtggaagggtcttacaactttttgaggcgcatctgggaaaaatacgggtttttctcttcggtggccaactgagtcccggcggctaatttctcacttttgcttgcgtttgaaggcccgtaactttttttaaaggacagggagcggaaaattcttgctggtaggattttaagttgaagtgttttctaattttcaaaaaaaattccaggcctctacctatacttggaagggctgcagaaattggcaacttttcagtaccaactttgcccagttcagtccccgttgaataactcattaggctttgacctgagcgcagggtggccagcagacttattgtagagctcggtgagctcgattttctgaaatttaaaaatttcgaaaattttcaaaatttttcgagctaggcctaaaaaacggttttcgggtttttgaattttaggaatttttaacgaattttcccagaaaaacggagaccacttccaaaacatagtttttcgagctctatcgactggtatttttttcggaaaaatttcgattttttcccggaaatagaaaaaaattttggcctgagcgggacatttgagtcccgggcccataactcgtcaggagttgattttagcgaaaaattgtcttagaacatttttgtagagctttcgaaactctatcgaatggtgtactataagtctggaaaatttcaaaaattttcgagctaggccccctagaaattttcgaaattttttttgtgggccaaaatgggggtgaaaattttttttctgggctattttgaggtgctgagtacgattatgatgtctattttaagtttcagaatttttggaattttttaaaattcgaaaatttttaaaatttttttggtccttggaaatttggattaaaatttgaaaattcataactcggtgatggtttcatcgatttaactataataaagc

SEQ ID NO: 36452 - DNA, 1179 bp, Heterodera glycines
  misc_feature (69)..(69): n is a, c, g, or t
  misc_feature (76)..(76): n is a, c, g, or t
tgctttcatttgatcgtatcgctttatcatttcaatcttttcataattgctatatcacgaacaaatgcnttctganatattaaatttaaactcacgaaaaacaagtatttttacgcttattaagctaattttcggttattaatgcctattttctaggtttttattttagaggctaaaaatataagccttatttgtagattggtttttgtttttaggttcgtcattaaaacaaatactgagtttagaaatgttttttgaccctctcctcagaaagttgtatctttttctcttatttgacttttaaaagaatggattagaaatgaaagacttgatagcctctcagattagaaatttcaaattaaaatttctcatgatttttctcacgaaaaattagaaaattaaaaaatcattttttatggaaaatttccgtatatttaattattattttttgctgaaattcacgaatgaatgagacacaaagatatgaaaaacaagaaatatttctttataaagaattagccaatcctaaagaatgggttccatggtactgagcatgaagtaaaactttgttttatgttgttacgtcatctaaattcattttttttaaattttcggaataaaatacaaaaaaaatttttttttttgaagtacaaacgacttgaaatcagattagtgttcacaataagcaccacgaaaagcccatgataccatttcttagcgaaaataaaattgttaatttttaaattttttctttaaaatttgttattttaacttaccgactcccaattccctttgccacagtgaaattgtgcgaatgcttacgcccaattccttcgcaatttccctattaatttcttcgtacggtcttttgtcttttgccgcggcaaattcccttttcatttgtctaaatttgttcacaatttcttccttttctttacaattccgaatgtgttgttctaaatttatttttaatattttttaaatattttttctttttttccaactttttcgcgttcggttgggaaattgatggtctgcattttccaccgtttgaaattgtttctgtcccttcatcaacagcagaaaaaggtgttttgcaaattgtccccgtgaatttttgatcaattttttggtgatcattttgccgttcttcgcatatttccattttttcacatttca

SEQ ID NO: 36453 - DNA, 879 bp, Heterodera glycines
ttattttttgaagtgagtcaaacaccctattagtgctttgctgtgccgagaaccggcaggcaatggatggctttcaatctgcaagaaattagattggcaatatgtggttgtaaaaaacttttgggtaatgaattattttttgaagtgagtcaaacaccctattagtgctttgctgtgccgagaaccggcaggcaatggatggctttcaatctgcaagaaattagattggcaatatgtggttgtaaaaaacttttgggtaatgaattattttttgaagtgagtcaaacaccgtattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggcaggcaatggatggctttcaatctgcaagaaattagattggcaataagtggttgtaaaaaacttttgggtaatgaattattttttgaagtgagtcaaacaccctattagtgctttgctgtgccgagaaccggcaggcaatggatagctttaaatctgcaagaaattagattggcaatatgtggttgtaaaaaacttttgggtaatgaattattttttgaagtgagtcaaacaccctattagtgctttgctgtgccgagaaccggcaggcaatggatagctttaaatctgcaagaaattatattggcaataagtggttgtaaaaaacttttgggtatggaattattttttgaagtgagtcaaacaccctattagtgctttgctgtgccgagaccggcaggcatggatggctttcaatctgcaagaaat

SEQ ID NO: 36454 - DNA, 1005 bp, Heterodera glycines
atgggtgcgctgtgtacgatgctctggaccccatcaaagtggagacccttgttttattcagcctctcaaagatgaacctatgaggaggaggaggaggagaagaagagggcaacagcaacaacaacaaaataataataacgatgacgaagacgatgatgataatgatggtaacgaggagggagacgacgatcacggtcatgatgctgataatgaggaagaagaagaagttggaacaaatcggtcggtcagactttgctttttcgacgctgaaacgtcccaagatttgccacttcaactgcgtacaaaggttgtacagaaacatgttccgatgctcattattgccgaaattatctgcgaagcgtgtataaatgaaggaatttcggttcattctggtgttggacaatacgcaaatgggtgcgtgtgcagtcctcctgcgggaccaaggggacgtcgctggtgttctcctccgtttctgaatgcacctggggatgacagtgctctaccagccaatgtccactacaatccacgaagactgtttttccatagttttgacgacgctaccaacaatgacccggtggatgattttatcaattttctcatcggaagtggcccacatggtgttaaaacaatttgtttatcacacaatggcggaaaatacgacattcatttaatactggaggcacttcaccggcgcaatttaccaccaaagcgtatttgcacaacgggactaaaaattttttcgatgactttgaaagggaaccatcaacgacacgtgatctttaaagactcgctgaactactttttctgtgaattggatgcactgccacggacatttggattgaacgctgaagttgcaacagcaaaaccttttttcccttatctgttcattcggcgtgaaaatttacatcaaagattgcgtggtttaccggccaaagaattttatcagcctgatcacatgaaagcatcctagtaagaatcctctacgagttggtgggaggccgagaa

SEQ ID NO: 36455 - DNA, 593 bp, Heterodera glycines
tttctcttgccggcagcgacgacgaaagtcaacaaccacgcccaaagaaaaagttcaaaattccgaaacgacgctcagcactgttacgacccatcggtcagcagcaaagtccattgcaaggacaacacaaacgccgcaagcaactacaagactcaggcttacgcaagttatttcaagccatctcggaccaacaaggaagcagcaaggccaccacaaaggtcatcgaggaaagccgagaaatgcagaaggcaccacgtcatgaacagatcgagcacgaacaacgaatggtgaggaaaggtcaacaagaagcaaatcgacatcttcaaccgaaaaagcggcagcaaaaagaaattcaagaagtgccacattcaacaacagaagagcaacaacgagaaaccaaacgccaacaaatcgaaagacaacaaaatgacgaacaacgtgccatcaatcaacaaacacgcagtacggcttggctagaattggcacgacaatttgactacgatctgatggatcagccggatccaacagagaaacaaccggaagaaacggatcagccaacgaaatcaaagcaacaatcaacaaagaacaaagag

SEQ ID NO: 36456 - DNA, 957 bp, Heterodera glycines
aaaaaagactttacaaaataatacctcccgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaatttttcattttttctagtctaatctactcaaaacggttcagaattcaataaaaatacatttcacgtgcgaaaaatggggtttgacaaagttattggg

SEQ ID NO: 36457 - DNA, 1091 bp, Heterodera glycines
caactctccgctcgcttgcgcctgaggtaggcgcacgcagctctccgctcgcttgcgcttgaggtagacgtacgcaactctttgctcgcttgcgcctgaggtaggcgcacgcaactctttgctcgcttgcgcctgaggtaggcgtacgcaactctttgctcgcttgcgcctgaggtaggcgcacgcaactcacccctcccttcattttagctagtggtattcaccatgccgctgacattggcaactgtcgttcgttgtggcccgaaatgaggggagggcgataaaagtgtgaaatggggagaaggagaatctttccattgaaattgctgacattaaaacgataataagggcacttttggcatggcttacataagtttatgtgaatttaagtaaaagtaaaatgggtctcacgggacgagtcgaaaacaatcgaaattcggaagaaaaattaaaaaatgtcatatcaaattaattaattaattgcgtaaaatgcgtaatttgtggcatttcaaaaatacctgcaccaccgcaggcgaatgaattcgccgcactttttcactgatcgcggcgggaaagcattcattcccccgccggggatttccgccggaaaccagccgtcgtccgccgaagagtccgtccccaaccgcccccccccgcccgaccgatcatatgttggcggaatgttcccacaccgccccatttgccctgaggggcgttgtttatagccaccttctccaaagaaaaactaaatttcaattttaaaaatattttaatcattcaattgatctctaattatgtcttccaaatgttagctgcaatttcgacgataaatgacaacggtaaaaataaatattaaattaaaaaatgaaatttaaaatttaagcgtaaattttcatttgatttacaccgaacggtggaggacgacgctgaagaagaagatgaatggacttatgaatatgtgacagacagcggagaagagggagaatgggaagaagaaagtgaggaggaggaaattgaagtagaagagaaagaggagaaaaagaaaaaggagaaagagaaaaagaaaacagaagatgagaaaaagaaagcgg

SEQ ID NO: 36458 - DNA, 730 bp, Heterodera glycines
gaagtgttcgagctccccataaatctgcgcgcatcggttggggggggactgcccccaaaccaaaaaaaatttattttttcaagtgtccgtttggggtactcaaacaattatggggagcaaaaatcccccgcagaattaaagtacagactatagggaagctattcccgaaggattcgttctccccataaatctgggcgcatcggttcggggggactgccccgaaaacaaaaaaatcgattttttcaagtgtccgtttggggtactcaaacaattatggggagcaaaaatccaccgcagaattaaagtacaggctatagggaagctattcccgtaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccatgaaatctgggcgcatcggttcagggggactgccccgaaaaggcaaaaaaa

SEQ ID NO: 36459 - DNA, 1242 bp, Heterodera glycines
  misc_feature (1087)..(1087): n is a, c, g, or t
tttttcatttatttccccgccacttccgacaaacaatgagtaataatacaacaagcattgaaaggaatggaaagaagagctgctgagaaattacaattattcgcctttattaaatgccaaaggatgatatgaaaagggcaacgtttttatttatcaataaaaatggcatttcaattattttttaagggattattaaatcaattattttgcaatttttttaaaattaaattaaaaaaggctttgaataaatcaacttcagctgtcttaataaacattttgctgacagcagcagatccgtcctctgctgcacactgattttcttcttcttaggctagcaaatgtctctccccgtcccttggctaatgaaagtgttttctgttgtggccaatcactcggctgtccggcaaatgtctgttggccatgttttcggctctattattctccagttggccacatacgccagcccaacacaggtggttttgcctatgagtcggtcggtcggttgtccaatggccatttggccaaatgatcgattcgcttgtcatccgtcgtcagatgtatggccatttcgaagtttgcaatttgaaatgaaagaaggcatcgctttgatatatttatgataagctttaacaatgtttataagcgaatgcttttcggatttgtgctgaatttgtaaatggtcattctgtaaaattcaaaaagtgctgaaacgaaagatactccaattcatgcgaattttgaaaagcagtcatcaaaaatatccgtaaaactttgaccaactcatttttgaccaacttatttttattgttccaacccattgtttttttttggattggaacgtgaaaatcgaggtcaaatcgatgaattttgaggatttttttggtgtttctcaactcgggaatgcttttttgtagacaattggccgcgtttctcgccgtttaacaattttatcgttaaaaataaatttattcaaaattttaataattaaatttattttaatctttgtattcattaactgaccaaagggaccaaattcatacaaaaagtaaaaattttaacggtccataactaacgaaattttttttanaataaaagtaagcttagaaatataatttgtctaaagaaattttttttggaatttttaataattttaaaaaatggttcctgtctgctggtcctacccaggtttactcgcagctgagagtaggttaacccttacctcattcttttggtacgggccca

SEQ ID NO: 36460 - DNA, 1551 bp, Heterodera glycines
gaatctgcgcccagtaaaaatggaggcgttgtgttggtcagttttggctccgcggttccgattcatgaggcggatgcacatgcagtagcattcaaaaacattgtggtctacctgttttccgaccagtgcccgcagatgaacatgatcgtcaaaaggggcgaacgtccgccaattggcacgggcggccaatgcaaaaaaatgtcggaaaagatgtatctcaaggcttggcttgaacaataggcacttcttggtattaccgaaatgacgctctggatcaaaagaaattaaaaggatggttcttttaaatatacgaagaaagcttttgagccagctaagacaaaaatatgcacaacaacaatgcgttcgccgagagatgctggccggcgcctcattgtgccaaatcacttttatgagtccataatcttttaggtcagctttggagtgtacagtcacgtaaaatattaattgttgtatagtccactacgattgtttgtttaatctagatcaggatacgttggagggaatatgccgaaaccagtcgatgttccagttgataattctctagcgcaatcgtgctgcctagcgggggatgcgccgaaggcgctgaccccgctagttagcttaataaacaataatttaaatacattttgccacaaattaataatattaataacgcgctaattcaaacaccatgtcggccgagaaaaagccgaaatgatggtttaaatagtttttcatcctcatttagcaagtaataattaaatcaaaagcgaataaaataaattttagttcctatagatataaattaaataaaaataaggacaattagctaaaataaaataattggcttggtactgagacttaattatattacttaattttaaaatacatttcgccaaaagcaatataatggcacaattttaaacaccttgtcggccgagattttgatctaaattacgcaaataaggctctaagcgttatttatgctgctagtttcgacctttatgatacaaaactattattttaataaattaattataattcatgggccatcaatatttattttggacagaataacataaataaaaaccagcactgagtctcaattgtttatggcatttattaaacacttcgccaatgcctatacaactcaacaaattcaaacaccatgtcggccgagaaatctcaaaatgaccttattcaaccgttttggcttacaattagcattagcctaataagagaaataatttaaaaaaaaaaataaataaataaatttggataaaattttcaaagattaaagctaaacttaagtgaaattcattaatagcccaacttattgaccctcttttcatttctctcaaatcgttgtctcttgcatccatttatgctagcactagcacttagtttaatgtatgcgtcatgtacattgccccgccttcttcgcacccatcggtcaataaatccttctctccttagccattcattttctgtttttcaccttgctcattttatgaacattcttttcttcctttctctcttagattaacaaaa

SEQ ID NO: 36461 - DNA, 1225 bp, Heterodera glycines
aaaggaagggcaaaattgagggggcacaaaaaccccccaggggatgcacaaataaggggtttaagccgaggcgagttggtaaaaaaattttcttaaaattcaataaggattagatggtggtggaagccatggaaaaaaaagaacattatgtaatttacccaaaaatagaaattcgcaaataatgtaatttaattttaaatggaaaaacaaaaaacaaaacattttaaaaacaaaaattacatataacaataagaaaagaacagaattgttttataaaagtcattaaaatgagcaatcgagaccgattaaattggttaattgttgctaattagtcattaatgtgttaattgcaaattaattgtctccaatgttgcgtggaatgaacatgatgcgtgtttcagataaatcagctgatcaatattacaataaaaattcaaaatatcatttctcgtttgcatcttgtctttctgcaactgaaaattttattttttgtaaattaatttattaatttatcgttcaaaattattcatacttaagaaattcaaccaaaatttcatattttattgacttaaacaaacctataaacatcaatcctaaataaaacaaactaaataattaaacattaagataaacaaaaataaataaattaagataaatattaaattaatgaatattaagataaattaaatcaaattaattaattaaacattaaaataaatccaattaaattaattaacattacacctatccattcgattttttaatttttaaatgtcatctaatatgctaattgttgcaaaaatataatgaattattttgcgtttcttaaattaagccaatctggtccataaatattaatataaaaaatttttcaataaaaattattattacatttaaaaaaataatattttcgcattttgtctaatacatttctttcaatgtcgatcaacaaaagtcgtacagtttaacaaacaattttatttttgtttatgcgttttgccaacaaaaatattatttttgtccgtccgtcccccggcccaatcggcgcgcacttttgggcgatcagagatttgatcatttttgtgctgcagctcaaccgatcaacaatgagtgagatcagggcagtataaaagaattgcaaatttgaaaacaattttctaacttttcttcgactcattaacccccaactaattgatcaattacaaaatgtcccctctccgttgct

SEQ ID NO: 36462 - DNA, 1188 bp, Heterodera glycines
aatataatacaaaagttttttgaactgaaacttttctttctacatttatttgcccattctgataaattatgcaatgctttatgcataatttctgtatctgctcttgctttatagcatatatacaatttaacatcatcagcatataattttattttcactcctgatggcaaagcatcaggaagatcgttaatataaatcaaaaatagtaaagggcccaggacagagccctgggggacaccagagccaacttttttatttgaggataaagcatccccaattttaacacgaaaagtcctattactcaaaaagctttttatccacattaaaagtttgccccgtataccaattttttccaatttgtataaaagtaagttatggggcactgagtcaaaagctttctgaaaatcaatataaatacagtccgcattttttccattaataattgcatcataccaatcttccacaactgttattagttgacttgtcgtagacctatttctaacaaaaccaaattggtattccgaaattttattgttttttaggagaaagttgtaaatattttggctaagaattctttccataaccctgcaaagtgagcaggttatagaaataggcctataattttcaggattaaatttgtccccttttttgaaaagaggaaaaactattgattccttccagatatctggaagagaaccagagtctaatgaaatcctgaaaaggtcagtaataacagttgctaatgaaggatggcaatttttcaatgttttatagctaatattatccggagaagttccatttttattcggaagttttcttaaaagtttttgggtctcaatgatgttaaattctatatctgatataaagctttgattaacaaaagtgttgtccaagcttagaaagcctggatcaacttcagaattgttaaacgaatttacaaataaattggcaaataattcacatttttcttggtcattatgatagcatttgttttcagaaaccaaattcgatatttcaaagggattaacatcatatttttgtatatattaaaaaattgaattttttccctttgaaatagccttttgttcaagttgagaatgaaatttttttgttttgtatttttatgtgtaaactaatgctatcataaagtgcccctttttgtgggtcgattttacacagcttatatag

SEQ ID NO: 36463 - DNA, 935 bp, Heterodera glycines
tcatttattttataataaaaaataaataaaattgcatatcatcttcattttggaagtgattttttgtaattagttttgaatttcgcaaagaaaaaaaaataaattttcaaagttttattatgcaaaaaggtggcaaaaaaatttttctaatggaagacataatttaaattattcatttgattacaatgaagtttatctgtttattatttgtcttttttatttttttgatttttgcttacaaataaatttcgaatacattttaattgaatttatttttcattaatattttcaaatcataaaatgaattaaaataatttaaaatataatgcatttgccggaaaatgtaagctagacaacaatattttagttcattcataattcaatcattattaattttataaaaataggttatttaaacaaaagttaacaaatatgcaattttggtataaaattaaatatattttgtataaattggatgaatctattaaacaatttgctaaattacacaaaaaaaaacatttgatgaataataatgttttaatttcttaaaaatgaaatatttcttatttttaaccttttttatttttaatcaattattggtaaatgttatgatgtcattggaaatatttttttaaattcatttttataaacaaaattattttttgtcataataaattatgatgcttaataatgaaaatatttaccaacaaaatcaattataatgcaaaaaaagttaatgcttttcatgaaaatattattaaaatgatcatttcgttaatcataaaaaaggcaatagaaataaaataatacataatatataaaatatattttaatatattttttttctgatttatgttagagcgtcaaaataccgaataataattttagacaaaaatcattgtgttcaaatgagttgtgccaattcaaaattcatt

SEQ ID NO: 36464 - DNA, 1007 bp, Heterodera glycines
ctaagaaacaagaaataaaaattttcaaagatttagtgattaaaattagactttcatatttgattttgctgagttaagcagttaaggcgaacgaaaatctgaaaaattcatataaacttttcacaaaaaaaaaaatcgttttcaggtccacttggggtgctaaaattttgatcatttcatatcactcaagtgagctgatcaatttgtgtaatcagcatcgaaggttataaaaccctgaaattttcagaataattttttatctttttttagttcttaatattatttgtgaggtatgcctgataagctcagtcagcctaatttgtaagggcagtaggtgaaacacgaaaaataaaatttaaaccaacatagttgtgggtaatttttcccatcaagaaaaaaagtatgcaaaagtacacttttctcctgttagacagaaagcatcgaacaagcactacttaagtatcaacatacaatcattattttcagtttttggaatacagaaaactttatagaaaacgcattcataattttttctcatttttgacagttctgatccaaaagtcggtccgcaaatttcgcactacgatttttatcatcaatataatctcttaacaaatattctaataaatatgaaaaagtttagaaccaacatattcctatatttcttaacattcaatttattggtatagctcataaaatatattaaattaatttaagaatactttaaagtaaaggaatgcgcaaccaaaaacaacaataaaagttattgtacagggtgcggaaaaaattcccgtccttttttaagttcattttttcatacccatttaacattgacaaacaaatttcttgataaaaacaaacaaaagatagtaataagccggaaaatcacaacaaatgttcgaaatttcccccattggccgagattcaagcatcataagcgcttccgaaaatttgcagtaatagtcgcaccccatttatgctgtttttaacgatgccaattattacca

SEQ ID NO: 36465 - DNA, 1151 bp, Heterodera glycines
taggtattttgcataacggatttcttttttatggccaccccctcgattagagtcccccgccccggccctacgtggaaaaagtaaagtttttttttttatattttaccatggtgcgtggagtcctttttgaattaaaccgaccaaaacgatttatttaaatgccctcttgaatcctatataatttttgtcacaagaaatagatgaatcatggtaccgcttggtaagcctaacattatgttagaatatcaaatttcgaaaaatttctaagatttccgaccagcacagtttcctgtttgctttttaattgccgatttcgatggtaatgctcttcaatgattaaattatttgtttaaattgaacctgaatttccgtgtgcgggtacaatttcttcaaccgttgcaacacttttgcctcatcacactcgtacaaattctagataagaaatacgattcaaattctgtataaattagacatttagaacacaattcttcaaccgattttttgggtaaattaaaggttgaaaaacccatcatttgctgactgctggtgtttttggcacagggacattttggcgacgccagttttatttagccataatttttttgtggccgaacaaattttttttttttaatttttgcaggataagagagacagttaagtgctttaaaatcataccaagtttgttatagttggttgacaaataaaaaaagttttatacgtttgcgccaaaatggccggaataaaagtggccggacccgttgctgaccgttttcaaatatttatgttcaaattgatttgaaaatataggtttgaaattataatgcatatggaaaatgctgcaccgaatgcattgggtccggcgctgaactgcttgctccccttgcggttgtcgtcatgtccttcgcctcttccgcctcatggcgcagcacatcgacaatggaaaagcgctgagcaggcgacggatcttgcacgggatcaggtgcatccatcatcggaatgtccagatcatcgtctagatccatggaaatgatgccttacaaattaagtagactgtcttgttgctaggcactaattctttctcttgctgatgaaaaattttttaggtaattaatttttccaactttaattttatgtccatgttatgtttggac

SEQ ID NO: 36466 - DNA, 491 bp, Heterodera glycines
tttgtaagatagtaaaaggacaaagcgatgagggccgtggaggttcgagtccgttgtgcaacatgaatatttttatttatttttgtccaaaaaatttaaaaaatagattttcggaaattattttggaagctttttgccaactaaattgaaagatcttggtatcattcaaaagctcttgatgaggagaagctttttctaagcaaatgttgaacagtttggtgagttagaaaaaatatatgggtgttctaaacttgtaatgaacttgagcatagacaataataatcagcatagaaaaatgaagaatttttttctctatcgatatgcaaaatttggtgtaaattgtatgaatagaaaaaaagttatatgtgccgaagtaaattcgggttttctctattaacagagataaataaatagtacaccaaaatgagagatgttttttctctgcattctctatttattggcacatgtctcgtttttttgaaacggtgtga

SEQ ID NO: 36467 - DNA, 526 bp, Heterodera glycines
tgaaaaccacattttacaacccatttttggccaattctttaaggcgggttttttttgttcaaacgcgattttctcgaaaaaaaagtgttgtgacattttacaatccgcggctcaaaatgtgcagaaaagatagagctttcgaatggtaccggtctcgttactcaactctcgatattcgcttgccaacaaacccgaaagcagttagcccccccgttatttttatatatagataactaggcgtcccggtagatggctgcgctttatagaaagccgagcctatcccgtcgagttgtagccagtaacggggtagatgcgtcaggttgttagtgcagtagcagctgacgaaagatgcgtgtctggatgttcgtgcagcagcagctaccggtaacagccaagcctagccgttcacccccaccccaccctacgcggcatgcaaaagaattgatcaggttcgtattgactcggtacactcgctcgtcgctccgcttcgctccgctcctcgctcgcgcacctcgaggggcagggc

SEQ ID NO: 36468 - DNA, 609 bp, Heterodera glycines
cacaattttatttttaaaacccctcaaataaatattaaatatttatgaagcatatgactaaattgttaaacctaatattttaatgagcatttcttaatattttttgaaattatagccaatggcagaatttacggaaaacttagaacagaagaatagaaggggtgccaaaggattttacgttgaccctgcccttgaattacggtttttgtccgcgggcgatcgaaacttcgaactgatcagacgataccgctttcctgatgaagaaattgatttcatttcaagtcttgtaaaggatgaccttcagccaaaacatggcaataaaggaaatccaattcctgttaaactacaggtttaagttggttaaagattttgactaattttggttaaaagggattttttaaataatttcacatgtctctattttagggaaattaattacagttcataaattttttttttaaattttgagttggccctataaaatcaaaatgatcattgagaaaaattattttataactgtttttaattggtttttgttagtttagcctaaattatttatcatagaaaaattttttggttggattttgactacttttgctaaaatggatt

SEQ ID NO: 36469 - DNA, 836 bp, Heterodera glycines
cctgcaggtcggtttttcatttgatcacttttttctgatcatttttccacccccaggccaaaaaagccgaaaattggcaatattaaatcgcctttgctctacacgataaaagtgattttagtgatttgagcagttacagttcgaaatgttcacttgtcaattatataccatttcttcggtattttttgttcatcatttactatacaatagacataaaaacaaaataatttttggtttgatgaaaaaaataattttaataatataaattaaaattaaaggttatcatgaaataggtttggtggagaaatattcttttaggagttgttttcaaaaatttttaggttgatttttataggaaatagcattttgatcgttttcgcttgaaaaaaatttaaccaaaatgccggaagtaattattagggatgatatttttatgcaaaagcatattttttcctgagctccccgtggattttggcagtttttagggcctaaaatatcatcctagtaattatattcgagtcaggtactagattcatgagtcatgattagggttataaattatatggattaacatatttttctgcgcatatgctatgaagaaaggggctcaaaaatagcatttgccaattttgcgtttttagtccatattttggccatttttggcaaattttcataagaaaaatgcaaaaaagcgaaaaatacacccctaaagatcgacttttttggaaatttaaaaaaaaaacacccctaaaaagagaattttttcgaaatttcggaaatttttttagttattttgtccacttccgaaaattttcgctgaaaacagaatgagatta

SEQ ID NO: 36470 - DNA, 751 bp, Heterodera glycines
  misc_feature (28)..(28): n is a, c, g, or t
ttttttattggattatttttaattgttnaaattgaaaaagttggagcagaaaagaaaaaattggaggaaaaaacatttgacgaaatatttggagaaaaatgggaacaaaaagaagaagaaaatggaaataaccaaaataaaaatgaacagaaaaagcgagaaattattgaaaaattcaataaaattaaagagaaaattaagcaaaaagggggaaaatattcaaaaaacgaatgggataaaattaattcgaaaatagcgaaaacattggggacaaatcgccaatacatttacgaatggatcaaagaattacgattgtacaaatggcacaacaaattgaaaacggatgaacaaaaaattgaatgtgtgcaaaaatttattacaatgaaaaatgaatataaacaaaaaggaagaaaatactcgaaaaaacaatggaacaaaaattatgcagaaatgtgaataataaaataaaatcatttagccaaaccaaaattttgttttatttattgatttttattttttttatacgatagtgtccaatcttctagtgtccacttttcggtgtccaattttctggtgtccaattttccggtgtccaatttaccggtgtccaatttaccgggagcgtgtcgatatgcgctgccggaaaaatctgtcgaaaattcgcagacggaacagctttggcttcctccatgaattgctttacaaacgcagcaaaaagattccattgataaatagtatagggaatttttca

SEQ ID NO: 36471 - DNA, 974 bp, Heterodera glycines
aaaacgttcaacatcatcaaggttttgaatcgatactgagcggggcacaactgggagcggattgatgcgaaagctgaaggtgttttctggtaaatctgctagttgtgtaaagcagctgcaacaggctctgtcggcatcacttcttttgcagtagtattaaatgtcgtttgtttggtaattgttttgttcgcttcttcaagatgaggtggagatggttgtatgactggtggctttacaattgttctgttcgattcttcataccgaggcggtgactcaagtatcggtgaaggttttggtggtgttttttgtttaggaggaggtggtggtggttttggaaccgttttcgcgggctttagcttagacgcgggcgtagtctttacgggagaaggctgttttactgctggtggaggagaactaggtttgaccagcggaggcggtgtttttgtcctggtagtagtggtagtagtagtagtggtaggaggagaagccgttttagatggaggaggagaaggaggagaagccgttttagctggaggaggaggagaagccgttttagccggaggaggaggagaagcggttttagctggaggaggagaaggaggagaaggcgttttagctggaggaggagaaggaggagaaggcgttttagctggaggaggaggagaaggcgttttagctggaggaggagaaaccgttttagctggagtgggtgttgttactgatttagcagtaggtgttggaggagcaacaggagcaatcggttgagacggtttagaaacagctgctgtaggggttgctggtataggaggagcttgcgacggtggcttagctggagtttttgctggtttttcgggtgttttttgtggtttttgcagctttgtctcgtcatacaacggtggcgagtcaagcagaattggtgtagccggggctgttttggctggtttttcggggttttttgtgtttttgcagctttg

SEQ ID NO: 36472 - DNA, 354 bp, Heterodera glycines
cagtgtagttttggggtgtcccggtcactaggaaggacttttatgatcaagttggtgtaggagacttttttgatcagcacctaaagttataccagcatgaattagtatttcaaatttttaaataactagaagatagtttttcaggtttgagtcaagacttttttggggcactgtatttgtcttgtttgggaaatattaaaataataaatccaattataattatggtcagcaaatctaattaataaattaaaataattgtattattaattaattaaaatcatttattccgtactgaaatgacccgcctcttctgatcaccacacatttgcctttttgtcacttcgacacagcacc

SEQ ID NO: 36473 - DNA, 954 bp, Heterodera glycines
  misc_feature (72)..(73): n is a, c, g, or t
cctagaggagtgtcgttcaacctccgcccctttttgctatggtgcgctcttttgccgaaaaacgtacgatcnncaatgatttttttgaaaagcgaaacttctgactcaaaacacctcaaaccctagagaagtgtcgttcaacctccgccatttttgctatggtgcgctcttttgccgaaaacgtacgatcccaatgatttttttgaaaagcgaaacttctgactcaaaacacctcaaaccctagagaagtgtcgttcaaactacgccatttttgctatggtgcgctcttttgccgaaaacgtacgatcccaacgagcttttagaaaagcgaaacttctgactcaaaacacctcaaaccctagagaagtgtcgttcaacctccgccatttttgctatggtgcactattttgccgaaaaaggacgatcccaacgagctttttgaaaagcgaaacttctgactcaaaacacctcaaaccctagagaagtgtcgttcaaactccgccatttttgctatggtgcactcttttgccgaaaacgtacgatcccaacgagctttttgaaaagcgaaacttctgactcaaaacacctcaaaccctagagaagtgtcgttcaaactccgccatttttgctatggtgcactcatttgccgaaaacgtacgatcccaatgatttttttgaaaagcgaaacttctgactcaaaacacctcaaaccctagagaagtgtcgttcaaactccgccatttttgctatggtgcactcttttgccgaaaacgtacgatcccaaagatttttttgaaaagcgaaacttctgactcaaaacacctcaaaccctagagaagtgtcgttcaaactacgccatttttgctatggtgcgctcttttgccgaaaacgtacgatcccaatgatttttttgaaaggccggaacttctgactcaaaacacctcaaaccctaga

SEQ ID NO: 36474 - DNA, 799 bp, Heterodera glycines
aggaaggatctaaatttttatatgtttattcatttttaaatattaaataaatttttgaaaatttcgctttttcaaaacgttccaaaactgttggccattccgatattggcacagttccctctgatgcagcgttggcatccctcgatactgtacacacacttttgctcacaactgtatttgacacagtctttgcagcgggcaacaagcgaatggcctccataaggcatgaaaaggtcgaaacatgcctgtaattatagactattttcacataaaattagcatcaaaattatggagtatgttaagccgtctgttttttaaaattgtccttttttgacataatttttcaatttttttcctaggtgcccttaacggcaaggccgggccaaaaaatccaaataaggatgattttttcgacaaactttgtttccaaaccctgccatagctcctaaattttccacggcggagtctttggattggtatggattaagaacccggaaaatgtgtcattattcaaataaaatttacaatcttaaatcgaaatttcaatgtaaaagcaataactataatccgaattcagtttggaaaaaattgctataataaatttattaattacttttaaattttagtttttcttttcaacatgccttcgatttaaagtcatttgcctgcagtttgatgacaaattctgaactttggacaaataatatgaggataataatggtgattagtagtttcattagagcaaccaaatctattaggtctaataaatttataatttaattaataaaatttctttttt

SEQ ID NO: 36475 - DNA, 853 bp, Heterodera glycines
cctgctgccgtcagcttttactgctgctcacaggttaattcgacttgttaatcccatttttctggatttgctgttcaattttggattttggtttaatttgcagatcacttttttaaacaaaaatataattacaaaaaattcgcaattaatgtgggacgtggaaataatagttctctcatagagcagaaattttattttataaaatcataacaaattcactaataaatttgagagattatttcataatatagttccctaacttttcactgagttaccggttttatctcttatttgttagttttaaattaagttttggccgcaaaacaatgccttgggaaaccattcaatttcaagagatattatttaaaccaaacccaaattgtttattcgactaaaccaaaagcccttctgaaaaagtacagttttttgaataatacaaaatgaaatacaatttcaaaatttgcatgggtagggcttgcgtcggtatataccgtatttcttgaattatagtcccccccccccagaaaattagagtccccctctgacataaaacccccttttgagggggggggggggggggtctgtgtgtaactatgttgcacgtggttccttggaaattcctctggaattactccctgaatatcttctattttcttatcactcacaaatcactgtgggaaaattaagatgatactgatgattagcgttcttgttcgattttggcgctagtgcgatatttattctcatggtacttggaaagtactcaagaagtatttcgatttttgtaaaattacaccatcagctgatataaagaaaagcattcttgtctgtccttttccaattatattgccca

SEQ ID NO: 36476 - DNA, 923 bp, Heterodera glycines
  misc_feature (859)..(859): n is a, c, g, or t
ctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctcctcataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggtgcagtccccccgaaccgatgcgcccagatttatggggagaccgaatccttcgggaatagcttccctatagcctgtactttaattctgcgtgggaatttttgctccccatnaatgtttgagtaccccaaacggacacttgaaaagatcgatttttttgtttcataaatatttttt

SEQ ID NO: 36477 - DNA, 885 bp, Heterodera glycines
  misc_feature (800)..(800): n is a, c, g, or t
tttggaatattgttcaattttcccggacaaacccgcgtctgaaaaattccaaggaagtattgggtttcctgatataaaatttcaatggccgactcagtccacaaggatagaaaaaagaaatagggatttttggaaatatttttcaaattttcccggacaaacccgttctggaaaattccaaggaagtattgggttcactgctatataatttcaagggccgactcagtccacaaggatcgaaaaaagagatttggatttttggaaatatttttcaaattttcacggacaaacccgtactggaaaattccaagaaagtattgggtttcctgatatataatttcaagggccgactcagtccacaaggatagaaaaagaaatagggatttttggaaatatttttcaaattttcacggacaaacccgttctggaaaattccaagaaagtattgggttctctgatatataatttcaagggtcgactcagtctacaaggatcgaaaaaaatgattgggatttttggaaatattgttcaaattttcccggacaaacccgttctggaaaactccaaggaagtattgggttcactgctatataatttcaagggccgactcagtccacaaggatcgaaaaaaatgattgggatttttggaaatatttttcaaattttcacggacaaacccgtactggaaaattccaaggaagtattgggttcactgatatataatttcaagggccgactcagtccacaaggatcgaaaaaaatgattgggatttttggaaatattgttcaaattttcacanacaaacccgtactggaaaattcaaggaagtattgggttcctgatatataatttcagggccgactcagtccacaaggatcgaaaaa

SEQ ID NO: 36478 - DNA, 748 bp, Heterodera glycines
aaggacattttgtaatcacgcatccaaaactctaaatcgcattttattaaacaaaatcaagcattgcaacatatttctcgccgccaactatttttctgagcaattgcggcttagaaatgagaaatttatacatttccgaattttgttgaaaacataagcaatttgtaaattataagtaaatgaagaatatttccgtctggaccaattaattaattggcaattcacagtttacccactcaattaatgtgaagggagcgagacaagcacaaaagaaaataatggagatcaatgagcaaagaaaagggaaaagcattgaaattcaaacgtagaaatccaagcatttttaattttcccatcaatcagcgcatttccgctacggatgtccccttgggcaaatggacttcgccaattcgtcccaacaactaaaatgtctccatcacacctttgccctaatgaattaattaggcaattaattagcaaaataattccccctaattacctttataatcacttcgccacttggttcgattacgctggtcaaaaagcgatttgaactcgatgaaatatgaatggatttgttttatcccccacaattttatcctttccgttggattccattcgactggcggtgttcaccgaatccccaaaaaggcaatagcgcggcatcgtcagaccgacgacgccgccgactgctggccctgaaaatgccaatttgggagggaatgccaaattgaaagggaagggaggg

SEQ ID NO: 36479 - DNA, 923 bp, Heterodera glycines
ttattctctatgccagagaaatgtctatctcttttttgcgagaaattttgtaccatacaaatgttctcagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatgaccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggcaattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggcta

SEQ ID NO: 36480 - DNA, 940 bp, Heterodera glycines
  misc_feature (25)..(25): n is a, c, g, or t
tttgtctaatcagaacgactgtganaaaccataaattaaactgaacagtttctggttcggctcatttctttgtaaccacacaacgggtggaaaaccagaaattaaattgaacagtttctggtttggctcaccacttcccctttgtctactcagaacaactgtggaaaatcagaaattaaactgatttacatggttccgatcgcagatgtatcatattggtaactttatggttgtttttctggtcatgtttctggttttgctcttttcttttgtctaatcataacgactgtggaaaccagaaattaaactgaacagtttctggttcggctcatttctttgttaaccacaacaacggtggaaaaccagaaattaaactgaacagtttctggtttggctcatttcttttgtctaatcagaacaactgtggaaaaccagaaattaaactgaacatggtttcgtctcatttgttttgtattggtaactttatggttgtttttctggtcatgtttctggttttgtcttttcttttgtctaatcataacaacggtggaaaaccagaaattaatgaacagtttctggttaggctcatttctttgtctaaccagaacaacggtggaaaaccagaaattaaactgaacagtttctggtttggctcatttcttttgtctaatcagaacaactgtggaaaaccagaaattaaactgaacatggtttcgtctcatttgtttagtattggtaactttatggttgtttttctggtcatgtttctggttttgtcttttcttttgtctaatcataacaactgtggaaaaccagaaattaaactgaacagtttctggttaggctcattctttgtctaaccagaacaacggtggaaaccagaaattaaactgaacagtttcgggtttggctcatttcttttgtctaatcagaacaactg

SEQ ID NO: 36481 - DNA, 989 bp, Heterodera glycines
  misc_feature (34)..(34): n is a, c, g, or t
ataacccctaaagacatctttcttggaagaattnttgtgaaaaaaaattttccactcaaaaatcctggtcacccccctttggtcccgaatctcaaaatcacttttatttttataaaaattcttaaaaaagtgataaaaatgccaaataaaatttatataatagagcaaaaaactgcggatttttgtagtattttacttttctcaaatagcttttcagaaccgagttctgaatttttttctggaaattcgaatttttccagaatttctggaataacttttttcatatttatgctagaaaatccaaataaaacccataaaattctcctgatttttctctatttttaaggctttattcctgtaaaattggtcaacacttaggctagatatgaattttcgaatattcgaccaaatttctgagggccaaaaaattgcaaaatattttcgaatttttaaaaaattctaaaaattatgaaacgaaaaacaaaggtcatattcgtaatcagcatttcaaaataccacagaaaaaaatttttcaccccccttttcaacccaaaaaaaattttcaaaaatttctagggggcctagctcgaaaatttttgaaaattttcgaacatgtagtacaccattcgatagcatttaaaaagctctacaattttgctctaaggccatttttggctaaaaccaacccccgacgagttatgggcccgggactcaaatgtcccgcttaggccaaaaaatttttctatttcctggaaaaaatcgaaaattttctaaaaacatcactaatcgatagagctcaaaaaacgatgttttggaagtggtcttcgttttccctggaaaaatcgttaaaaaatcataaaattcaaaaaccgaaaaactgaattttaggcctagctcgaaaaatttgaaaattttcaaaattttaaaatttgggaaaatcgagctcattgagctctacaataagtccgctggcgaccccctgctccgag

SEQ ID NO: 36482 - DNA, 870 bp, Heterodera glycines
  misc_feature (19)..(19): n is a, c, g, or t
gctttttccaaaaaaattntcgggaacaggggtcttttaggggccgataggcaccgccggggaaaatttttggattttttaatgaatttgttaaaaaaatttcgaaaatttgcgaccccccactcgctgcgaaccccctcccccacctcttttacaccggcccccccccttcgctgcgaacccgccccccgctcgctggccccctttgcgagcgagggggggggggggagggggtccgaccccccccttaaaaaatgtattttatgaatatatatttaaaaatggattgaaaaaaagttacgcagtgccaaatgccgaggacggctgcggcttctcactgctgcaactttcctcctcttcttggccggccgagtgccgcccccgcggcgactttgacttttctctctgtccgccgtcggcggtgcttttcgtttttggcaagccgacgacagtgccggcatcacccgcccttttgtgatgtgacaaagtggaggagaacccgcgatttgttggttgacctgaatttttggtttaagaaaagcaaatttcctttcctttattgccctgtcctctcaaaagcggtcccattaattagtcttgggggagttatttggcatttaccgaatttaattgcacttgccaccccttggggcttgggtggtacgtaccccttgaccgctcggactgttccatggactcacccgtcatttcgtcactgtccatcgattgagcatggtgtgcacagggcgccgtcgttgctgaggttgccgtcgtcgtcgtcgtagacgttgcgactgatgacagtgacgtgttgtcgccgtttccggacagaaagttgctgctgaaaaacggcaccgccagcaccaacaa

SEQ ID NO: 36483 - DNA, 590 bp, Heterodera glycines
gcccgcccctccctttctctttccattcccacggctccttctgtaaccgatgaagcagcttcacccttttgaagctgcaaaatcgttgtcgacaaatttggacgaaagatgaagctgatcaatcaaatgaacagttcgttcgccgattttgccgattaaccaaatggagttaattacactccgcggcagcagacacccgtctcccctcccccccccccccggaattatcacttattagtctctgctatcctcctccaatcatctcatccttcatcccccccccgcttccttaaccattctatttcatcatttggcattcacaagaatatcgccacctctcccccgccccctttctccttttctcccccttcgtttacccccccccctctccctccctcacccttttcgcccaacctttcatgatttcccattttgtcaaggccatttcccatcagccccttcgcccattcattattccgcaatttatgggtgtgaagattgattggagaaaacgttcgaacgaataatgggcgagaatgggaaaagcagaaaaagaaaggaccaacagcacaacaaacagtcgcgacgat

SEQ ID NO: 36484 - DNA, 943 bp, Heterodera glycines
attatggctattttaaaattaaaaaataataattataccatttatataaattaggtccgctcacttcgatataaatgccctagcggacaaccacggcacttccttggaacacaattggcggcgaaaatggatcatattggttcttgtttagcacctagccaaattgaaaaaaaaatgtagtgcacataatatatggacattaattatttgaggaaaaaaacaataattaccggcaaaatataactgccaccgagtggcctgagggaaaatcggcagtaataatggcaaccaaattaaaaacaattaattatgctgagccacaaccgaccgattaatgtcctgagtgcgagacaaaatctgatcaacttcagtatcattgcgcaatttttcggccaactctgtcaagttgacaccggctgccaacagcgcagtgatattgacgccaattgggccttcaatttcgacaccttttaattaaaaaataattaattaaaatattgacgccaattaggccctcaatttcgacaccttttaattaaaaaataattaattaaaatattgacgccaattaggccctcaatttcgacaccttttaaattaattaaatatttatattttatctattgctaatttgattgagcaattttaaattgtgggttccaattaaaattggcattaatccttcaaattgtaattaataatttaaaatgcaccttcaaattcgctggcattgaaactttcaattgcactaggcacatattcggaacagatgccaggaagatgcaggccaacctgaaaatttaatgaatttaggaaaaaatttacccgttcactcattaatgtaatgttctctgcctttgcccaaatttaaaaaaaggggggcgggaaccaaaaatatttttaaggaaaatctgatcttcagggaaatctgtggggtaaaaat

SEQ ID NO: 36485 - DNA, 1065 bp, Heterodera glycines
  misc_feature (972)..(972): n is a, c, g, or t
aaaaactccaaaataggtaataataggtattataaaactcttcttagacacccaaaaccaaggggaaaatgcttttttcctgcttatctgtgcgtattaaatgcgcaaaattttaggtatttaactaaaaatcgcatccctaataattaaataacaacttaaaggttgatttccgatgaaacaatttttttcataagaaaaagttgttttgtctttctctactatacataaacggcaatttatttgtcactcacttttcatgtacattgatcactccgtcatcacaatgctccattccaatcaacaaatttggcaaaaagggatcgctttgaatttgtcgatatggtccggcaaaaacgatgtgcagccaatttgggacattgtggcccagcaaatttggccaatttttgcggcacacattcgccagttggacatcccaaatggtgatttggacaatttgcgtcatctgatttcgccgacaattctcactgatctcgatcagttgatttcaatcaattctggccatttggtgcccgatatggatggcgatgatgggccatatgcaactgctgagcaagcgttgtccaaatggttgcacacgccgaccatcagcgggcaaccgaagcgattgtgttgccgattcactagtggttttgattcagaagcaaaagaatggatcaacgatttcaaggaggtcagtgcagatcgccccacatttcggttggagtcaaatgggcgccaaactgtttgggggctataactccgttcataatttatcgaattgaataattttaatatcattagatagccctaagtgttctatatttgcatacaaaaatttcgaaaaattagttaagcttcaaaaaaattacggtatagaaaactagttttttgaactttttggtcctcaaaaattttcggactttcgtagacaaatggagaacattatttactggctatcggtgatattanaattattcaattcggtcaactatgaaaggagttattccgcaaaaaccggactggcgcccatctggtcgactcgcattcgactggtccgccatg

SEQ ID NO: 36486 - DNA, 867 bp, Heterodera glycines
  misc_feature (50)..(52): n is a, c, g, or t
  misc_feature (851)..(851): n is a, c, g, or t
gggacattttgactgattttagcttgtcgttataatgacgcggggacatnnngactgaggggagcttgctgggacattatgacgcggggacattatgacgcggggacattatgacgcagggacattttgacgggcagcggatctctagtgattgcattgcgaaattggcaaaaacagtcgtgataaaaaaaattaatttaaaattagcacaaatttgcttttgccctatgatatcaccgcgacatcgatatggaactgctgctgaaatggagatttttgatgacagcaaggttgggactggaaggcaaattcgggaatggtccaactctcgaattcactgaaattttgaaaagaactaaaatctaagattcgtgttcagtaaagttcggtaaaaaaaattttccgggaacggaaacgagaaaacgaaaatgaacggagcgggattcccgtattattttttaaatgaaaatattatattttaaacatttttaaaaattgtttcaatttaaattattaaatattggcttttattttgggcaaaaaataacttaaaatttaataaattgaattttctggactgatgtgtttaaaaaataatccggtaccaatattttcaatggtaccggaaaaattggtccgcaaatgtctggacgcggttggatttggtttacaaagaaaaaagttatatccaaaaacatgctggcaccgaaacgcgagttgacccaatttttgtgtgcctttgtggaatatctatttcctgtaaaaactttcaaccccaacaaaatccacgaatttctttaaatttaattttaggttttttccatttgtatgcttttgcattgtccaaaatnttttacgattataaaa

SEQ ID NO: 36487 - DNA, 668 bp, Heterodera glycines
cctatctttttggtatcattagaaagcacaaagtcttcttctgctaagatctataaaatctcagcgtttaggcaattacctaaaaagatttgataattaactaattgttgattattttggtttgttactttctttaaatgttccaattctcttgttttctcgtattattacattattcagactttgtgctttcgaatgataccaaaaagatagggtttgttcgagcatgaacaaagttattgtataaaatcaggtaatgtcaattgattagactcataaaatacctttggactcataaaactcgattggactcataaagtgcattagagcccgcttttctccgtgccaataaacacatttgggacaaaggcattgatttgcgcttgaatgtgtggacgcgtaacaacaacaatattgtgcagccactttggagtgtttttgcccgtcaaatttggccaatttttgcgccaaacattcgtcatttgaattttgccaagggtcgtcaacttgaaaatttgcttcgctacacttcgcctacaattctgtccggcctcgacattatttcaattgattccgaagatttgttgcccgattcaattggtgatgatggtccaagtgcacattctgctggccaaattctgtccaaatggttgaacattccaacaaaa

SEQ ID NO: 36488 - DNA, 1173 bp, Heterodera glycines
ctttctgcctcttttttagatgtctccagcaaaattgctgttcctttttctgttttttgaaccatttttaaaaaatttattattatctttttttctcttttatacattaagcagatataaattcatcattaaagctaggtcttggggagggtccggggcgggataaatattctttaagcatttccttaactttttcggccaattccccgatcccgaggtcagattgtgtataggcgttacggtacgcagtaccgacgtcttgtctatactgcttaacaatttcaaatgccccctttgcttcgtcagccaattctcgtcatattaacacatcttttcggtccaaacacttgtccatttcttttctaatgtgtcctattttctttttttcttcgttaattttttcggaaattccttgtacttttctcaccccttctaatagcctaccgaaccatgttttcatactcggtgcctcaggatgacgaactttaattttttctgcctccgtaattgccctatgagatgcagccgcgaaatctcgggcttcagtatttaatctgagcgtatcccgaaatgctttttcaatggtttttctcgcagcattcaattgctgtttttcttcattagataggcaacaacaatcgctatttgcttggccgattgcgaaaccaaaaagtattaagaaaactgttttattcattttattttatttattttttgtcggatttcttttatatttttatttattgtgcctaggtacttttagtaattcgggattttttattattttatataatttaaaaatctcttcctttcgggaggtatccttttcaaaatacttttcatttattttttaattttagaattttatatagataggtggtagttttatttttttaattgtcttattttcagcttggtttatacataatatgatttttgtccctctgatttcaacccttggttttattgtttctgttttttttgttttttctacatcataattattttcattttttattgtaattttttctttaggaggccgtcctctttgtttttttattttttcttcagacatttttattagagaatgaataataaataaaataaaactttatttatactttatggaaagataccaaaaacaaaataactttttaaatacaaaagaacaaa

SEQ ID NO: 36489 - DNA, 970 bp, Heterodera glycines
  misc_feature (31)..(31): n is a, c, g, or t
  misc_feature (876)..(876): n is a, c, g, or t
atagatcaatcttatgtgattggggacaccngcttgaaatggcgaggcgaatggtgcgtttgtctctgatgggaaacgctccgtccgcttggaaattcacccggagagtcctcctaaggggggaggagggtgcgttttgggcggcattttcccgcgttttgccgttcgtcgctcctcacaaatcccaattgttcgacgactgtccgtccaatttgcgcggggcgtcgcccatcggacgaactttgttcttgcgcgccttggaaaggttaaaggacagcgaatggccgcgcttctcccaattcaaaaagcacaccgacgaaaaaagtgtcggggcgccaaacgacggattgtctcggcacagtcacttcgccaatgccctcgcgcgggtcgacgtcaaacgaaaggcgcgagtcctcccagtcctggtgcaggttcaagtccacttcctgtcccaaaacatcgaacggagtgagtcaccccaaatgatcagtgatcaatcattggtcaatcaccgccgaatgggcgtgccaaacgacgcggtcaatgaccacggaagtggtgacgacgatggacgaatgttcggccgactctttacccaaatggttatttcgtaatgccatcaattagtgtttgacctcggacggggggccgttggttcgggtcgtaattggcgaagagattggccacaatttgggactgggcatctgcaaaacttcggcattttttggccattaaaaaggggtcgaaacggacggatttggcgacttcgctgctgcttcgactgactggcgaacctttgggcagccgaagaggggaaaaaggggacgaaactgacaaagggcgaaataagcctttaaatgggagaaaacagcgcanaccaaaggaaagtgccgaaaaggagcagcaaaaatggaaggcgaaacggagacggcattttcgggtcgaaatttggcatttcaaacgaatttta

SEQ ID NO: 36490 - DNA, 816 bp, Heterodera glycines
  misc_feature (8)..(8): n is a, c, g, or t
ttaaaccntttttgattgcatattgaattatatcaggtccttcaaatttggtatttggactgtagctcttcctgggcactacggcgggtgtttagaatattttttaaatgtaaatccgatggctttagttcaaccgtttagaatgagatggagttaatttaaaattagaaaatgaaatatgaaatttattataaatactaactcgaaaatgcaggaaaacagtgaaagatttagaaatacttcagtgtcgaaatttctttgtgtcgaaaatgtagtgtcgaaattacttagtgtcgaaaatactcagtgtcgaatttacccagtgtcgaaattacatagcgccgcctgcgctagttattattattttttaaattttttggcgtttttgttttatatattttttaattttttggcgttttgtttaaaattttttctttctttcttttccttctctatttctatcgccaaatggctttcatctctctgagcatgtcatcgtttttgaccaatcattaaattccacgctttttgctccattctccaccgattcatttcattttcaaagatttctgctgacattgttcattttattcgatttgtttttataccatcttgtctagtgctcggcatttttgaaagaagcggcggggctggatccagggaaaatccaggcctgggtccatgtccaggtcgggctctaatttgaacccctaaaattccctttggcttttaaaattactttaccaattattctacataatttgaaatttttaggtacttttaaaactactttatcccattttcctgcactatttg

SEQ ID NO: 36491 - DNA, 229 bp, Heterodera glycines
tcttgatccgttcgaatatttaagagcttcctgttgtcactcgaatttttgaattttttgtaatatttggctagatgcacgattttggatttagttttgatttaatatttagagaaaaaaaaaatttttttaaattaaaaatgatgcttttagcttttgagccaatcattagttgatgtaattttatttgcagaataataatcataacttacgctcaaagcttaatcaa

SEQ ID NO: 36492 - DNA, 1257 bp, Heterodera glycines
  misc_feature (16)..(16): n is a, c, g, or t
  misc_feature (1138)..(1139): n is a, c, g, or t
  misc_feature (1143)..(1144): n is a, c, g, or t
  misc_feature (1151)..(1151): n is a, c, g, or t
  misc_feature (1155)..(1156): n is a, c, g, or t
  misc_feature (1159)..(1159): n is a, c, g, or t
  misc_feature (1161)..(1161): n is a, c, g, or t
  misc_feature (1190)..(1190): n is a, c, g, or t
ttcccacttcagtacncaggtgaataccacgtcagggctttacctgagcgcagggtggccagcagacttattgtagagtttaatgagctcgatttttccaaattttaaaatttcgaaaattttcaaaatttttcgagttaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcctaagcgggacatttgagtcccggctccataactcgttaggggttagttttatcgaaaaaacgccttagggcaaaattgtagagctttttaaatgctatcgaatggtgtactacatgttcgaaaattttcaaaatttttcgagctaggccccctagaaattttcggaaattttttttgggttgaaaatgtgggtcaaaaatatttttctggggtattttgatgtgctgagcacgaatctgatgttcattttcagtttaggaaattttggaattttttaaaaattcgaaaatatttttcaattttttaacccttgggattttgggttaatatttgaaaattcataactaacctcagggtaagtcaattttaatacaacaaagctttaaaaatagcaaaaaatcaggagaattttatggcttttatttagattctctatcatgaatataaaaaaagttattccagaagttctagaaaatttcgaattttcagaaaaaaattctgaacacggttctgaaaagttattttggaaaagtaaaataatacaaaaatccgcaattttttgctctattttataaattttattttagctttttatcacttttttgaaaaaagttatagaaataaaagtgattttgggaatcgggaccaaaggggtgagtataggatttttgagttgaaaaattttttcaccaaaaatcttcaaaaaacatgtcattagggctattttatgacgctgatcacgaatacgtgatcagattttacttttgacatcgttaagacctcagaatccctgtgtgattggggattctgaggcatcattttgaagggggaggnnccannttctaancctnnctntntacattatttttcaaagatttttttcgtntttttcaattttattcatttacctagatggtgagttaataaataaaaaattatattttatttaattt

SEQ ID NO: 36493 - DNA, 941 bp, Heterodera glycines
  misc_feature (40)..(41): n is a, c, g, or t
  misc_feature (63)..(63): n is a, c, g, or t
attattgcatcattaaaattattttacgttgccatgcaannaatcaataaacaattcatgatntaaaaataaagaatattattttttgcaaattttttttatactgtaaacaaatgatgaatattttaaaatctttgggattgataattctttggatatttccatttttttatgagctcctagggacttgaaaagtaaaaaaaaaacttagcttaaaattatgtctatcaaattgagaaattagcgaaaattatcgaatttgtttaacgaaattggattgtttttaacttggtttgaagctgctaggatggatttctatatatttttttcttatttcgcgatttatatacctatttccataaaaataagaaaaaaacgacaatttcgcttttcagtttgatttttcgctaaaatgagtaaattttaagctatgttatgttttttccttctaaaatgatttttaataccatttttcgccatttttgaagttttactgtgcgtttagcatatttaagaaattttgaaaaattataccctcaatttggaaaaatctgtccatttttttgccattttatttccatatttcgcgatttttggtccatatttttaccagccctagttataacttataagattctcttttcattatttcttcaatatgtttggcaagccataggtcgagtggacgtaagcgcacaaggtgattcgattagcattgattaaatgggtgctccccttaatgggtatacattttttctggtctccagtcaccgctctttacaatgagacgacctgttcggagtgtccgttcacagtcattccggtggatgagctgcccgtgctgaacatcagcgagtcggaaggagggaatgagtgccaatttgtggacccggccgcctctaacgccttctacttcctctactactacgacggctggacaa

SEQ ID NO: 36494 - DNA, 909 bp, Heterodera glycines
aattatcgaataaaatgacagcagttttattagttttttaagatccatggtctattcaatgatatatccgaaaatgatcataattatcgcagcattcattgacttgctttgttgcccaaatagcgcttcagcgcactttcggtgccaaattgccacaggtgacgaagcgttttggcaaaaacgacacgaaatgcgtctgattggccaacactgccataaatgtgttccatagacagccaaacggtcggctcatcgttgtcccgggcgcgggatgcgatggcctgaagttgtggccaggccgggtcatttggctcaactgcttgtcctttctggtcggtgccataacagtagcggcaccatagtgcgcaaacctggaaaaatgttggaaaagtattagtaaatttgcaaaggtcagcttcttaatggccttatttaatatctaacttttggccctttatctaaatgtggttagatctgatcaaatcattatcattaagtatctacaggttttttttactatttttctcaaaaaattaaataaaatatttaattaatattattttatttattaaattcttcttaacaatttgattggtccaaagactagatctatcttgaaaaagttaatctcagaaattctcaattttttttaccaatgccaatccgtcaatgctttgtccagttttaaggcaatactcaatggtgggcacaataaatttgggctgccgatttgtgccatcaaagcacagtcgtcgaattgtgtcaccgttttttgggttaccaaatcgttgttgaatctgcttacagtagtcgtccaaatcaatgcccggcaccggcggtacggtcggcagaatttcttcggtcttgaaaagggaatcaatattaattaattgtcccaatttatactct

SEQ ID NO: 36495 - DNA, 949 bp, Heterodera glycines
  misc_feature (90)..(90): n is a, c, g, or t
cgggctgggtgagattaactcggaggactcggcaataaattttagtagaaatgggttttaccagaggatgagggccccgaaataattacncaaaggggcatttaaaacaaatatctttattgaaaacgcttgtgaatttaacattttttattgtgatcaagtgaaatggtgcgcaaataaattcgaaggatttaaatatgttttcgtttacatactggtggttgcggctttaaggctcgcaaaaaattcatcgagtgttttgtcaatgtcaccaagatcatctttcttttcttcttccgtcttcacttcaacagtgttctgttccacagcgggtgccgtgacgggcttctcttgtacaggggctggttgctgctcttgtggctgcttgtcgacaactgccacttcaaccgtcttcttttgatcatctcccaccggttcagagagcagaatgtcactgatcactttcatcgcagttttggcttttttcaaacgggccccgtcctgcacagtgctgtccgcaatcagtccggcctccaccaattcgagcgcagcttttgcctttcgcttgaggtcccgttcttcgtccacgtgttgaattagcggaatttcacacgactcagagggcaggtcgccatatggaaggttgaacacgcgcgacttgtttttcagtcggaagaagcagtgacctggcaattcgtagaccacatcgaatggcacgaattggactttgtcgatgcgtgtgcaccaaatcgtgaccccctccttcgtaaccattgtgtcgacctccacttcagttgccttacatgagcggcagcggccactctcgtcaaacggcaggaaccgtggagtggacagacgggggccgctaatcgtcaggcccgatgttgtcacggtaatttccgcttcgccaagaatttgtcggagcaagccccgcttgtcgctcatgttg

SEQ ID NO: 36496 - DNA, 920 bp, Heterodera glycines
taaatattatatataatattataaaaatgacttttcattttcttgttttaatgaatcccttttaaatttagatggctcaattgaaaaaagcacggcacgaatatctggagctggtgaaagtgtttatggacgaattggaagaggcggatttgtttgaagaacaaaatgtggcaagagtgtgcatacacgaggccgggcacaccctcattttgtggttcttaagaggatcggaaaaatttttggaggtaattgaaaatatttttgtacgaaaataagctttgtcgattagatttgcgtagtgccggacccaaacggagactatgatggctacacggcgagtgagccacgtgccgaaagcacgcgcagccagattatggcagaaattgcgtgctattatggaggcaagttagcggaagaattattttgcgagaaaagtatcggccacagcgacgacatgagacaagccaagaagctgaagaaatggcgttaattgatgcgaactgtttgtgacacggaaattttgtcttttcgataatattatgtatatgaagttgtacattttgctcacaaattcgtccatttcaattgcgttaatatacaataattggtaatactttagatggtacaccccccttttttggaaaaaatttttttgttttaaaaaatcatgaaaacatgttccaaagggtgacagggccgcttatatgaatccggcatcgatttcgaccaattcctaatcccggaaccgaattcgaacaaaaagtcgaaaactcaaattttcagttttcatattttagtctaaatagtataaatatcttctgttacaatatttagggttttgagaatgtttccgtgtatttaagcaaagtttgaaccaaaaacgtgaaaccaaaaaatttgaattttcgacttttggttct

SEQ ID NO: 36497 - DNA, 1012 bp, Heterodera glycines
cagagtttcatttattttcccttcaggtgccaacaacctttacttttatagcccgtagcaaatggggacatttttgtaattttgaacaattttttttaaatttttcgggcaaaagcttttaatatttgtaaaaatatttcgttggcactaccggagcaatttatagtgaagaaaaaacgacatatttttaatggatttttctggcatgactgacttaaattcgatattaatttttaggcaattacagccggtgaagaagaagccaattcagagacgcattttggacaattagaaactcagaattttgtatacgaattgcaattaggatttgccacggggacggcgaatcgttgtttccacgcaatttgtgtctctttggggcccgatcgtcaattggacattttgtcacgtttaataagcacaaatccctggagaatcgttcttgctgccgaacaaatcccatgcataaatgaattgtcagcaggtcgcgtggaattggcacttttatttgagctgatcttcactcacttcggaattgaaccgaccacggaattgccttatcgacaattggttaaaagtttgggacaaaatacgcttaattaatcgacaattttaagttaggccgaatcgggaaacacatgggcgaagacttgcaggaagggtcgactccgaaacggacgcggctgaacgatttgaccaccgaacttgccgaaaatgacgaggtaggtcaaacaataataatgccaattcgggacttcgatcttaaaggcatggaacaaattgcgagcggacatggacttgattcagtcaatctccgatttgtatgaaattttagtcacacagaaagcattggttttaatcatttatcacagaaatgttaaatgcattcgtcatttgtatcaaatgaaaatcttggagcggcgtgttctaaattttctgaggaaatttgctgacaatgcgaaggacgatggacagcggaaaattgcgcaaacaaaaggcattcgctcgaatt

SEQ ID NO: 36498 - DNA, 871 bp, Heterodera glycines
  misc_feature (864)..(864): n is a, c, g, or t
gatttgagtcccagagattgaaatgctggtgtgttgagtcccagagattgaaatgttgtggggttgagtctcagagattgaaatgctggtgggttgagccccagagattggaatgccattgaaagttggtgggttgagtcccagtgtctggaatgccggagatttgagtcccagacattgaaatgctggtgggttgagtcccagcgattggaaagcctgagaattgagtctcagagattgaaatgctggtgggttgagtcccagtgtctggaatgccggagatttgagtcaccgagattgaaatgctggtgggttgagtcccagagattgaaatgctggtgtgttgagtcccagagattggaatgtcattgaaagttggtgggttgagtcccattgtttggaatgccggagattttagtcccagagattggaataccggagaattgagtcccagtattggaatgctggtggcctgattttcagtgattggaatgtcattgaaagttggtgggttgagtcccagtgtttggaatgccggagattttagtcccagagattagaatgccggagaattgagtcccagtattggaatgctggtgggttgagtttcagtgattggaatgtcattgaaagttggtgggttgagtcccaatgtttagaatgccgcagatttgagtcccagtgttttggaatgccggagatttgagtcccattgtttggaatgccagagatttgagttccagtgattggaaagcctgagaattgagtcccagagattgaaatgctggtgggttgagtcccagtgtctggaatgccggagatttgagtcacaagagattgaaatgctggtgggttgagtcccangagattg

SEQ ID NO: 36499 - DNA, 661 bp, Heterodera glycines
agagaacggaagaagggaggaaaatgaagagaaaggacgttgagaggaaataatataggaaaggaagagggagaagaacgtgaggtcagaagagagaggaagggaacaagagaagaggaaagggaaaagaggaaaagacaccgcaacaaagaagcagagagaggaggagcgggaggaggaggagaaggaggaagaagaagaagattgagaagaagaggagaaaggtgggcgaggggagaagcaaaccgggcgagcaacagctctttcaaattttgaagagcttctccctaaagagtgcggtttccccctccaaaaaaaaattcaccatttttttgaatgcttttccttttctgtgccctcccctcccatcttattttaattgggacctccaacagcgacgaattcctttgctgctaaagaattgccattttccgtcccgtgcccttctttgccccccccttttactgcccccccccctccaattcggtcattgtcaattcgtttttgttccattttgttttccactcactttacaactcttttcccacaattttcgctttccttccgccgatttctatcgatggccaaacgatccgatcagaacagatcggacggatcagctttgatccatccggcttcaccttctctctgattgcccacc

SEQ ID NO: 36500 - DNA, 1060 bp, Heterodera glycines
  misc_feature (1050)..(1051): n is a, c, g, or t
aacccttcggattggcatatatttccgacaaaagctctttcaatttcaccaatttgcatagattttgacgccattctgtcagcttttcctcccgaattaccccataaacactttcctttatttcttcaattttttcctcaataatgagttttatttggtcgtccatagataatatctctgacaaataatttttaaaatttttgaccgattccattaaataaggcaatgaaagccgcgcctcgtaacactgggccaaaagggtgcctgatttgtgctccaatttcttcaatagaagctccaaataactgcattcaagttgtttttctaaataaaacatcattaatttaattaattgggtaattaataagtcacttttttaataattggtattggattacaatgaatgtcttattagtagggctgggaatttaagtcacgaaataacaccaaaaagtcataaaaacgccaaaaagtcacaaaaacccaaaaaaaaaggatggaaattagctgatatccataaaacctagagaccagaatttttaaactaccgggaccgaggctcaggcttagacaattgaccgggcccaagtcgaccggttcaaaaaaagcctttaaccgtgaggtacgtggcttttttcaaaatttgttgaatattgttttaaaataaatcttttattttagctagatagtcgtaaaagtgccatgtttgaagcttttaacaaagtgaaaatatttttaagtcattttaaggccattttgagtcagcagaaaaaaagtcattggacttaaattgaaagtcctaattattaggggagaaaatggtttttattatttcgtactgaaaattcgccaacttttttcccttctcaaccgacggacctaacttttgtaaaggattttgtcattaataatttttgcttcaaatgagccttttgggcaattaatagggctttaaaaaatttttcgtaaaccctaaaaaataactcatttttcatatttactttttattaattctaagagtttcccccaatttttcttaccaaaatgcannaaatttcgg

SEQ ID NO: 36501 - DNA, 828 bp, Heterodera glycines
ctttatattttttaaatatttgtggtttagtggttagagtttcagctgtaataggattctttgtcatgagttcaacccctgttgtcgttttcctctttttatgattccccccccccccccgcaatccatcactttgtgatggcatcatcgcatttccctccccccccccaccccaagacattatgttgcgcggtcgctgctttgtcttgcgcgactttcctcaaacggcgcccgatgaagcggcaaaactcaccttttacttcaatcaaatgcattctccgtttttggatgctgaaggaattcaagtaaaaaacttttgaactaaaagagatttcaaactttgttgacgatgtttctttgtgtcttcaatcccttcgggcggattcgttttttaatatttttttaatttttggttatttttccgtgtgcataaaatgcttagttcagagacaagtcgtggcttacatatcgcaaaacagtgaagacttcgccacctttccacgcttttatttgaacaaccacacgtggtacagaatcagactgaagaagcgacgcatttcaatgctttcggttgttttttgagggaggggggggagaaatcagagcttacaaaagtgtacaaaatactgtagttttaagtttgtggattcttgggttggtttttaccatttaataagcaccaaccaaaatgaagatttcgaatcaattttgcgttttgaattacggccacaaaaaaagtctgagaattccgttgcattcgttgaaaacagccaatgttttttattttgtaaaaacagaaaatccttaaccccttccccattccctccc

SEQ ID NO: 36502 - DNA, 1256 bp, Heterodera glycines
ataatgatggtctttttgaattgttatcacataatttcaaaattattaaatacctattgaaaaagggtttatgtaatattttttaaacagatattaattttgaattaaataagtattaaaatataaataaacgtttttaaatgaacgatagtcataatcgtaatatttttgcttttataaataaatatttgaaatagaaacttttttaattaattcgatttatgtaactggttgttccaccacagttccgccgacgttcgcaattatatttaataattaatcaccaacgtaattataaaaatgatttttgggtcttttccgatgataatttattgcgataaatatgttgtataaatttagaaaaaaaataaacaaaaaattgttgcaagaccagtggaaacaagattagttagatgaaaaataacaattagcataaaattattaaaagggatttcttaataaaaattaaattaaattataatagcacttttaaatcgatgtttcttaaaaactaactttttataattttaattaataatttactctcataatgcaagaacgattagtatgttaatgatgttagaaaattaaccaaataactttttggagcaaacaaaagttaataaactaaatcaaaaaatcgttattattaaacaaatttgtgggttctttcaaataaattaaatcgaaaaaaaaattaattaattatgaaccataataataattattattattattaatattttattatgttgtcaaattaattaatccaataatattcttttagctattttctgcccttcccttctgaccaaaaggggggggggacgatgccctggcgatctgtccaaaaaaaactcgtctcaatttgcaaaaccgagttccccccggctaagattcgaaaatgactaagaaaattaacctaaaaaccttgcacggggacttcagacacactcaaattccgagaaataggactttttcgagtttgtctaatgatcttcgatctttttgaacgactatcaatacatcaccacgttcataatatctgtatttacgatgtaacctgcaagaagaaagaactgcacaaaagacaataaaaccttacccttatcttgctatatggctcagacaacggactagatttacacttgtatctgtgtaactgagtctacacacaataatgccaatgctgaatgcttgcgaactctacatagattgaaaacatgctactaccgaatcatgctgattaagtatat

SEQ ID NO: 36503 - DNA, 1197 bp, Heterodera glycines
cccctggggggaggggagtggggaacatggttttcaaaattttcaatttttttttagtttaattttctcaaaacggttcagaaattcaaaaaaaaaaacattcacggggggaaaaaatggggtttgaaaaatttaattgggaaaaaaaagactttccaaaataatacccctggggagaaggggagtgggaaacatgatttcaaaattttcaattttttctattttaatctactcaaaacggttcagaattcgataaaaataacattctcggggcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctaatctaatctactccaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctaatctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttccattttttctagtctaatctactcaaa

SEQ ID NO: 36504 - DNA, 1580 bp, Heterodera glycines
ccttttgcgatcgactaattttcctcagttagtcgatcgcaatgctcaaccctttccttgcttttgccttttcccttaacacacttccttgaaaactgttgatccaatctatgtttcattgtttgtcaaaagccgtgcaaaacaatcgcttcggttgttcattttttctcggaatgtgtaaccatttgggcaatgcttggccagcattgcatacggcccatcctcagcaattccatcggtgcatagacgaccagaacacatgaaatccaattgattgagatgtgagagaattgttggcgatatgagacgaagcaaattgttcaaatgatcgcgaccggcaaatttcaaatggcgaatgtttgtcgcaaaagtaaccaaagttcaccggtaaaaacatcccaaatgcgctgatggacgccggtggtttggttatgtttatataaaggcacattcaaatacaaaatggtgccacttctgtcccaaatttgcttattgggacggataaaggcgagcacagagaatataaaaatgctttaatagatacaaatataaagtttaaattaggtaggtattcaattgaagaaaatgaaagcgaattttgttggacaggtggacggtcggcaacggaaatgccacaaatttgccagcgtactctaatagtttcggtttcggttcatttgccgttgcgaattgtgatggtttcaaaattgtcatttccgtattcatcaaagtgtttgtcaaccaaagcctcgaaccggtaagaaagcaatgccaaattgagatttattaataaaaatgtaataaaaacgaaaaatacaccccctaagttttgtgaggagcggaaaactaaacccccgacgggttcgggatctgccatttcaatttactcaatgatttttttcagccaatttcaagagtttttaaaatttttggattttatcaacaaaaaaatgaattaacaatttggcgattttattttaaatagcaactcaaaaattttcatttattgatgcaatggatttattttcaccaaaaataaccttcaaaaaggaaccaaaaaatgtcaattatcctatttcactccaagcttctataaaggaaaaagcaaaaatctggaaaaagctcaaagaaaacccgaataaatacaaacctttatataattcaattagcctacacataaaaattcagattagaaaatttcaggagcgcgaagaaaaaaaaatttcttgacaaaatcccaaaaatatttacaaatatattgaaaaagattttcaaagatgggaaacccctctaattctttatgataacaaaacaattatagacgacggagaaaaagcagaaatttttgccagacattttgcatcaactttccaaaattccaataattatcctcaaccacccaaaactttctcaaatagtcttaattttccgacactttcaactttgcaatttaatgtcatagacgttcttgaaattctaatataccttccaaataaaaataacacctcgccagacaatattagtttcaaatttcttaaaactatgcacttaatcttagctaggcacctgacagatctgtt

SEQ ID NO: 36505 - DNA, 1260 bp, Heterodera glycines
tatgttaacccggcgcaaaatttactggcgccaaaaatttccgacgccaaacagtccataggactatacaaaaagagacaaaaaacgatcacacacttgcagcatttacgcagttgcatcatcgtgttgttcaggctgatcagtgacggggttgagcccttcatcagatgggtgaaattgcgctccaaaactgcgcggtaatattttttctggatgttggagagttggaccttaaaattagaggggatttcatcacaaaaaattgcagagtagtgccattgtctttgtggcacccacacatcaaatgtggtaccgaagttgcgcattttgccaaaaattttttaaaaactgtcgaaatgtgggtgggtacacccttgacacgggtcggggtcactttggcgcggaccatttcggcgccgcaaattttgaaatgctataacttttttatttgtcagttagctttagccaatctggcatcatttgaaagctctatgtgtgctctatatttacatgtaaaaatagaaatgaatgattcaaaaataaaaaagttatgccacgcggcgccgaaaaagccaagaaaaagttaatttttgaggttttttggccataacttttttgtaaactgacgaaattttttgaaattttacaggctaatagagaatctgaagagctatcgaattataacaaaaatttttaatttggttgatcaggaaaaaagttgttagcaacggcgccgaaaaggccggcgccgaagtgggcggttccccttgacacacccaaaaagtgccttaattcaggtggatatacccttggcacaccaacaacgtgccttaattcggatggttacacccctaacatagcctaaaaatgccagaatgccggtatatatacatagtttttgaaaaagatcgggagggatcccgatgaaatccggtcccgattaatgccgtagaaggaaaaaaaggatcgggaaggatcccgagaaactcccatgggatcctgatcccgtctaaagcgaaaagtgccggaatgcggttgtaactccattggcattggcaccgctggcacatgcctcaatgattgtttcctccttgggctgcagttccttctccacgtcctccttcaaccgtcggagcatcatcggtttgagtatctcctgcaacttttgcacttgctcctccgtttggcattggccaaattggtggagaaaagcctcggaattggcgaactgttcaggctccaaaaagttgagcaacgaga

SEQ ID NO: 36506 - DNA, 1303 bp, Heterodera glycines
acagccccttgcttctcgcagttttaagtcttggaattgtcaaatagacacaagacttcgaaataataatcataaattgtcttagagtttttttgcacgcaattcaaaaaaggaaaaacatttgcagtcaaaaaagatatttgaatgtctccaataatgtttccataatttgacgaaagttattcggtatcataatgacaaaacaaaacgaaatcgttttagaatattcctctctggacttgacttgggcatagatgtcgaagctgttttcatacgctatttctaatacgggttataccgatccccagatttttgaatccggttttccgaaaaaatgccttgtggtgaaaacaatatttcacattgcactccatacctcagtgagttcggctcggatcgagaccgggataagggcagtggaaagagcagctcgagctctacaagaaggtacggaaagaaaaaatagttatttctgggactttttcagaaatcggaattaattctccaatgaggcccaaatcttaggcccccagccacagcccgttgaatgtcccagtgttaagtgttggatatgtcaaatgaagccaagacttgaaagttaataatcaaaacattcctattcagatagctgccaaaattttctatagaagccctccttttaaacgaaaaatgcgaactttgaactttccgactttttattttatttcttctcacttttcatcgtttcattgactttttatgtacaaaggattaaagatcgccaaatgagattacgaatttgttgatgctagctgacaaatgaatccgaatattatttaggcgaaaaattgggctcgaattttggcccctgctgttgcatttgctcctacaacattttcagctcccacagctattttcgatcagcccattacaccgaagttgaatggggccaacaaaatgagcaatcggctcaatgggggggggggggagggagacaaataaacattacacatatcgcatccattgacaccataattttatattcctctgacaaatgaatgaatgtttaaatgattttacaaattaaaaaaaaatttaatgggccaccaaattaatttctgttggctatattaatgaaaatgttatttttactggattttttttatttcaaaaagctcattaatctcaccaatttggcaccctaaaaaatgtcggaccatccaaacgaagcggagcgaaatttgaagagaatgtgagccaattttatttcaacttcaaacattattcggcacttttccagtcaccaagaagttgccagtttggg

SEQ ID NO: 36507 - DNA, 928 bp, Heterodera glycines
ttttcattttattcctatcttaattcccaaaaacaattgtaatgcaaatttttgaggcaccttggataacgcatgaaggcgagtgattagtggaattcattagtttttacggaaaactaaaaacaaaaaatcctaaatctttaggaaagcaactgtatatgtttagaggagctaattggaaaaaaactttaggtggcagcattttctctctcgacttccaccctagcggatgtaaactcgcaacagcaggacaggatccttctggtgctggtcttctgattgtgtgggatcttggctttctaaactgcccacccgattcgaaggagttcaattgcagtcaattaccattgacacgaattccccacacaagttgtacactttaaacagtcactgagtcgatttggggatgggtttaaagggcgacccttcttcctttaaatcagtttccaatggggtttacccccacccccccgctagtgagatagtaccaaatactatttcttccctatgctcagtgaccgttttggatggtatttgtgtctttttttaacaaattgcatttctggtaccataaactgcgttcgatggtcaaaacattctgctaccatcagtcgattggtctgtgctggggatgactcgatgatttgcgtttacgaatgcgtcggtgtctattcaagcgaaggatccttcagcaacagtttggaaatgcctacgtgtcaaaagcgaaatatcgaaagctatcgctgcacacacaaattgttggcttaatttttcctaaattatcgtctcatttggcttaggtatggccattccatcgatgtgttgcacattgactggtcttcggatggacgctttcttgcctcgtgctctttggacagcacaatgtaatgaatttgcttatattaaatgggacgcaaaaattgtaaca

SEQ ID NO: 36508 - DNA, 992 bp, Heterodera glycines
  misc_feature (905)..(905): n is a, c, g, or t
  misc_feature (915)..(916): n is a, c, g, or t
tttattatataatttaattattaaattatactataatatttattatattactaattacttttgctaaataaatataaacattttagaatttattcaagtgttttgattatattatcaaaataattttatatttctttttttattaatttaaattagcttttagcataagttaaataagaaaaaaacatttgatttgtctaatataaaatgaaaatataaaaataaatttcaaaattatttcttttaaaatcacctttaattaatcattttcatattttttttatttctcctttgcccatgcaattaaaattaatatgataagaaatagccgaatttctgtttttttaaatcgaaataatcccctgaaaatgtttaaaaactgcaataccgaaatttttgttctcgaaaatcccaaaatgcattaatatgcattaaaatcttaaccaaaatccctgtctcgtaaacggttctaattcatgctcataaattttttttggaataaatatttataaaataaattaaaattttttttaacttattacttctcatttgtttcctattattttacgtcaaataaattttatatttattttatatggttcgagtggagttggaatttgtttaaggagtgtacttttaatagtcgcataattttttactcgactaattaattgcgctctttcaattcgatttttgaattggctgcgattattttgtgcttctcatatggtaacgtgtacaaaaaatgataaaagtgaatttgaaattattaaattatgtaactaatgaatttttaatttaatttttatttttgaatttttttatttctctttttatctaaatcaaaattatgcatcttcgtcatcaggcatttattgttgccattcacccgatgtgaactgtgnggcattatcnnagaaatttgatccgaaagtccatgtgtagcaaaatccgaccctcattttcatttgcaaatataaaattttttttat

SEQ ID NO: 36509 - DNA, 1039 bp, Heterodera glycines
  misc_feature (973)..(973): n is a, c, g, or t
tctttcacaatttttaatggtaaatgtttagaattctgtgggaccgaatcacaaatttattttccttttgacgtaaaaataaattattaaaaagaatgttactttatttttacaaacttagtttagctaataaacatgaagttactcaggaagaagcttaagttcataggaaaatgccatcaataatcgactaggaaaattttaataattttgtgccataagaaaatacaaagaaacaagaaagaagaggaaaacccgaagaaatgttgtgcaataaaaaaatggcaagaaggttgtgaagtcgagaagcggccgagccagaaccttctaagaaaagtaaaagacagaaaatccaaatgagaatttgcggaaaaaagggcagaggccttattttttgggcgtcttgtcgattgaagggtgggggtggagtagggggtaacagtacgcgttgccctattatgaattgggttcgtccgctcccccacaatgttttatgctgcaggcttagcgaatgcgttctcatcggaaccaaagcaaataatggtccatttttggcttgcacaaacgaaatagtcggttgcaactgccacttgaggccagcgtaaatttgaccgatattggtgttaatttaggaagcgattagatttgtataactccgataaatttggtatattatacgaaagcacttagtgagctcattataaaaaataagggtgaaatcaatccattgcgatctgggaaatttggagccctatttttctttaatttttggttttaaaccgagacgaacccattgtatcacttgagtcaatgcgagtggatccaagcgcctcttttattttaaatttataatcattctttgttttaatgataaaatgacagttttatcccatttctttctgatataacattttctactggtgggtcgtttggtaaatagatcatctaacgtaaaacaactggtcattatcangtcccaagcgccccggcggctggtcataagtggctgctgtaaaaattataaaaattaacatatcgg

SEQ ID NO: 36510 - DNA, 987 bp, Heterodera glycines
ctgagagagagtgagggagagaaagagggggaaagagggaggaagaaaaggacataaggaaaagagagagggagatacagagaggaaagtgggagagaaagaaagagggactgagagagagtgagggagagaaagagggggaaagagggaggaagaaaaggacataaggaaaagagagagggagatacagagaggaaagtgggagagaaagaaagagggactgagagagagtgagggagagaaagagggggagggagggaggaagaaaaggacataaggaaaagagagtgggagatacagagaggaaagtgggagagaaagaaagagggactgagagagagtgagggagagaaagagggggagggagggaggaagaaaaggacataaggaaaagagagagggagatacagagaggaaagtgggagagaaagaaagagggactgagagagagtgaggaatgatgaaatataacactacataatgagagaaaaaatgagagataatggatgaaagagcgagagtgagggaaagaatggattgtgacaacaaagtgagttaagagttagagagagacaaaggaaagacataaaactaaggcgagagagagagaagaaagagagaaataaggaagagggagagaaaaaaagagagagaaaggggaggaaaatgatttgggaaaatgcttttcattttttaaaaattatttataactaaaagagaaaggttggggctccatgaaatggcgtctgttattttaataatttaattttgtgaccttttagtattattatttaatttggctatatgatgtttaaattacatttcttggaatggccccatttaattgtacaatgaaattaaaaataattttattaaattttataagaaaatgccaatttttaccagcaggttcggcaaatttaaaaaatgtgaacagccactcgtaacggaggaaataccaagcccccccccccccattctattgac

SEQ ID NO: 36511 - DNA, 942 bp, Heterodera glycines
  misc_feature (50)..(50): n is a, c, g, or t
aaaagagatagccatttttctgggataacctctaaatataaaaatcctcntgtgaaataaaatggcgattgtgcacagccctccgtctcatacgcaagcgcttttgtgaggtataaaatttctcaaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctatttcgcaccgccctccctatcatgctcgagagcatttgtatgtgtataaaatttatcaaaaaaagagatagccatttttctgggatagagtataaatttaaaaattccctcaaaaataaaaggtaaattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaatttatcaaaaaaagagatagccatttttctgggataaccctctaatataaaaatcctctgtgaa

SEQ ID NO: 36512 - DNA, 665 bp, Heterodera glycines
gcaagatatcatgataagtctccttaggccatgggctaaaggaattccctcagttgtcttttgaccatgcctctgaccttacaatatgctaatttttttattgattaaagccagaagaaatttcatcactgcttgttcattacctagcgaatattaggtaacgcaacagataaaaccttctaaagaattattatcccctttgcttaaaggtattggactaaaaccatacatatttacgggaaaaattttactgcttccgaccggaaagcgtaatctactcttcttgtagaagagttttgtctgttttcgggattaggcgcaaaattaactaatttgactctccaaccgactgactccggacgatgtgctcttcctctcgcacaataaccgtccccgcatacgcgacccaatcttgccccatggagagcctggtgttggaatgcacgcgacggcaagagaattttctgtggaccaggacttttttgcggtgggttgaaagaaccacccatgagataggcaatgataccgcatccaatccccaacgactcgaataggccatagaggaatgaccgaaccctctctgcccgctttgctgcagaactgtacgcggagctctgtcatgccaaaagtgaccacacttctctgacttcccatatcctccgctg

SEQ ID NO: 36513 - DNA, 1208 bp, Heterodera glycines
agcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccagattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggagttttgctccccataaatgtttgagtaccccaaacggacacttgaaaaaatcgatttttttgggttttcggggcagtccccctgaaccgatgcgcccagatttataaggagtccgaatccttcgggaatagcttccatatacctctactttatttttgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagccagtactttaattctgcgttggatttttgctcccccataaatg

SEQ ID NO: 36514 - DNA, 1179 bp, Heterodera glycines
ttcatcatgcttttcctctccctacagtttacagggatggctatgtgtgcatcagtattctccacccgccgggcgacggaccgtttggcattgagagagcggcagaacgttggcagcctgtgcacacggtggagtccatcgtcatctcagtccaatcaatgctttcggagccgaactttttgagccctgcaaatctcgaggcactcgtaagaagagcattcgcatggaatgaatattttttaactaattcccctctaatttcagctgatgtttcgcgtcaatccccagcggtacaatgagagggtgaaacaatgcgtgaaggagtcgaacgtggcgcttgaaagtgattaccgcgatattccaaacgatggaggaggacgccgtgcatcgatctaaccttgaaactgtgatctttttcatatgaaactcgttttgattgtacataatacgaatcacacacattgtccattcgttattaccgcgatattccaaacgatggaggaggacgccgtgcatcgatctaaccttgaaactgtgatctttttcatatgaaactcgttttgattgtacataatacgaatcacacacattgtccattcgttctcatatgtatttattaatcattgtgtaaaattaaagaatttaataacttcgctttttctgataaaaaaattatatatccaggaaaaagcctagaatttgaaaatttgaggttgggaatcaggccgggataggattcccaggattcaaattctggaatttgggtcgaaattattaaaattaacataaaaattctcaagaattttcgaataattcgtatggtcgggaggccttacttacacgcataggtgacattggaaaatttgagatgttgcaattggtggaaaaaagtcgggatctggatcagattccgggaaaatccacatgcggaaaataaactttaaaaacgtagcatgcaaaaatcgtgtaaattgttaaataaacgcaaaatgctctattccagtttatgcattcaatctgctttttgtaaattgctacttttcagttttatttatatttgcttttcaatcaattcgaggagtttcatgaaacaatttggcgaatgcccctaataattctcaccaatgagcggtgataaacgagcgtttcgaaatgtttaatgattattttaaattaccc

SEQ ID NO: 36515 - DNA, 633 bp, Heterodera glycines
cttttatcaaagtgtttgagattttggcggatttttaaatttctccatttattagttaggtaaattcattcattaaaatttcaagatttccgccaaaaaatctgaatttgtaatttttagggtttcttttcatttcccccctaatcattatccatcctcctcttaatgcctggtctgcacactttttacgatggcagccttttgctcgcgcctttggtccctttctttggtctcgacacggataaggtcactcactccgcgtcttttccattttgtcacttcaaatgagtttagttgaatctcttcttttgccaattgctctccgttttgctcgcttttgcctttttcaaacttttcccccctcggaagtcctccgatcactccgttcggttgtccattctcgcatttgttggaatagcgctgtgttatttttgctttggaaggtcagtcaatgaatgatgcaaaatgagaaaattttgttactattattattcgaatttgtttgttccctctgattggtttacctcattcgaaatttcgttgattaattttacatttttaatccttcctcattttgttttcaattccttagttcagggccatcaaacacatctttcgactactcctcttcag

SEQ ID NO: 36516 - DNA, 976 bp, Heterodera glycines
atctgctcccccccccctccatccagcagctgtcacatcactgatcactcaaaaattttcatgtcggccatcaaaattacatgtaaatttgaaaaggcaaaacccccaataggtttgggtttcgaactccccaatttaataattaattaatttgacccccttcacccccacaattatctgaccaattagcgcccccccccctccggttaatcaattagtcactaattgactcccgccctccagccacctgtcacttctaattagtgtcaggttgctacgaaggcgtatgtgttactactgtaatcctacataaacaattttttgcttcattataagtccgtaaaaatcgtatcgatccaaaaaaatggattacggactgcggatccgtaaaaatacggatccggtccatacacgaactctagtccttaatggtttatattatcctgcaaaatttcaaaaaaattcgttattcataaaagttatgacctgagaaattcaaaagtttttttgaacacttttgggcataattttattgaaacttaacgaaacggcaaagaaaataacaacaattttgcgaatgcgaaaccatttttttattatatcaaatacaaataattaataaattttacaaatctcgaagaagttcaagagtcatctaagaaactcatgccgaattaccccggtgacaatatatatggtaaattcaatgggaaatggaagtgttcggaagtttttgattttatttaattatccaattaaatctgcatacttattgtattatgtatatatatatatatttatatttatatatattgattgtattcaaatcatacttttcttcaggatatagttataggcaaaataattgctttttaattttatgattaatttttgaataattatttatttaaattttattaacggaagtattatgtaaatttttataaataaagctagtgtttcggaacgcgaatga

SEQ ID NO: 36517 - DNA, 411 bp, Heterodera glycines
aacaccttgaataaaaagccaccggcaaattggccttaagccgtccgtgcgttgtgtgcctcatcgctgctttttcttgcctccctggggcgtcactcattcattcaatattcaatctcgaccctccccgcccgtcgtcgttattcattcccgcccctccccgccattcacccatcgtcgtcacactctttgccctcccccctcccgcgccccctcccattcaatttccgcacattttccacccggttaaccaaccctttcccccttccccccccgctgggggaagggatggacctcttctgccgctgcttcttctccatctatttcttccgctgtttggttactgcaataaacctctgcttcttgtttcatccctctcaaatacattcttattcattcattcaattcatc

SEQ ID NO: 36518 - DNA, 994 bp, Heterodera glycines
  misc_feature (909)..(909): n is a, c, g, or t
  misc_feature (939)..(939): n is a, c, g, or t
tgtttaactttgtagaatttatggattgttgcattttattagcagtttatcaattttagagtctaaaaatgagaaatgtgaaaattttgtattttcgacctttgttcgaattcgggttaggggtttgaaattggtcgaaatggatgtcagattcgtgatcagcgaccccaaaaacccccggaaaattgttttttatgccttttaacaaaaaaaaatttatggggcctaaactgtatatcctgtaaaaactagtataaaagcggttgctcttccaccgactgggcacacttgcaattaaacaaaaattttttttttttcttgagaatgttttacttaatgtcgcctctttttattttgttaaaatttaataaatttttgaggaaaaaaggcaattgaactgaaaagtgtcaaaaactttctttaacaatttgcgccaacaaaatgtcagaccgccgaagagaagcggaggaaaaaatggcaaaagcaatgtaaaatttaaaatgccaattttcaattttaaattttgtttccctttttcttcagtttcatctctgccgactgttggctttcggtgttcgatttgctctctccgcgtaaacttggcctcggagttgcactgatcagtcaccgatttgacttttacgtcgatgaacacttcaaaacgcgcaaatgggcgctgaaatttattggaattggaagcaaaattggaaagaatggcaccaaggaaatggaaattaccaattacaatcgaaaagcattgccaattcctcaaattcaaatgccacgcaaagtcaccggattcgaacgcatcatcatcaagtaaaattggcgattattcaaaagatttaattagacaacacttcccatcattttcagtttcatcgaccaaaatgccatcgcttttctccngcattttcgccaactttttcgccgtctgtncaattaatttggacatttatgcgcacagtgaccgggcatttcgggagttcatttt

SEQ ID NO: 36519 - DNA, 865 bp, Heterodera glycines
aataaaatgtatttatttgtttagattttgtttattttccatttatttttattttattatcaccaattttaaatattaaaataattttatagcctattttcaaaaaagttatgtccagattctcaaataaccaagtttttttttacattttggttataaatttcttgaaacataactaaatttttgaatttttcaggctatagaaaacacgtatggctaccgaatgaaatatacattaaaaatttggttggtttagaacacagttatatcaaaaaattttttgttcgtttttgactacgtcataacttggactccaatttatagttgctaaaaactttcaaattaatggtgtaaaatgttatccaaaaagcaacaatttattacacttttatttgttttattatcaatagtaaatgataatcgttgatattctaatttattaatgcataaattttaacaatgtaataatatttttctatttaaagctcttttgaaggagtcagttttttccatttgctgattataatatatatttttagaaaaaattggttttttttggttttcgtttgaatacaattatttttttctgttttggttttgcttcattttttatctcatgtcttatagacttttgctttaactgcagattgattcgtatattcaatagatttgtatttaataaatatttaaaaaaataaaataaactaacccttatttaatttataattattgttatggtttaaaatgtttgccattttattgtagataataagtttacaatgcataaattttaataatattaataattatttttttatttctatttttctctctgatagctcttttgaagggttcattttttttc

SEQ ID NO: 36520 - DNA, 1393 bp, Heterodera glycines
  misc_feature (1309)..(1309): n is a, c, g, or t
ttcatttaagaaaatatgaccaggctgtggaatcaacaaatttttgaaaaattaatttaatcaaattgagaatttgcaaaagaaccgttgactttttaataaaaattattaaatttttaaattccacatatattttcaaacagatatttatgcttcaaaaattcgatgaataaaagtatttataaaatcaattttatttatttcaaaatcattaaacaaatttagtccaaaaataatttttatgggatgctaagcgaacggaccctcaaaaacttcaattgagcaattcgaagagagaaaggttttattagtaaagttcgtcatattttgtcaatcggtaattcaaaaaacacaatcgcttctgtaccagaggtgtgacaactctcgccaaactcttgctctcgtcttttctgagacaagtcacacccctgttcagtacccaattgcaattttaggtagccaagcttcaaaagtgcgcagcgttttatcccagtccacatccgccgactgttcacgcacacggcagttaatgtgtacaaaatttctaaaggttcattctgctgaaattgctgaattgtgcatacatatatttgttggtcaaaaaaagcaaaaaaatgggcaaaaaataatataatatttgaatctatttttgtttttatttttgaatagtgcaatttattgaagaaaaattggcaacaattataacgacagaagaaatagaaacgaataatagacaaaaaagcaatggtaagatttcttaaacacttttctcagaaagtggcaaatatttattctttccttttttaaatttttttcttcctgatgtaattttatgcgctgaatatgaattgatacttatttttgctaatcattagggttcccaattatattgagataaaatcgcaaaatatgtccataaaatacacccaaaaatcgcgaaatatggacataaaatgacaaaaatatggaaaacatggatatacaaatccgtcctaagaacttcaaaccaatcaaaaaaaaataaccccgcaatatttcaaaaaacgttaccaaattaatcaacatttcgccgtttatcatcctggcgccacaaaattcgaagaacattgctatcttgtagtccctctaagcccccattaaccagacattagcattttttgacattaaaaaccgaaaattttgactgtctttttgcctagctcaaaagtgtgaaccttaagcgcttttgtgttgctggtgcaaatggatgtcacgccataaaaaaaatatggccagaagaattcaaaaaaccagattttccaacctcttnggtcataaatttgttcaaaattgacgaaatttttttgggattttgcagattaatagagcatattatgagctttcgaatgatacc

SEQ ID NO: 36521 - DNA, 606 bp, Heterodera glycines
ttccttatcattcgtcatcccccacttttcttcgtataaaatgaataaataaaagtcatgggggaggggcggataaatcaaggcaaggcaaaggtcaactccaaatttgtaaccaacaaacaattaaccgaaggtaaacccatcattaacgctgtgaacataaaacaaacaactgcgaatgaagaaatctccccgaactgatgaaccgaaaagcattttgatcagttaataataactttacacaaaatatcacaattactcactctgtcgtgagtcataagcaaaatgaattgaaacaaacaaaggataaacgaaagaaaggaaaagtacaaaggtaaaatcgaaacatacataaatagccgttttagtggagaaaagaaaagaaaagagagtgagggatatggccgaccacgagcatattcaacgaaagaaagagaaagagccgtgggaaaggggggagggaattgtgaaaaaagggggggggggggcaacgccgtccccccccccccccgcccaatccataaaatgcctccctcgtcccatgtgcagcacttttggctttgtcacaatgagtggggcttggtgagaaatgaggggggggggggg

SEQ ID NO: 36522 - DNA, 381 bp, Heterodera glycines
aaatattttcacttaatttagaattgatcaatttgcaaattcattacgcataattaaatttttgtactattatttttggtataaatttcttttaacttctaataaattgttaacagaatagcattaaaattttagacggatagaagccattttaagagaaaaaaagatatttaccaattggttggcatcggaagagcacgcggactgattaatggggcaataaaagtgttttgatgggaagtttcgcgaaattgggagagtgattgagtacaaagtgagtactttggcggcactgtcaacattcgttgtaataattcgctggaagtggcaaactttcgccctccgaccatttgccgtaaatgtccttttgtctacgaatct

SEQ ID NO: 36523 - DNA, 983 bp, Heterodera glycines
ctctgggactcaaacctccggcattccaaacactgggaactcaacacaccagtatttcaatctctgggactcaattctccggcatttcaatctctgggactcaaatctccggcattccaaacactgggactcaacccaccaactttcaatgacattccaatctctgggactcaatccaccagcatttcaatctctgagactcaattctccggcattccaaacaatgggactcaaatctcccgcattccaaacactgggactcaacccaccaactttcaatgacattccaatctctgggactcaacccaccagcatttcaatctctgagactcaattctcaggctttccaatcactgggactcaattctccggcattccaaacaatgggactcaaatctccggcattccaaacactgggactcaacccaccagcatttcaatctctgggactcaattctccggcatttcaatctcggggactcaaatctccggcattccaaacactgggactcaacccaccaactttcaatgacattccaatctctgggactcaatccaccagcatttcaatctctgagactcaattctccggcattccaaacaatgggactcaaatctcccgcattccaaacactgggactcaacccaccaactttcaatgacattccaatctctgggactcaatccaccagcatttcaatctctgagactcaattctcaggctttccaatcactgggactcaacccaccagcatttcaatctgtgggactcaaatctccggcattccaaacacggggactcaacccaccagcatttcaatctgtgggactcaaatctccggcattccaatctctgggactcaacccaccagcatttcaatctctgagactcaattctcaggctttcaatcatctgttctaagcgtagctgtcgctctaacacacttttcttcagatctttgactattatttctatttctcat

SEQ ID NO: 36524 - DNA, 932 bp, Heterodera glycines
  misc_feature (900)..(900): n is a, c, g, or t
aataaaaataatgaaagaaataattcggaaaattttggcaaaaatgttgaatatttagccatgcaatcgccaaacctgcctccagtcaaagtttttgaagatgatttggatgagaacgaacggaagttaagggaacagatcaataaattgaaagaagaattggaaaagacggaagaaaagaaaaaggtgattgagaagagaagaatggagcaaatgaaattggccagggttgatgaagtggtcctggaagatgaagaggatgaagaggaggaggaaccaacctcaaaaaagtcccgtcttaatccgacggcgacgaaagaaattgtgcaaaaaataattaatgaagaattggttgccaatgatttggtcatgatcgatccaagagggatcaatgatcgaaatggaccggaagatgtgatcgaaagtcggagaattgaagatggaataagagcaaaaaataggagtgtaaatgaaaaagcaatgcgagaattcgtgatgacgaaaacatcgctcgatcatgcaaaagaaattaggacgagagcaatgaatgaagtgaaatatgctgaaaagccaactgatccgtcaaggcttttgagaggtgaaattcgtgcggcgaaatggacatttgcgaaaagcaaacgaaggcaattccgcctgaagggaaacgattggtgatcaaccaactcgaaacttccgaagaagaggccaaaagaaagcaattttgtgcgcgaaccccgccaccatttcaaaatctgatggcacagcagtgggctcaaaagagagaaaaagcggaaaatgaagtgataagcccagaaaagttggaaggaattttgcaaaaaatcgaagaaatgaaggggaaatgaatgtgatttgtgaagaagtgaaagcgttggtgaaccnatggtccgtgagcagtgattgtgaacccggca

SEQ ID NO: 36525 - DNA, 838 bp, Heterodera glycines
gtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttccagtgtcccgttgggggtactcaaacaattatgg

SEQ ID NO: 36526 - DNA, 465 bp, Heterodera glycines
tctttgtcaccaatccaacaattttgctatcattcgagagcccttcaaatttttttataatttttcaaactaatagaggacacttagggctttcgaatgataccaacaacgttggatttggttgacaaagaaaaaagtggcgctatattgaaagttaccctttttgaaaagtttttcaaaagggggacccttttgttttgcaaaatttttttgtgataaaaaaccatgataattttttatccggggttttaaaggtcgctaatcacgaatctgacatgtattttgactaatttctaatccctaacccgaactcgaataaaaatcgaaattttgaatttttcaaattatgattttttgttcaaatttagattaggaaatcggaattgatcaaaataattgaaggattcgcgatcggggacccctataacccaagatcaataaatttttatgactatcacaataaaa

SEQ ID NO: 36527 - DNA, 1027 bp, Heterodera glycines
  misc_feature (1016)..(1016): n is a, c, g, or t
cgtccgatctggcaagttaagcaacgattgctgactagtcaaaaggttcggtgccgtgatgaaacgaaccagcactgcttaccccgcggcacccggcacggtcccccgaaggaatggatttaattaaattctctccttcggggattttttattaaggaagagagttcattatttatttgtcttttgcataattaattcataagtatttttacagaaactgctctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaanttttgaagggc

SEQ ID NO: 36528 - DNA, 1047 bp, Heterodera glycines
  misc_feature (932)..(932): n is a, c, g, or t
  misc_feature (955)..(955): n is a, c, g, or t
  misc_feature (1024)..(1024): n is a, c, g, or t
attatatttgtttaatcttgtaatcttttttgagttatttttttattcccttgtaattgaaaaagtctgcccatttaattcttctcacctccattagcaaatggtcgtccattccatttgctatggttttttccttctcttgtcagcgcagcttttcccatgccacacgactttcaatgtgccgttggcgtcaatgtcgaataccacttttgcacctgcagagatgacaaaaaaggacattaaaaaaatcgtggaatatttttatttttttaatggcgagaggaacaaagactcgggatcccgatcgatcccgatgaattgaaaattgctcggaacggaccccgaagtcgggatcgagattttttaattagggctaggagaaataaacaaaattggttaaaattaaattttcttcggcagcatccttggccaggatgaagcttcccattgaaaattttatttaagccttaatcccccaccttgtgcaaaatgagagagtgcacttggcattctcacaggcggcacgaacacgaaaaaatgcttcagggctccagctgagcatgtacccgtgctgacgcatgaattccgcaacgaaatgatcgaccggaaatgccaaattttaaagattgatgaaatatcaaaataaggactagataactgcaaccgctttttttgcgacgcgttttttcaaaaaacttggggagggcacaaaggggggaggagtcggcatagccgataaccgcagtcgttttaatgaaatttgctaacagatttgtgtccaaaaatcgaccgaccaaccttacccaaaatgacaaaaaatctcgctaatttttccaaaatccataaaattataatacaaatctgttaaaatatggtcaaaattctcaattttcagaaaagaggtcgtcgcctaggacgacgtacccccatgntcagacatttgcgccgcctatantcgataacgggtttaaattttgtgtttttttcaatctttaagtcataaacagcattagttttggactangcgaaaatgtccgccgcaaaggc

SEQ ID NO: 36529 - DNA, 597 bp, Heterodera glycines
ataaataaatactttttgtctcctgcagcacaaattttgtaaaaccctcgaaaaataagcattttgggacacaacccaaaaaaggtcttctgattcccccatttttaaaaaaattatgctcttcatctttcagctttttgtcatcaacctcctacttttgttgtacatattagcatttggtccgtctcatgtgttccgactgcgcacatttatgtatttgcctcttaatttaacataatttatttacgttcatggctaattaatttttatgttcatggctaaatcgttgctctcccctctattagtgattaatttatgctctctaatacatcatcataataataatttatggacagcggtgccccccccccctccccctcttttcacactcattacggatttgctatatgtatgtatgtgtgtgttatgtgtcagggaaaagcccctccggcgacggggccaattctatggccacaccgattccgtcaattattcattatttgttgttatgttgttctacatacaacacatttgtacacatatttgggcctgcctctccgcctttcatctgctccatgttgtcatagttgtcccccc

SEQ ID NO: 36530 - DNA, 1012 bp, Heterodera glycines
  misc_feature (879)..(879): n is a, c, g, or t
  misc_feature (950)..(953): n is a, c, g, or t
  misc_feature (957)..(957): n is a, c, g, or t
taaaatatgctccaaagatcgtgaaatattcacataaattttccaattgagggtgtaatttatcaaaatttcttgatatatgttcggcatgtagtaaaatgttccaaaatggttaaatgtggtagtaataatctttttaggtgaaaaaatcacgatactgcttaaaatttgcgcaagactggatcggatgggggtgggggcacagtcaagtgaataatttgcgctttctttttggtcttttccccccttcccatccgcccaaaaccaccacagcattgtgaagcgccgctgctgcactctgctgatgatgatgatgatcaaacaataaaaatgagtgattgatcattattagaaaattgagggagaggggagcaatcaatgtgccgacccgatcagtgatcagatcactcaaagaactgcagagagagagctagagaggagagagagagagagagagagagagagagagagagagagagggagagagagagagagcttttggcagatctgaaaaaacccagcgccgccaccaaccaaaacaccgattcacaaagcaaacccatcaaatccctttcaaaaaataacaacaaaaaccagaacgctgataatgataacaatgacaatgatgatgcaaatcagcagcatgaacaatcacaaatcaaacaaaaatcgaaggcgcaaaacaacctcaagaaagacgaaaaacagtccaatcaagcacaaaatcaacaaaatcaacaaaatcaacaaaaacaacccaaacaactaaaagacaacaaaaacaagaacgacgagcaagcacaaaagcaatcaaaagacaacaagaataaaagaaacgaccaatcacaaaaacaaacaaaagacaacaacaataacaanaacgactatccaacacaaaaacaaccaaaacaaccaaaacaaccaaaacatcaaagaaaaaaagcttcccnnnnccancaatcctcatccctagaagttgtcatcgtcatcgtcatcagcagcagtagcaaat

SEQ ID NO: 36531 - DNA, 911 bp, Heterodera glycines
aaatttttttaaattaatttcgtgatttatttgttagcttcgaacaaaagaatttaatagaaaataaaaaaaaattatttcgaatatttttttggttgattaaattgtgagaatgattcaaaaattttaaaattttcaataaaaataaatatgcattgtataaaatttgaaaatgagaaaataatagaaaatgagtgtgattggattggcttattcatcggtcaatttgcgttttttggttcctttttcttctcccaccgtcaaatcaatggccaaagtcactttatcttcaattttgtcgtaaaatcctttgctcgggtccatcaattccttaatttcactaatttattaaactatgaaaaaggattttgattgccactcaccgtagaagtaatgaaaagtgggaaccgccacaatttattattaaaaactctgtctaattggaaagtcaaatccttcgttccgctcttttgtgaaacaatcaccgtaaaagtaatgaaatatttgaatccccggtcgttctcttccttgttaaaaacatggtcaatttttttcgttaaatcctccgttccgttcttttgtgaaacaattcgtagggttgccgaacattcgaagctccaatttccatctttggtaatcaaaattaattaatgcaattaaaattctcaattttcaccattcgttggagggacgcacaaaaggtaaatgcccaaatatttctctgtgctgtcatttttctttgtaatctgtgcaagtattttccacggaagtccatttatgaaaacatcggtgccactgtttcgcctgctccccactccctctcgcgcaaattccgaaaatttctcaatttccaacgccagggtccctctgttgcctttggctatgttccaatcagaaattcttcatgccat

SEQ ID NO: 36532 - DNA, 1053 bp, Heterodera glycines
gggtcttccatttgctgaaccctctccaaagattgcactctgtcgatgagtttcgaagtgccgttctttcgtccgattttttggttgtcggccatttctcattggatgtgtgtcatttttacccaactcactcagttttaattcgaactttttgcttttgagggccttcctttgcctcgttcttaccacgtttttctcaacacggcttttaaattggcaaactttcgctcgtccgtggcttttgccgtcgttctcaaccgcgcattggcacttggccaaatgggcttcgaaagtgacaaccaagttcacatgtacaccttttacgaggatagtccgtccatgggattaattgcgtcgacggaaattcagccgaacaatgcgaaatcgcaagaattggccgattgggtgaaggggcaaattgaggggaaatttgctgctaaaatagtgcacgaattggaattggaaggtgagtaaatgtgggggaatttactggtacttttttattataatttgatgttttttatattttgattttttttttgtatcccccagaaactctcaatttttcattttttcccctcgtattttccctatgatttgccctccctttttctgttttgtcccatttcccctcctccttttggcacagatttggaaaatgccggcaaatccgacgctctcttccgccgtttgtcctcttcctccgccactttggtccttttctcccattcgcttggccttcgttcgcttagtcaaagtcaaattgcgctgcgaaatgtatgaatgctggggaatccctccgtaaatccgcttccattttaagtttgtcaagatttttcatcattgtccaccgtttttggaaaatttagagcggcggtcgatggcggagggtttttttgttgcgtcgtccctttgtcaaatgttaggcaaaacccaaaaaaatgcgaattgagcgttgaacagggccaaaaaccaatccaataaaaagtcccatttgaatgggttttccttcccctttaattgggttttggggttgcgaccaattttcaaaaa

SEQ ID NO: 36533 - DNA, 954 bp, Heterodera glycines
ttcatgataattgttttataagcagcagcaaatggcatctaaaaatgctgttggcactttgtttctatcctccggcaccttttttgaatttggcacaaagtctttttgtactccgtcatttcgtgggtttggcactctgtttgcccccccccccggcattgtccctctctccgttcttctcatccctgttgctgttgctgcaccaatttggtgctgcccttcgcatccctcacacacttccaaatgccttggctgtccctaatttggccattcaaagggattcggtcgcctcgtagcgaaaggcatccgaccacctcaaaaggggtaattaataatcattagtgtcaaattgctctcatttttccaatttttcttacccgcgtctcccaccgattgtaattgtaaaatacaaagcagcgcataatgaacaaacggttgacaatctgtttttttaaagaaaggatttcacattataccagttaattacgcaaaattttccaaattttggcccctatttatttgctttatttgaattatatgccaaactcacccattcctcgccctctcggtattgtctgccttggtggacacacgtgccatgggttgcgcgacaatcgatgggcccgaacaatgccaaaatgccagccaaaatggcaataattttgaaagcaagcgattgatgcattatttctttagtttttctaaaaaatatatttatttaatttaagtgtttaaaatgcttttcttttgaagcttttggcaattatcagtgagtataaatatttcacaagtgaaatttgaccaaagaatcattcgctggcaaatgaattttttgtgttcaaagcactgacaaattgacgaacacaactgacggattgccacacgcttcccactcaaagtttttggccctatttttggtcgttggcttatgctttttgtccatgatcaatcatt

SEQ ID NO: 36534 - DNA, 923 bp, Heterodera glycines
ttaaaaaagctgtatatataaaatgtatcaaaatgttcgcgttacttactatctaaaatttcttctatgtacattttaatagaggatatgccgaatccgctaatggcgttcactaacgtaacctaccagggatgggccaaatcgaaaaagcaaatgcgaaacgcgaaaaaccatccctgtaacctaccaccgtcattacttaaatgtgagaaggaaatgcctggggcctatttcaattcgcgtcgtatctctgatatgacgtcgatcgtgcaaatttttatcaattttatcgtttcacgaagtcacatcgaatttattatgatcaacgtacaaataaattttaaaaacccaaaagtaaaaacgttacaattaatttattaattcaaataaagttaataaacattgaattatattttaaaaaccaaaagatttatttatgtttttcatatcattaaaaagaggagagagcatattctataaaacaaaaaaatttaatgtgtattaatagttaaaaatttatttttatgaatttttaatcttaaatgatcagaacaaatacatggattgaaccacatacatataatagaaaagagttaaacaatgtgacgtcatatcagagatactaatagtgaaaattagagaaattaatttaattgcgtttaattaatatttgtactttgtgatctgtcagcagagacatttaaatttttatgtgtccataaataccgatgatccctttcttctagggaaacacatttttccttgttttggtgataaaaaagcttttctgacaaaattctgtaagtcaaattaaaaaacctattcaatttcaaataattcacatttgttttccattttaatatttgctcagcttttttatgtgagtaatttttaattaattaataaaaccaaaaagctaaaaa

SEQ ID NO: 36535 - DNA, 327 bp, Heterodera glycines
gtcgacaattccttggcaagcgttcggcgccccttggtgaagccgcggtcgaatgagcgctttttgcattcgagtccactcttaatgataaaagggattaattaaaagggttaaaaacaagtgaattgactgacaatgagactattatcaagaaaatgtcaaatgttacaatttatagtacccaaaaatgacattttttgcaatttttttgtaaaatcaattatttgggactaataaggcaatctgttgttaaactattgaagcatagatttaacgaagatgttcagattcggattcgaaagttcggaattggtgaaaaaaatgatt

SEQ ID NO: 36536 - DNA, 684 bp, Heterodera glycines
ttgccgaaaggtcaattcaatggccaaagggtcgtcggattcacttaaacggaaagtcagtcgtaaaggaaggcttcatttgtcaggaaatgatggcaacgcacctttggtgggctctaaacaattctttcttaaagaaaattcgccaatttttttcgcttttcgtctcaagcgatgcaattgcgtcaatctgtaaaagataaattgtttttttggattttaaagttttatctaattttaccacgcattcggagccaacgcccaaagaacgaataaaacggcgaccaacggcaagaaaaaggccgaagccaaacgcatctttgagacaaatttgttggcacaacatttcgcacaattcaaaggcggtcgattgcgagtccgaaaataaaaacggattaaataaattttaaactgaaaaggaaaacgaacgattggcagtgaaatgactcggccatcggtcaaatgaatcggcacaaacatttgggcgtcgtcgaaaattgagcagaacagttcaacctaattacgaaatgcaatcaaaatgggtttctgatttatttgattgaatttggccattgttttgtcaattaccgtatccccccgaccagtaccgtatttagggggggggggtacacggggtacgtaccccccccgcgaacctacggggctgggcgaaaagagaagagg

SEQ ID NO: 36537 - DNA, 919 bp, Heterodera glycines
  misc_feature (859)..(859): n is a, c, g, or t
  misc_feature (895)..(895): n is a, c, g, or t
ttcaaatttttaaaaccttaaaccagtaattttttacaaaagaatgaaaaaagcattttttttataaatttcaatttttgacatcaaaatgttaattttaagaaaataaattatttcattgagaaaaaaattgatcaattgtaattcacaggtattttaaacataaaaaattttgaataattatttttggatttttcaaaatttttaattgtaggaatatattttttgaaaatttcaattttttttaaatatggtttctatgtttctatgcggttaatattgtcgttaggattactgttgttagttacggtgtttttttacggttttccccacctacagtacttcactcagtcgggcaaaggggaaacgcgaatcagcggcttttgtggcgacggtaagtttattattagtagagatcgatctgtacctgtggatccaggcctggtttttcctggacctggatttttatccaggaaatccaggtccaagtccaggcaaaaaaacacgaaaaaacctggatttcatggataaaatttatttcaagtgaccgatgtcttttcatgttttcaaaaaatgattaaaaagattaaaaacagtatattattgtaaataagatatttttaggtgtttcccaagcaattaaatgtttttttcaaacatttgtttgcttttaaaacaaatttcaaaaaatccaggtaaaggtatggatcaggtctcgaggagcctggatttttcctggacctgtattttatccaatatggaatccaggtccaggtccaagcttttttcaaaatgtcgagctgtaattattagcattatgataaaattaatcatcacagataattggaaaaaaactatncaacatttacagtatctgtaataaaattatttgtangcaagttcggaaaactgtactgct

SEQ ID NO: 36538 - DNA, 902 bp, Heterodera glycines
cggaacggattagcatcggggttacgagatactttttgtcctaaaaagagatagccatttttctgagaattaattcacaatttccgcagctcttagggtaaggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttcttagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatc

SEQ ID NO: 36539 - DNA, 887 bp, Heterodera glycines
catatcatccaagggaaggggtgccaactccttgcccaattgtctatcggcatacggatgaagcgcagtcgacatccaaggccgctgagctaatggaagttgatgaacatgatgatataatgatcatcgaaccacagacaagtggacaggcagttgatgccattctcacccaagcccaagtggccggtgaaaaccaagctgacatgcttggtttggtgtcggagtcttgcatcccgcaagaaccaatcgcgcaggctgatgatgtaatcttcgtcagacctaagacgccaccaaggcgatcactgcgcgtgcaaaaaaggctttcagcttctgttagccgttcgccttcaccggcgccaaaacgacccccgccagcaaattcgctgggaatggcaacgccgatcacacggcgttgctctgcatttcacaaggggtggcaatgcgctgcagcagcagccaaacatttcccggaatattgtgactccgggaaactcggtgacaaaaaatgcgccgattgcggtgcacatctcttctcacatgaagacagtaacatttgctgccggaagggaagagttgtgctgccaatgcttaacccgcatcctgacgagctcaaagagctgattgtggggaataagcaatcccgtgaagggaaagaatttgtgcgacacatgtcgcgttataacaacctgttccaatttgcgagcgtttccgctggcaacaaaccaagccctgctggcggtccgatggccgttattcttaacggagaattccatcgccgcataagcagcatgcaggctggaaacactcagattcctggttttggccagttgtacattctggaccccagtcgaggctatggaacaacgccaaaacaccccaggtttact

SEQ ID NO: 36540 - DNA, 939 bp, Heterodera glycines
  misc_feature (807)..(807): n is a, c, g, or t
  misc_feature (862)..(862): n is a, c, g, or t
  misc_feature (889)..(890): n is a, c, g, or t
  misc_feature (900)..(900): n is a, c, g, or t
  misc_feature (907)..(907): n is a, c, g, or t
  misc_feature (912)..(912): n is a, c, g, or t
gaggaagagaacacaccgtacgactttatagccaaaataagcggtggatttgaagtaatcttcaggaaagaacgacgagttgccaagacgagtgttgggaaaagaatggtgttgaaacaacggcagatgaacggcagcgaaaacaataacaacgcttatcaaaatcgcgaaggtaaaatctcggtcactgaaaggccagccaaattaattttaattttgttagtgatcgttccccttcttgttttcccacataaatgaaacttgtttaggtaattttttgaaaaaaaaattattttttatcaaaataagcaatttttaaatttctttttggctaagcgatactggtgagaggagcggaatactgcactcgtttttttaatatttgtaattgtttttcagttgaaatcatgcgttcacagaagagaaacattgcgatgcctccaattgctgaggaaacttcgttagtgcaccgaagtgagatactgcaacgattggaccaccaaatgcgcaaaaacccgaacttcgaaaatcgaataaaatcaatgctgagagtttggacggacgacatgtcatcgccggccattggcacttcaattttggagttagtcacttggcacgaactccccctttttagggtggtgccttccttcccattcatcctacagcaagagggaaaaggtcccaccgaaagaaaatcattcactcactggtaataaattgggatgacattttggcaaatccataaaacttagtttgcgcttaattcgctcacataagcacgaaaactcattttccaacttggtttgnggattctgtgatgatttttaaatgcctatttttgcaccttttagggttcttgtgncaaatgccttggcgcctattttcatannattatttaancaaatancatanaacgagaaatatgacccgaaaaattcc

SEQ ID NO: 36541 - DNA, 850 bp, Heterodera glycines
catgaaaaaattttaaagatttttgtttggatttttcatgacttggactcggtttaaaaactaggactctgacccggctttctgtacccggcaataccctgacccggtatttgcccaaatacccaggcccgtacccctaatttaatatacgattttgaagttttttaaattaaaaataaggctacagaaaaaattgaaaaactctcgcctctcgtcctctcgcctctcgccaactctcgtgtttttggggactctcgcctctcgccaaactctcgctctcgtctttttggggactctcgcctctcgccaaactctcgctctcgtcttttctgagacaagtcacacccctggtacgtaccccgtgtaccccccccccctaaatacggtactgtacctccttttgcaggtcctgcttctgcaggatcagctgctggttcttctccttgacctccttgcacttcttctccaactcctccaccccggcctgcttcgtcggccgttgattttgctcgtcctccaaccgcttgcgcaaaatctgaaaaaataatggaatttttccaattaaaccgatgaaaatttctgggataaacaatttgaaagaaaaattgccattgttctctctgtcttctacacctccaccaacgcgaagggagaaaagaggaaaatttctgcaaaaatggcaacaacttttttttaaaaataattttttaaaaattcacaataacttcccccaacggcgcctatcggcaccgcctgccccaaaaaatacccttaattttaagatttaaccaaaaaactgggcctttttcggcttgaaaatctgttaaaaaatgggaaaaattccaatttt

SEQ ID NO: 36542 - DNA, 947 bp, Heterodera glycines
  misc_feature (716)..(716): n is a, c, g, or t
tctgtgtttgattttttaaataatttaatgcgttttttggcatttgtattacatacatgaaagttgaatttcttcgaaatttttctttaaaaaatccacttttttacaaattgtagaaaaagagaaaaagatttgaaaggaatcgaacccgggggaggggggttccccgatttttcttaaaaaacaatttataagaaaattaaagtcaatttatttttttattttttttatcgggggcagggaggatgagcttctcctgcgaaatggcaaaatatgcactgaatccaaataaaaatgtccaacaacattttatttttcaattgtctgtaggtgggctccttcctcggcgcgtgtgccatgtttccgctcgtcaacattttcaaggtgttcaagaagcgggacccgtgcacttgagattgattgaatatgatgaaggcaattcagtcaaaatcagagtttcgtcacttttatccccatttttgcacacaatttttgcgttttcacattccattcgtttcttttaaatttttgtcccctcttattctatatgtgccaatatgtaatgtgatagtatttaaaatgcctcaaaataatctaaagaaaatcaattttttatcttaatttttccaaaataaatttaaatgttcttgttgatgaacttgatcaaacttagggatgaaatgaaaatgatttcagaaagggtctgtgtaatcgtntttggcgccagcccaagttttcggactataacttttttcattgtcatccatatccaacaatcttggtgtcattcgaaagcttaacatgtttagaagctatttctaagctattgcttcgcgattaaacaattaccaaaaaagttataacatgaaattgcaaaaaagtcaaaaattttgaagttttttcttaataactctttttaaaggccaaaaattttttttgttttttgt

SEQ ID NO: 36543 - DNA, 1181 bp, Heterodera glycines
tttttttaatttatttaaaattttattgtagattttcattcagtattttggaaggttttaaacccgtcattattgaacgcctttttctttcgaaaaaaaccaatataattattgcttatatgcaaaaaaaatcaaattaattctatcttattttagaatctaatattttttcctaaatttatcaagatgaatagagtcggagaaattttatgaaaaaattcaaacgctttagatttaagcgcatgtaagttttttcaaaattaaaaatttaaataaaccaacataattcgtatatttgaaatgacaataaatgaatgtgctttttttctcttaccatattccacttgcccatcctcttcattatgctcctgctgctgttcagtcttgacatcattgacatgcaaaaactgacaacactctccggagtggatccttccgacatctctgtcgggggggggggggggggggcgtcggtccctttgcttccaaatgactcactctgttcacaatgtaatccaacagttcaaaaatggccattgtcttcggcgttaggtcgtccgccgtctgttcctcctccgttccgttcttttccattttcacatcgttcggatggaccccgaaaagtttggcgtactctctgcgcgacggggccgggattgggtagcggccgatgacgagttcgaccagcgaaagaccgaaactccaaacgtccgattggacgctgtagcgggcgccggtcaaacgttcgggctgaaagaaagggaacaaatgactttcgaatttgctttttaaatgcaacagatgaattccggcatgacccatcccctctcaccgccatgtacgagcgcgtgccgacgaaggaattggccatgctgtcgattaacatgcaggagactccgaagtcgcacagtttgatctcgccctggctgttcaccagaatattggacggcttcacatcttcaaaacacatcaacaacgacaacagttttagcacaaatgccgaaaaagtcggaccgacccctgtgcaaaatgttgaactgttccttcagataggtcagtccgttgatgaccgccaccgctattcggcccacccatttctcctcgacgcgaccgaccgattgaagcactatgtccagggaaagaccgtccatgaattccatgcaaatagaaatgtcattgtt

SEQ ID NO: 36544 - DNA, 1480 bp, Heterodera glycines
  misc_feature (841)..(841): n is a, c, g, or t
ccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactaaaaaaatatgagtgatcaaactttcactaaaaagttaagcctaaactttttcccaaagttaaaaagcaattaaaattttattcacctccattattgatagaaaaagcatcagagtgcctaaactaacatgtaaataaaatttggtgcgtttcagaaccctttctgaaaaaatatttatgaattaattttgcaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttaataattttcctgcaccgaaggtactcactcggcctcttcgcggcctcgtggtgggccttcgcccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcggnggaccgtgccgggtgccgcggtgtaagcagtgctggttcgtttcatcacggcaccgacctttttgctagtcagcaatcgttgcttaactttcagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttaaagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttt

SEQ ID NO: 36545 - DNA, 1427 bp, Heterodera glycines
ccgcttaaaaaaacaaatcaaatttgtttctttaatacagctcattccggtaattcacctcatacggcttttccccagtgtgcacacgccgatgattgaccaaagtgttcgaatgcgcaaatcgctgtccacaaaagtcgcactgtttttttttaaataaatgaaataaaaattaattttaaaataaaaataaaatgaatgaaaatgattgaaaataaggggaaagacggaaaaaagttccaccttttacaaccaaatgctaatccatatacacccaaaaattgcctaaatttttaaggtcgaagcacaaccaaattttaaattcaaaatttcaattttcaactcacctcatagggccggtcgcccgtatgaatacgccgatgacagtcaagatgattctgttgagcaaaggccttgtcacaaaactcacactgttttttgaaaaaggaaaataatttaaaattcaaacatccaaaatccataaaaaagaatttgaaaatcaaatcccaaatcactcaccccgtatggcttttcaccggtgtgcgtacggcgatgattgtgcagagtttgacaatgcgcaaatgttttcccacattcagcacactgtttttaaagtaaaaaaataaaataaaaaatttattttttaattttttaagcgttttttgtccgtcttaataattaataaaaaaaaaatatttttaattaattcttattttactcctaatccttaattgcatcaacaggcatttattattgctattcatgtgcaccctttcaattctgatgacgtgccaaaactttttggacaatatgcgcaaatctttcctttttcgtttgccattttcggtttttgtgccatcggtctttgctgctggaaaaatgtgacccataaattcgggatttggcattttttcagcaatattttttgtttttactcaccaaaattctgctcttctttcctcccaatgccccctcctcttcatccctttccccttccaattcgtccaaaaattcctcctcttcttcctcctctttttcttctacctcattctcttctccgacaaattcctcctccttttcttcttcttcttcctcctcttcatccatcgtcccttccaattcctccaaaaatgcttcccttccatcctcctctccctcttcttcctcctcctcctcttcaacaattgattcttcctgttcgtcctcttcctcctccttttcctcattctcttccccatcatttgcctcctcccctcgtcctccattctctccttcttctcctcctctgccattttcttccttttcctcttccgtgttgttgttttgttcaaatttctgcttcaaaaattggtcgacaattgctttgatcagcaaaagtgtataaggcaaacagcggcgatcagaagaaatgccaacagcaaaaaatg

SEQ ID NO: 36546 - DNA, 1562 bp, Heterodera glycines
actagggaagcaacttttagtgaaaaaactttttttttgctcatttgttttgaagaaaggagctcaaaaaacgcatttctgcgttaaaattttttcatttggacgtcacttttcgtcactggaaatcactattttggggttttgtcactaaaatagttaaaaatcactattttggcgttttgtcactattttttcactatttcgacattttttggaaaattctttaacaaaaatgcaataagaacaactaaatatcgcaataattgttttttattcttaaatttagacttaaaatatgccaaaaattaaatcaaaatcggccagctttcgggaatggattcgaaggatcggaggaactgacttttattcaacaactggcaaaataatttattgtcaattatgtgaacaacaggtaactgcgacaacatccgtcgaacaacaacaactaccaataaaaaattcacagattccttgcacgcaattcgcgcatctcaaacaacacaacgaaacggtaaagcacaaggcaaaattggaacggaacaaaggaggacaacagcagcaatttttgacaacaccaaacaatgttccaaatcaattcaaccttgatttgtgtgaagcctttgtctcagctaacattcctttccaaaaattggagaatgaaaaattcaaattttttttgggaaatgccccatcgttacacacttcaaaaaaattacttgcggttgacttttgaccaggtcattcaaaaaacaaaaccaaaaacagtaattcattttagacaatagagaaaattaagaggtattttaggcatttgcctcttctttaaaaaaaaataattaaatgtaaaatgccattcctaaataattaccagccctagtaatgagcaataagtgtcggtgttttgcctttatgctattgattttgccgtttgtccactccgcttttctgcttctccttttcaatgtctcttctccctttcgttggcatttatctttccattctcccaacaacaataataataaatccatccattctctgtgccgttttaccaacatttttgatttttccatcactttcttagcttctttgaattaaattttattgcctattttttgtatcaaaatatctaggcaaatttatatgacaaaaaatcactaaaattattattttttatccgaatgtttagttaatttgagcattttaactgtgtaaaatttaacgaatgtcaaaaattacttgtaaatatttaaactcatcttggaaaaatttaattcatattattttgtcacattcctttatttttaaatattaaaaaatttaatttctttatcaatatgaaaaattaaaacttttttttaatattattttcggtgttttataataagattatgcacaaatatttaggggttgggtaccatgcataacattcatttccctctttaattagaaatgacaaaacctgacactttggcagaacgaatgaatttgttgctaagcactggccttggtgcggatgtgtactttttagtcggagaagcagacgcaaaagaggcaaatgtgaa

SEQ ID NO: 36547 - DNA, 1259 bp, Heterodera glycines
acgtagttgtccaataaggtacttggactttccgcagtaaaatgtggtacaaaattttgaaactgtcccgcctcacggcggggcttaaaagcattgtactgcataattaaaagctaaaataattttcgtatatttttcacaatttatttcaaaaacccaaaaagaatgattcaattttgaaacgaaatagtgcacaaaagggagggatggttagccgaaaagaggaatttttagaaaagagcgcccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaagacaaaaaaaatgattcaattttgaaacgaaatagtgcacaaaagggagggatggttagacgaaaagaggaatttttagaaaagagcgcccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaagaccggaaccaattttaaaaactaaaatagtgcacaagaggggaggcgccgcacagagggggttataagcattgtacaggataattaaaaccgataataattttcgtatatttttctcaatttatttcaaaagacaaaaaaaatgattcaattttgaaaagaaatagtgcactaaagggagggatggttagacgaaaataggaatttttagaaaagagcgcaccccgtctgatattcccatttttccgttccacaactggaaaaaggcgactgtgcttattgacacgtttttgtccaataaggaacttggactttcccctttaaaatgtgggacaaaattttgg

SEQ ID NO: 36548 - DNA, 1351 bp, Heterodera glycines
tattgataagaaggacgacgacgcatccgactttaagccggagactgtgcgggggcatgcccgagtctgtgcgccggttcaacgcagccacttcggactcgatctcatcgatgtccagtgggcggtcgtcaaggggcttatccgtggacaagtattcccgcacttgacctggcacattcgccatcatgatctcgttgacttcgtcgtcacgtgtcaatgtgtggagcgagaatcaaacgattgagcagctccttgtcattgccaaggagttgttggaagttaggatagacatagtctatcagctcttccttgctcttaacgaggaactgcggaggaatccagaagtgctctccggtttctccgagcccgatttggcggcacatttgcaagtacgcttgctgaccttggcccagtctctggttgatggtcaatttcatcgtggtgaattgaccaaacaacggagacgtttgaaaacaggctgtcacctgagcggttaagccttcatgaggcacgaccggcagcgactgtttgaagtcaccgctgaaaatgaccgtttttcctccgaagaggagatccttgtgctggcgaattgccatctctttgcacactcggtcgatgacctcaatcaccgtgttgtgaagcatggtgatctcatcaatgatgatgagttgggcctcacgaatccgacgggcaaagaagctctccagcggaatgcttgggagtttgtctaatgacacttctctacccagacgaaacgtggaatgggctgttttcccatatggcagcaaaatggctgcacacccagtggatgccgtagcaagcactttgtaggtgtatggggcctttcgcaagcgcctaataatttggccaaacaggaatgtctttcctgtgcctccatcgccgtatatgaagaaacggcgggggacagtcgaatccctagggttcgactgtattgccaacaaaacagcatcaaagaccttctgttggtcgctgttaagtggcggaggggtatttggctgtggacgaggatttggttgccctggaggcaaattcaaatcatcatcgccaaagaaaaactcttcaattgccgcgtcagtatttttggcaattgaagttggcgggtctggcaggctaaaatgcacacagcttaagttaaagcagctgtgcagccgccaatcaatgtcggctagggcttcaagctcttctactttatgctgtgccagagtaataatgccttgcggattgtacatttggtctttgtacttgttccacaattctatggcattactcggctggccatagaccaggatgctcacaaaaagccatctcatctgatctggccagcgcgaca

SEQ ID NO: 36549 - DNA, 594 bp, Heterodera glycines
catcgcaaataaaaatttacgaccaattcttccaacactttgcgtacaaaacaatataatgtattgtcctttctccgtcatagcacttgggtaaaaatgaaaaaggtgtggaatttcacgcgacggcgcaataaacggccaaagcgaaggtaaacagcggaaggaaatgggggaaaaggggaggaaaagcggagggaagggacaatgactccccgggggaggggggggggggcattggcggattaacgacgaaccaaacgaaagtgcgggaggaggcaaagaagggcacactgtagggtgggcaattaccaattgataatggaaacagcaaagtcgaaaagtggcacacacacaatgccatcccatggcaatgccatcccatcccatggcaatgccatcccatgccatgcccattatcccttccctttgtcccccccccctttcagtccctctttctcatcgtcattggctcgctttgctcgtcccttactccgtccttaattcgttgctaaattcgtgccaaatatgtctttgtttgttcagcttctgcccatctgtcaattcccttcctaaaactttccctcatttctcccc

SEQ ID NO: 36550 - DNA, 690 bp, Heterodera glycines
gttggtcctcaaaatcgttaaaactatttttaaaccagcaatcagaaaatggtaaaagaacgtcaaatataaaagattgaagcggatcacgcgcggacgtcttcctccgcccttcgtctcgccccactacttgctccgtcttcgcatgctcccttttgcggaatttagattgccttcgattttgggtgtttttgagtttgggagctcagataaaccattacccctaagcctaagctgaagcctaagcctaggcttaattttgaatttagtcgcaaattaaattccggttttttgttcgagtcatggttcggtattcaaatttggtcaaaatggatgtcataactgtgttcagcaacctcaaagccccctataatatgttttcgtttaatttaaaaattttgagtttttgttcgaatttgggttcggaattttgcaaaataaaggtcatattcgtgatcagcgccaaaaattaccatagaaaaattatttaaaatgtcttttgggtgctttttatagtgcggtcacttgagtcccagctaagtttggcactccaattccggcacttttcagcctgaaaaagggcaagcgcgcccctaattctatttttccaacccatttcgaacctttttacatcgattctgaccgtttttaagcatttttgagtttggggcctatgatcaatatttacca

SEQ ID NO: 36551 - DNA, 926 bp, Heterodera glycines
  misc_feature (867)..(867): n is a, c, g, or t
  misc_feature (877)..(877): n is a, c, g, or t
  misc_feature (896)..(896): n is a, c, g, or t
ctgttgcactcagcgacgagtttttgtttctcggtgaggaaaagtctgcagatctttagaaagtcggcattcttcctaaatttgtttgcctttccattcactccacggtgcttttcttactgaaacacttcggccaagtcgggcttccgagaatccctaacaaataagtttgaaatgcatttaatgtaatttatattttaattatatttactaaccatttaagaattttgtcataaaaattatgcaaaaacgtaagatgaacatttaaaatagtctgaaagtgatccgcgattcgtctgatgacgtgtttggaatggagcaattttttgttcattcttttttcacagtcattcaaatgcctaaatgaaataggtatttgagaaggtatttataaaagaaaatgacaaataaaacaacaaattgcgacagttaaaaacggcaaaatcacctcggataattgagcccaatcagttgcaatttcataacataagcgcgttgtttctgataaatttctaatgcgacttcgtgcaatttccgcagccgcaaattctgataaaccaataataataattgccataaatgactctgtctgttgtttgtcttcgattcgtccattttgcccacctctttttcgtccgtttcgctgtattggggaattgggccaaaatgttccacaaaaaggcattgctcctcctccgcctcagcgcatccattctttgagctgatcaaactgctcgttttcgtcggttggacagtcccattttcagaagaatgtccgggctgacaatgagtggcccgggggcgggtcgctggcgcagcctttgcgggaacattttctgtcggatggcaaaggacgatatttgccanactccgaagngattctgaaacatttagtngaattcgaattaaaagaaagcaaaggaccc

SEQ ID NO: 36552 - DNA, 980 bp, Heterodera glycines
aggggtattattttgtaaagtctttttttccccaatcttcttttcataccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaattttatttttattgaattctgaaccggtttgagtagattagactagaaaaaattgaaaattttgaaatcatgtttcccactcccttctcccaggggtattattttgtaaagtctttttttccccaataacttgtcaaaccccatttttcgcaccgtgaatgttatttttattgaattctgaaccgttttgagtagattagactataaaaatatgagtgatcaaactttcactaaaaagtaagcctaaactttttcccaaagttaaaaagaatt

SEQ ID NO: 36553 - DNA, 870 bp, Heterodera glycines
  misc_feature (752)..(752): n is a, c, g, or t
  misc_feature (757)..(757): n is a, c, g, or t
  misc_feature (792)..(792): n is a, c, g, or t
  misc_feature (799)..(799): n is a, c, g, or t
ctttctctgctaagtctgttttttacagttcccatggtaacaaattcttttacacgagggaaagggaggaaagtgttggaaatgcgatgaatgtgtggcctttaagaaggaaagacgcgctttgtgtcttccgtttcccattacgttttattgtaatgatattttcactgacaaaacaatgtttttgtagacattagcatggtttgtaatattcgataatgtgtgaattcgctcgttgctttaacaattgcccgggggcaaattgacgggaaacgaacggctgaaggggccgggggggggtcagtcattcgctcttcgtgtgccttccttccttcactgatgcatttgcaaaatgccggctccgatgccacagccaactcctttgggtccgaattgttttgcatagcaatctgaaacattctgtgaccttctcagagtttgtgatggcaaactgttgcaaaagatttcgccgtctctgtccgaaaatttccccggctccaaagaacggccgcagcggagacagcggaagcagcgtttgtgccaaaccttcaaaaagcaatcgcaaatgaatagagtcgcccttcccacgtcacctccccggcggcgattagtttttcggcttcaaaagcgcgctgaaggcaccttttgcagacagatgcacgacggacggacaaagcagaccgacgcgctgactcaagcggaacacgcggcggaaagaagcggagaacagtcgccggcggagaagctgacgngttgnggaggacacggcgaactgcacgcgatggaagaggncgacggnagggcgagtccgcctcctcctccacttccgggatcggacttgtcaacaattggccaaaacgcccgcctcgt

SEQ ID NO: 36554 - DNA, 668 bp, Heterodera glycines
tccgggaaagttcaagcaagaagtgagccctcaactagactcgaagccgaataaattagattttttcgagagtcgcagtcgagactaattagcattgattccggcattttgggatggttttccaataaatttagatattttttagcacaataattaatttttaactgtaattaatgactaattgatagtgaaggcaggggattaacaaattatcctttccacggttttcccacttttaaattgcccgccgttttgtctccgccgttattcattcaccgataagtacatatgtccactgatacaataaatacaaactttcttacggatcccaacattagcagcagcagcagcagcagcagcataacattggttatgattcgtcacaaaagtgtttatttatttatgcccccgggggtgggggagggaaaaagcccgttatttccccctttattgacataaacaaacaatacaacaaatgccatgttatgctactcaataattggattcccatcaatttttttgattatttattttctattcccatcgcctacgatttttgtctataatctatggtgctatgcgttgatggtgctggtatattgtatattcagtctagaaaactccggtgaggccgtccacaaattcatgacaccgagccacaccaatta

SEQ ID NO: 36555 - DNA, 1034 bp, Heterodera glycines
cgttggatttttgctccccataaataggtttggagtaccccaaacaggacactctgaaaaaatcgatttttttcgttttcggggcagtccccccgaaccgatgcgcccagatttatggggagaccgaatccttcgggaatagcttccctatagccagtactttaattctgcgttggatttttgctccccataattgtttgagtaccccaaacggacacttgaaaaaatcgatttttttgttttcggggcagtccccccgaatttttcaagtttcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctccctttttgatagaaaaagcatcagagtgcctaaactaacatgtaaattaaatttggtgcgtttcagaaccctttctgaaaaaatatttatgaataattatgcaaaaacaataaataatgaactctct

SEQ ID NO: 36556 - DNA, 1034 bp, Heterodera glycines
agatgccctcgaatgcatgaaaataaggaatattataagctgtcaccggataaaaaatgattcaaaatgtagccagaatatagctttcacctccccaaatctactgttcaatttcgaaataatgaactgtgtacttttactaagatgtgtttatttgaaaaaggttggcctttcaaaaggctctctgaataaaggctcacagaattcagctccaattattttgccgatattagaattttgtacggttaaaataaagattaaaataatgtattagcatttggttttcaaatataaaaagaaaacataaatgacatttgttataacttaataaagcttgacaaaaggtctatctccatttcttgcacactaaataaaatttaatctttatccacccagatgccctcgaatgcatgaaaataaggaatattataagctgtcaccggataaaaaatgattcaaaatgtagccagaatatagctttcaactccccaaatttactgttcaatttcgaaataatgaactgtgtacttttactaagatgtgtttatttgaaaaaggttggcctttcaaaaggctctctgaataaaggctcacagaattcagctccaattattttgccgatattagaattttgtacggttaaaataaagattaaaataatgtattagcatttggttttcaaatataaaaagaaaacataaatgacatttgttataacttaataaagcttgacaaaaggtctatctccatttcttgcacactaaataaaatttaatctttatccacccagatgccctcgaatgcgatgaaaataaggaatattataagctgtcaccggataaaaaatgattcaaaatgtagcgagaaaagaattttcaactccccaaatttactgttcgattacgaaataatgaactgtgtacttctactaagatgtgtttatttgaaaagaggttggccattcaaaaggcactctgaataaaggctcacggaattcagctcccaattattttgccgagtattagaattttgta

SEQ ID NO: 36557 - DNA, 1138 bp, Heterodera glycines
ttacagtaagtaacaaaagtatatgctcatacagtatcgcagaataaaatagtgggtaaaattccaaaaatacaaactttccttacactaacttagccccgtccataagcattcgaaggaacccaaactcttttcccttctatcgctatgagaaatgcctaagctttgattaagatttgatttcctatgaagaaaatgccgaagaattggtgagacttgagtccagatgaagaaatgtcaatgaaaaacgagaacaaagatttaagaatttttgggatttgaatccgatgagaaaatgccgaagatttgttgtaaaaatgattttctctgctctctctatttattgactcatctctcgttttttaggatgcttatatatgtatttaaaactgaagcccggaattctgaaaaagtcgggagggatttggaattggcacccattgataaaaacctgctgctgctttgattacccaatttggtaatgaattcagccattttttgcatgtgtttcgcttttggcttcgtctgtccgtccgtccctttatctcctccaatggttttgttgccaatttttttggttgttcgccgcgactgatcatcaacagccattcttggcccagtccatctcggcactctccgaaccgaccaattcattaactaattaaccaatgcatttattgctttgccgcattcccttttgctccttcagaaattaggaagaaatgaacggaccatttatgaaattatttgcctaattggtttttggcggtggcggcgcaccaatcgcagcatgaaaattgcacttgagcaaaaagcgagctcattttcaggactaaaaaagcgcgaaagaaagtgcaaaatgagaggacattgtgaaatttaattaaatgaagaaaagggcaccgaaagaggcgtatttaagacgaagaaagagggaaagagaaggccaaacagagaattagtattttatttttcatttttatttaagagaattaaaattgaaatgactttcaaagctttgcgtggcatttcgccgtgctccaacgaaaaactgaaggacgaagtgcgaaggcagcagaagaaggaggaggaagaggaagcgaaaaaggtggcaaaggacaacgatggcgaggggtgg

SEQ ID NO: 36558 - DNA, 830 bp, Heterodera glycines
acaccggcgataaacgccgccatttcctccgatgaaagcgattggattccgtcgagagaagcgacagaacgcgtagaagaagccaactgaaaattttttatgagacagacttttgcttcccttccatttattcgtccctcttttgtcaacccaaaggaatgaatattaaaattgttaggcaccgaccgattcgttgtccaacccatagacggaactgcgccgaatttgtgccctcgccgccttttctgcattctaatggaaagaaatttgaatttgcattttaaagtgctaaaagtgggggaggggaagtaaactcccttctgtctttttgcttaaattccaaaattctcatccccgaaaattcactttcgactccaattgcgcaatttgttgtttcaattccgacaccgcctgaagcgcttcggtgtattttagccgttgcatcactgaaaatggacgaaagcgaatgttgatggaatgtcaaaggcactcatttgcccaccgttcttttccttcatttcgctctgtgacacgaccaatttacgctcgttgtctcgcagctcttcgcgaagttcgtgttcaatctgtagttgttcctcaatttaagccatttcattggtagcccatccccgctctctctctttcactatctttcccccatgctctctcactctcattattttcccccctttcaccctctcattcgcaatctctctctttccctccatccctccttctttctatcaagcccatgcatgtgcaaagggaggagcgccgggaccaaatttcttaggaagatccagaaccttctccggggacgacctttattt

SEQ ID NO: 36559 - DNA, 845 bp, Heterodera glycines
tttctttttttatagaatctgagaatttcagaaatttactttcatgtatttaatgaccattacgctatgaattgaataacactttttgatcaaaaagtgaaattttgagaaaacttgaaatgaaaattcccagaatttgttaattgttcaaggattttctatccataattgtctaccaaattcatcttcatttaggtatttcagtgtgttaagaaaatgattcaaaaatgataaaaatttaggaaactcaaaaaatctaggatcaaattcattattttttaaatcatttttttctttttttatagaatctgagaatttcagaaatttaattgaatctatttaatgaccattacgctatgaattgaataatactttttgatcaaaaagtgaaatttttagaaaacttgaattaaaataaaacatggcgctttcttggtgctatcgctgtgccaactgatgatgaggcatttcatcagtcagctcgtgtaaatttgttacaattattttataggtgcaactttaggatacattgcgcactgtgccatggcctcttttttcgtgtgtttacagataccgtaccaattgtaggtgccggcgccatcgttcaactcctgaaagggcatgagactcaacttttgggtcttaagccactgagaagtgtttgtctcgagtctcaagaggtacgaagaaatgacgaaagtcattgccggtggtgcagtgaaaatttgaagttttagcgaaaacctgcccgaacattgggggggaattatccttccctgaggcagagcccatggctcttctatttcgaattttcaatataaaaaataaattgaaaataaataatt

SEQ ID NO: 36560 - DNA, 1016 bp, Heterodera glycines
gaaaaactatgatggaccagcttccaacttcatatccgcttcttgatgattccaccatggaatatttgggataaatttatgaaaaattttttatttaagtattaataatgaaaaaattattaatcggtagattcataaatacataaaataagtgtcttatattttaaatatatttaaatgaatttttcaagtgggtgatggtggtctcttaaacactccaacaccccccccccccccgccccaccaatgttttgtgggcccccgtctgtttccgtaatcattgatcattgcattgggccactttctcagtcacttatttttggacagcaaaataattgttttcatcgagacctttttgctatttatacgagacgtacttaggccaatatttctaatgtttatttgcgaaatttatcatttattaattatgagggcgactcctcaccaaaaatatcggatcaaaaaatgtacggaaggcggcggttcgccgggcatttcctgcgccatctgaaactaatgtgaaaatcgctaattttttggtttcggcatatccgagttttggcaaaggagttcaagaaacttttttggaaaaaatgccctccgggatttttttttaaactttgccttctgatggcaaagtggcaaagtgcgttcataaaatttttgataaaaaacctcccattttttatgtcttaaactttacatcatattgtctttattgtcttctcgtctatatttggccaatggcgtgccaaattggccattatttcctttcccaatccacggttgttgacacacccccacactctccgtccgtagtgccccacttccacccaatcaacccgataattggctgcttttcagccaatgccgccacaatgttgaaattgataagagaaaataatcgaaaagagaaagaaataaacggaatggtgtgatgaggaaaaggaggaggaagataacaaggaaaaggaagaaaatgggaaagagaaaaagaagagagaaagcgagggaaa

SEQ ID NO: 36561 - DNA, 791 bp, Heterodera glycines
ttaataacgaaaatatttatcatttgattttgttaagacttttcaataattattatagcgcaaaatgtagtcgtatacgaggaaattctgtggaaagaaaaggtttaaaaataaattatagatgaactcgaatcttcatgtccaacatattaaaaatattcataaataatgcttgttgaacgccaaaaataattactagagaagaaacactgtaaccgtctcggcagtaatctgcaattttgaaaaaattctgaaatagcccaaaaccactcgccttaataacgaagatatttatcatttgattttgttaagaattgacaataattattatagcgcaaaatgtagtcgtatacgaggaaattctgtggaaagaaaaggtttaaaaataaattatagatgaactcgaatcttcatgtccaacatattaaaaatgtatttttttcaattagtctaattgttacaaattataattttttatgttaggattttgcccaccaatgtttgcactacatttgtcaaaaagctgaaacattattcaagcaatcggattttgcacattgatcaaaatttgttttgcggcattatggaacgtgattagctgctgctaaccgatgaatttgaaatttgaaaagctgtgaacatttaacttaaatattattttaaaatcattttaaattgttcattaggcactccgttgggccgacgaaaagtgccgtcaaaaattccatcgaatgttccgactcgaatcgtcgttctgcgcttggtccggcactgtacaaaattcgtttccc

SEQ ID NO: 36562 - DNA, 1022 bp, Heterodera glycines
taaataaataaattatagagtgtttgcggttgcgggtaactccctgtggttttcgggcaatagccatgttcgcgggtatcagttgctctccttgctgagcagaatgtaccaagtgtcaggttctagggccaaggtgagcaggggaaaagcgcgcagaagtgaaaaatgcacaggtgagcaatgcataagcaatttcagtgctttgacgcacttttataagttcggaatatttagcggagtcactgcaattcattatcgatgcaccacaagctatgaaattatcaaataattatggtaatttgcaaaaaaaaacatttccttcatattgaggaaaacgaatttttccaacaaaataaatttaatttttttttactattttgatttttttaaagttattttcttgtttgtttgtttgttttttttttgcttttagggatgcattttttcaaatttatcttgaaaattccgaaatctgatgataaataatggaagtaaaaacgcgtcttagacgcttaaaaccaagctaaaatattgtgtatatttttggctaaaataaattgcaaaaaaaaaatatttgaatacatataaattcggaccttattcaaatgtctaatttacagggcttccttttttatgtaagaaaaatcgcgaaatatgtaaataaaaatgctaaaaatataagatataaatccatgaaaaatatttatatattataaaaaaagaagcctggtaatttagtattaattataaaataattcataatttattaagcaaaaccattcacgcttcatatatttagtgaaaggaaaatgtttagacttttcaattaccgaaaaaaattttccgtattaacaagcataaccaattagcaattaattacatgccaaatgaacattctgtgtggtcaacttacgtgatagtcattaacacatgccgaagattaatgatgtatttttttcgactgacaagtgcgtgtgtggggaaagtaaaagtgccaaaaattaacttccctattcattgaa

SEQ ID NO: 36563 - DNA, 946 bp, Heterodera glycines
atatatttaaaatggggaaaataaaaaaatatactaaatttaaaatttgtactttcgttcagcttttatagcacttatttcaggcatcggcgaaatctaatcctaatttgttcagattagagattttttggtcaattaagtcatatacatagcatttttctcacagtccaaattgagtaaattagtcacaggaattctctcagcttatttttaatcttttttaaaattcaaattattattttatggattctttgtctgtgggtcctttgtctttgtgggtcctttgtctagatattttgaatgggacaaactgattggctttcaattgcaaaaatttgcttttttgatgaacgcttaaaagttataaaaattttcccggcggcgcctaacggcaccgccgcgccctctcccctcgaccactttccaaaagttttttggaaaaatgcgccgcaaaaaattgttaaaaatctgattttttgatcccgagtgcactaaattgcatgatttgcccatttcctcccaaaattgttaaaaataaatatgggaggcgaaaatacgaaacttgatacaattttaattgattatattgttacactagttatttatgctattttgcaaaatgtcctgatttttgacagcaaaatctgattttttgggcccgatgttctgattttgaaaaattttcgatccgagccttgttgtaaatttaagtagccaaaaaattggtaaatgacaacagtaccttttgagtttggaatttataaccttggctttgacttcacatgaatatggaaaacaactccacgcttattttttgcaaattttttcaaaatttcattattttaggctactaaattacaaattatttttctaaatggcacccgtcaaacaaaaggaaaaactttcctccgccaaccatcgcctcaattctgcaactgatacaaat

SEQ ID NO: 36564 - DNA, 925 bp, Heterodera glycines
gcgcgttcacttaccgctgattttctcctcagcgcgtgggtcggcacacacatccatcgcttcgccattcttgctccaaacgaatttcggccatggtttcgctgcgtagggcaccagcagcttggcctgttcacccaccagcacagtcatgtcgcatgcaaacagtcccttggtgatcaacggcttacaggaggatggtgtggcagcaattggcacagagttcttgctccactcgccttggcccgccgcgttcactgcggccacgcggaactcgtagatgtgctgccgttttacgccgatcacctttagtgatgccaatttttagtgcttttttagacaaatttcaagtatcgtttacccccgaaaagtttttgaaaaaaattcaagccttgaaatttacaagaaattttagaaatttttttataaaaaaatatcaaaaaaaaacatttttttttgaaaaactaacgattttttcagttttgcaaaaaattgctgaaaagtcgcataaaatttttctaagattttctttaaatttctaattgtaaattttaaaaaaatttacggcgagggggggggggggggatgaaacgagggggagggggacgaacggctcatgttttcccccaccttgattcgtgtgtccggcacatcagcttggtgccacgctcgcgtatctccagctcgtagtcagagatcggcgtgcctctgtcgcgcaaacgacgtgtccattggagcatgaattgattgacggtggagaacagtgggttcggcggggcgggacccactggcacatttcatgacgccttgcccagcaggcgttcgtccgcacagcgcacctaaaaattggaaaaaattaatccttattttcacaaaaagcaaaaatttaatatttgggttttttgaattaaaaaataaaacccaaaaa

SEQ ID NO: 36565 - DNA, 1356 bp, Heterodera glycines
ggtgctgggtcgttacttaaaaaccatcataataagaatcaatattcctttaattaattatatgattacaattggaaattacatgagttaattgcaatttgaaagcaaataattatttatttatcccttttatattttattgctttcctcaaattcacacatttttatttggaataaaatttatcgattgttttagctttatttttaaaactgcgatctgtgcagctcttgtttgtcgttttcggctgccgtttttatctgacccaaaaaaattttaaattgataaatttttatttttataccaaaaaaacaaatgctttcaaggtgtgcgattgaccaacgctggccaatctgttgaaacatatactcattattaaaattttctagggtgatcgggatgtcttgatcgccccaacgtgagtgtttcattttttaatgacgtatttccggcaattaaatcatgtaattagttgcgcaaatattgattatgatggtttttaagtaatgacatagcacccaaatattaccataattctcaacaaaaataaaaataagcaacttactggtccgaaaaattcaaagcataaatttcagcatcaatttcgtctgtcgtagcactgttccaaaaactacttcgtttagtttccttgtcgttgaaaaaaatagtccaaggcccaaacagctcctggcagagcaaaagtattgcaccaaaaaattctgtcgatcaaaactcaaaagttggcacaaaaatatgaaaaatcccgtatagtgatgatgatcagaaaagtattttatcatatgatatgaacataaatttttccaaattgaagggtatacctctaagatggctgactacggtatttaaaatggtttagaagaaaaaaagaaccgaaagagcgaaattttccactttttcttgtttgttggcagaaatcaaaatatggacacaaataatagtaatatggacataaatcgtgaaatatggagaataggacatagaaatccacccctagaagcttttaacttagctaaaaatttgtttttcgtgcgtttcagggctcccacagtccataaaaatatggacccaatatcagatcactccttcgtggtgatctgaacatcccagaatacacttaaaattgagggaattttcggaagacattcctagagggttgaaaaaagttcttcccacccgcaccgcttccgccttcaccttcggcaaaatcatcaatcgaatttaaaaatatttcaaattcaatggttctcagttttaatgaatgaacgaatgcacattcattaccattccattagctttgtcagtcgtttttccttctatcgattttatccgatcattaa

SEQ ID NO: 36566 - DNA, 787 bp, Heterodera glycines
cctagcgggggatgcgccgaaggcgctgaccccgctataataaaaaataataattctcaactatgagcaaaaaattgacataatgccataatttaatatccaaatatgttataaatagggcttcgatttttaggtgctaaaaactgccaaaataagtaggttttaggttctaaaaaacccccaaaataggtgctaaaaatgggaaaataggtgccaaaaagttccgaatttaggggtgtaaaatcgaaaattttcatcaaaaagcaaaaatattttgccaagtcattaaggatatacataattttcaaaatcaaaaattatcgtcaagaaaataaaataaataaattttggagataaatttttgagaaatttttcatttcttaggggcgcatttttgaaaattttctggtcgattcttagggatgtattttttgaaaaaatttttgggtcggttcttaggggtgtatttttcttttttattgcatttttgttaacaaattttgggcaaaacgccaaaataggtgaaaataagtttttttaaatttttttaggttttttaggtgctaaaaataaaaacctagaaaataggtgctaataactcgaaaagtagcttaacaacagcccaaaaaaacatgtttttcgtgcgtttcaggccacggggagctcaggaaaaaaatatgtaaaaacctaaaaatcgaagccctagttataaattcaaaaatttaccaaatttcctttgattattttttccacttttccaaattctcattttcaaggacgtccttgc

SEQ ID NO: 36567 - DNA, 1358 bp, Heterodera glycines
  misc_feature (1244)..(1244): n is a, c, g, or t
gaagaagagcgatggttaaggggccggtgattgggggaagaacggaggaagaacgggtgacctttgaagacaacacctgtaaagagagagggcccacttatcattgatggactcgagaccctcgactgtgccaacaaattacgaacttccgtgctcagtgcttccatggcagaagcgtcaaattcattttggagtcgccgcgagaaaaagtgcggagcagcggcagaacagcgaggagggtgaattggcgacagacaagcaattaaacagacccattaagctaattgcgaacggacaatgatcccttcacaatgggcttcccggcgaacgcaaagtgtcaatttgcaagagaaacgcagagaatcggactctcgcagggagaatacggtagcacgggcaacggccagcaaacggtcatcggcgtactgtaggtcagagagcagatcagagtcagcagtacaactgaggaagacagacattcaaatgggaaaagaatgcaaaagaaggcaatgcgcccacccgtcactgtcgacgatggccatttgagtaccggaagcgatcggaagctgatcagttgaattggccgaattgggtatcgaatgattggccaccgaacagtccgaaatacgcatgccgaacacttcactgatctctgtaatattatcaaccaaatggacgaaataccgtgatcaatggcataaacaacaaggtcggacaacctttgcccccttggcattcccagcggtggtaaattgtctgtccgatgtgcgctttgtccaccattggcccattgggcgaatccctacaaatttggacaaaatgccaataaataacatggagtttgacctgcgcaaagagtaattacattttggaggtgccatttccaatgaaattgtgtgggaaatgggctgaggaggaacatttgtgtccaaatcggtgttgaggacgaaagagcgcggggaagaggggagaaagcattggaggaggaaggaatgctcgatgggagacagccgctgaaagtgtgggatcaacggcttaattagcaaaaaaaatgccgggggataaagcggtggaaaaagcggataaagcaaagactgaccagcgaacgacgtgcggcgaagatgagaaccaccgaaagattgaggcccgtaggggaaatctgacaacaattgggagaaatgtttgactgatcttggcaaatttacgcacagactcggcactgctcatcccgcactgtgcctccncaatctcgagagtgacattctcgagcccaccgagttcggcgaaacagtcgcgctgctcatgaaatcccttagcaaacagagagatcagcgagcgatttgttgtttggattctga

SEQ ID NO: 36568 - DNA, 1355 bp, Heterodera glycines
attagcaaatataataaaaaaaaaataataataaaaatgtctcctaagtgtcaggcagtagcagaaagaatggatattaattctttctctgatgatgatggattgttgacatcgatcgaattagtaattttttgccggggggggggggaatccaacgacgacggagagggaaaagggaaaggtcacgtgtaaaaaacgaaaatgtaaaaagatttattaaaagcaaacaaaaaaaaacaagcaccatttgctaattattagcaattaaacggcgatgggttttaattaatcagcagcgaatgaatgaccggcaaatgagcaaaggtttaaaagtgtacaattccaacggctccggggacaatcggcggacagtaaaatacacaaaaagataagaaaatgccgtcaccgaaaggaccaattgtgccataaaacgtaaaaataataatcatatgcaaatgtgaatcacaagtgtgaatgcgagacagaacatctcagctttgatttggaggacctaatcctacttggagatccctatgtccaagactcaattgaaaaataggtctgccttcttttcctcctccattcccctcgctactgcttctaatgaaagccctcaagaacaaattctctcccaaatccttggtttctccactctcccaaaaattctcccctcctctgatctgtcattttcctcattctcccaaaaactctttccgagacccaatcagggacaacttgaaaccctggacctccttttcaacccctcccccagtgcaatcatcaccgaagccggaccaggcactggaaaatccaaaattatcattatgtccatccaaaaattcttagaattagggaaaaacatccttatcaccacccacagcaatgtagctctctgtcgtttagctagtgatattctccctaatttagacaataattcaaaagcccttctcatcctctctgcctccgcaaaagaaaaatattttcccctttttgagccttttatgaaaaatcttttaataaaaactttagctgactttaatttgcaaaaattaacccgaaaagaagccaaaatcattaataaatataaaatgaatgctctaaaaaaccacaaaaagcagatgaacgttcttctgcagaaatctttatcagagacgttgggactgaaattcccatcatctttatcaccctcagtatgttagaagatattccctctatgttaagtcttataaatatcatattcattgacgaggcaggtcaggcacctaccaatcagattcttcacattctctccctggccccaaatttagaaaaaatccttgctgctggtgatccaaaacagctacaagttcgctcct

SEQ ID NO: 36569 - DNA, 1423 bp, Heterodera glycines
  misc_feature (50)..(50): n is a, c, g, or t
  misc_feature (122)..(122): n is a, c, g, or t
tcaggattggttttagccaaaaatcgtcttagacatttttgtagagaatntaagctctatcgaacggtgtgctatatgcccggaaaatttcaaaaattttcgagctaggccccctagaaatnttcgaaattttttttaggcttgaaaagggtggtgaaaaatttttttctggggtattttgaggtgctgagcacgaatttgacctttgtttttcgtttcatgatttttggaattttttaaaaattctttattttttggcaattttttggccctcgggattttggcctaatatttgaaaattcataactcggtgatggtttcatcgatttaactataataaagctttaaaaatagagaaaaataaggagaattttatgggatttatttgagttttttttcacaaaaaagaaaaaagttattccagaatttctggaaaaattcgaattttcagaaaaaaattcataactcggttctgaaaagatattctggaaaagtaaaatacttcaaaaatccgcaatttttttctctattaaataaattttatctggcatttttatcacttttttgcgaattgttataaaaataaaagtgattttgagattcgggaccaaaggggtgagcataggatttttgagtgaaaaaattttttcacccaaaatcctccaaaaacatgtcattagggctattttatgacgctaatcacgaatacgtgatcagattttacttttaacatcgataagacctcagaatccctgtgtgattggggattctgaggcatcatttgaggggggagggggcaggttcggatccggacggtgtacattaattttctaccatttattttctgtttttcaatttttgttcatttaaaatatttttaattttattaataataaataaaaatttttcatttgaattaaattattttttggtgaaaattttatgaaaaaaaaattttaaagatagatcacagagataatgaatgtcgagtgtgcaccgacctcgcacttgcgctcgagtgcttttgaaactgatgaacctcctctaataacacatagacatcttccttggatagaagatacacttaaaaattctatgagaaactacaaggagatagtgcaccgcccaccctctcaagctcgagagcttatgtaacgtataagatttctcaagagaagagagaggcctttttcttggatataatataaatttaaaaattctctgagaaattaaatggcgattgcgcaccgccctccctctcacgctcgagagcatttgtaacgtatacaatttctcaaaataagagatagtcatttttcttggatataagataaatttaaaaattctctgagatattaaatggcgattgcgcaccgccctctctctcacgctcgagcgcttttgtaacgtataaaatttctca

SEQ ID NO: 36570 - DNA, 733 bp, Heterodera glycines
gtagagaccgagcaggaccggatccggtctggatttttcgggataacgccaatccggtccggcaatttttggaaaacttagattgaccggattacatgattgacaggactatgagagaccggatccagaatccggtcatttttgaaaatgccaatccggtccggtccggcgaatttttgaccggattatgacccagtcaaaactcttggttttgttcattttcctttgttaaaaaaactctttggcttaatgtcttttaactttaaatggtcaaaatttaaaatttttcccccagctgcgcctgtcggcgccgccgggcctccaaaacttttttttttcttaaaaaattggctcaaaattgcgaaattggtcatttttgggggaaaatctgttaataaattgcctttaattttcacagattttcccggatttgaaaatgaacaaaaattgccaatttatgaaatgtttttgcaattagcaattgctcagcaaatgaatggcaaacacatgaaaatttagaaggaataattcggcaaaaatttgacaaaaattttgaggaaatgcaacaaatgatgacaaacatgaaataattgtggattctaaattcgataataaatggacatggatgagacttatcattggatgaaacttagataatttcaaaatttagattgatgatgctttattttgtgggatttgtcaaaggattaaaaacaaattcagagaaattttt

SEQ ID NO: 36571 - DNA, 1437 bp, Heterodera glycines
  misc_feature (1302)..(1302): n is a, c, g, or t
ttctttttttttttcaaattttgggtccccttttggggtttgatcccctttgggaaattttttcttccttttgcatttgatcaatggatcggttcccattttctgattttctttgcggaatattttataaaatttggtcggatttcaggattcaatttcaaaagcaaagaaaaaataaaaaatatttatgtcataattcattttgaatatcgaatttatgcaataaatgaattgttttattttttgttcgctttttaatactaatattaattttatttgtatttctcttcaataaatcgttgccaattttaaaattgtcacgtaattccggcggtaaaatcaatttttcgctcagatgaaaaaagacttgccgtaaaaaaaaaaaattaatttgttataaattttatattttaatccatttgaatttactcaaagcttcggtgggatgtaaattatttttgaatttattagatcagttgtataaattctaagacattttgcaaaattgtagaccatctagttaaaatttaataactcatttatatttatggcaatttgacattaattatttgatttttatttttcaaaaatttggcgcaaaattacataaagttaaatttatttatttattaaataaaataaattcgtaaacttcctttttttaaaaaagactttcataacattttcacccttaatatggacatagataatttacatagaagcttcaagccaagataaaatatatttttgtccgtttaagacagtccatgaaaaaaaaatatggaatttcattataattttacgccccagtcaaaacgtttccaagattttttcgtgcctggttttctgagttgccgctcgtaacagcagagaccaacttggattatagtcccattcatcagcagagtcaacaaacacgggattggcaccaacattgaggacggcatttgagacagcaacaaatgttatggacggcatcaaaacatcggcacccggtccaatgttagctgagcgtaatgctaacaccaacgaggtgaagccgttgcagcacggaacggcaacctgaaaaattttggaaaagtgccaaaattcgggccctcaaaattgggacggcccaaaccaattatcataaaactctttgtagttttacttacaggaaaatcgtagatggcgcatagttttgctgccagctgttttggccatgtgccagccgatgagatttgtttgctcattaatgcgtcatttacattttggatggcacccggcggaatgtacggctcgacaacccggatgatttgtgangtgtgcgcataatatgcggttcaggctcgggaaagaaagtggctaatccccggtgggaagtttggaccgtaattgcaatgaatgccgaaaaagtgcccgaggtgtaccatatgatggacagcatactgtgttgaa

SEQ ID NO: 36572 - DNA, 519 bp, Heterodera glycines
tagagtgccacgggaccgggaatttttgccaaaaccgggaccgggacttgccgggacctgagaagccgggactgggaccgggacctcgattttttttcgggaccgggaccgggaccgcaagaaaaaccgggaaccgggaccaaccgggaaattttaaaaattcaaaaaaaatttaaaaattaaaaaaaaattcaaattttaatttatatcaagtgaaaataatacaaaattatttggtttttatttaataaattaaattaatgaaaattttcaaacaaattttcttcaattatttcaaacaattaatcatttttggactaaatcatcgaatattaatagaaattcagatttgattttcacatcactttttttcggagcgctttttcaaaaaacttttgggaaagaaggggtccggcggtgccgataggcgccgccgggggaaattttaaaaatttgagatgcaatttgttaacagattttcaacaaaataggttggtttttgcgattattcagatcaat

SEQ ID NO: 36573 - DNA, 941 bp, Heterodera glycines
tatttattattattttatttattttgctttaaaaaattgaaatttatacacaaacacaaggaggaattgaacttgagaccccctttttggtgactaactcacagaccactaagacgaaaaaaccaacttaattgtacttggagcccaaaattgaatcgccgtgagtaggaaatcataattttctattaaccaatcacaaaaaaacattgaggcgatagggcgatcagagaaagagagagaaacgagagagtgtgtgttgttgttctgcttgccttacttatgtgttatgtcgcttttctctacgctccactctccattattctcacactctttcgcttttctttgactcactgcgatctctcattttcactcactcccctgtgcacgcccctcgaggaaaggcaaactttgtgcggttagggggaaacgagtccagcaacagcagcacattttgggaagggcatcaccgaagggggggggcgcggttcagcgatttgctgctgatcagatcacagactgactgatcagagattaattagcaaagggattttgggggatatgtgtttattttttggtgggagagaggaaaggagtgataaatgatcatcgcaatgaatgaatgaatgtgaatgcaattaataaaagaacacagatacggtaggaaaatcgggacgaattcgattttagggtaattaaatgggagggggggggcttaaagggcttatgggatgcccgcgggggtttgttgttgccattcatagcgaaaacttacaattaattaattaaccaattataacctaataaccaatccattaagctaagtgggctaaataaacattaatcactttaatttgggaattgggaaagaaattcaaaaaaaagaagcaaaagctaattttttcgacttgccaagctgttttttccagaaaaactttttctct

SEQ ID NO: 36574 - DNA, 576 bp, Heterodera glycines
  misc_feature (551)..(551): n is a, c, g, or t
aatcattcatggactcttttagaacctgttgccgaagaccgtccgaattttcatttattttcgccatgcatttagggaaataattaattggaaatgatgttaatttaattaattaattacgcctaattagcttgggcctttattttgctatttttttatcggacaaataaatatgtaattgcttaatgttaggcattaaatgagcaacaattcgttttcgtgattagcgcgacctttaaaaccccggataacaaattatcatggttttttgggtgggggacagtttagtcttgccgttatagcagggcgcgtatcgaaaatttttcaatcagaacatcaagcccaaaaaatcagattctggggtcgaaaatcaggacattttgcaaaattgcttcaaatcagttatttttacaatttttcgatcaaaaatgtatcaaatattatatttttcgtctcccattattgattttaacaattttgggagaaaatttagcaatcatcaattttagcgcattcggaatcaaaaaatcagatttttaagaattttttgncgcgcatttttccaaaaaactttta

SEQ ID NO: 36575 - DNA, 1067 bp, Heterodera glycines
tgctgatcgctcatggtgccgacgtggactgggaagcgattcttcttttacaccgctactgctcgcatgtgccaaaggcagcacagcaatcggtgaagcaatcatccggaataatttctcaaatttccctattttcagtcacccttctcgtggagagtggcgccaacgtcaatctcggggacagcgaaggagtaacgccgataatgatcacttctcgtttcggaagggtgaaaaaagcaaaacttggaaaaacttggcattttttgtttgttcaggtcgaacctgtgcacttcttactttctcacggtgcaaacgttgaacagatggattacagcggtggctttttgcccgtttttaaataattattgcactaattaatatgtctttttcaatttcagggatgcgatttgctcttttggacgccgccgctgatggccatttggaggtgtgccgtttactggtggacgattgggcagctgacgtcaaccagcaagcgatcgacggtaccacgcctttgatgggcgcgtgcagcttcgggcactttgaaattagtaagaagcaactggtgcataattcgactcaactttctgccccaattttcagcggtttttctcatcgaacatggcgccgacattgaccacgctgacatggacgggtacaacgcgttgatgtgggcagtgaagtacgagaaggctggtgtggcgcgacatttgctagcgatcggcgcgaacgcagaccaagtgggaattgacggtgggtgggcccaaaaagggcttaattgtaatgctccaactgattgactgctctccccctcccccatttaaggcaaaagggcgatagatttggcccaagaaggcagacgtgccgaaatgatcgacctttttcgaaccacagctaacaatgagcagcgggaggatggcaatgcgtaagaaaaaaaagaatttccgatcaaaaaggatatttttgatttcaggcaacaggacgagcaaccaccgcagcaacagtaaatgtgatgtcattgagagggaatcgaattgcaaaaacaatcggacggaattattcggaag

SEQ ID NO: 36576 - DNA, 980 bp, Heterodera glycines
  misc_feature (6)..(7): n is a, c, g, or t
ctgcannggtcttttgaaggttttaaatttatttatccgtctttaaattcaaaatgtttgtccaaattgcatttaatcacttcgttttccccgtcataagtcaaaatgttctgcgtttggccacacttttgtgaagttgtaaatcaaattgggctgttccgccgacattaccgttgtgaagatggtctgtctgaaattatttttcccaattttcggctctttggcccggccgactcattgcggacgggcggaatggcgaggacgcgggaggacagcgcaattggggagatgaaacgctggccgacccgtcttaggcattgggccgcttttgttctgtgggcaattgaaagtgagtggcatggctaatcttctgcacaccttcgcttgtccgtcattcgctcccatgggtcgctgttcgtctccacgagaaaccaccggtggtgcaaatagtccaagaaaaacacatcggccactccaaatcggtccctaataagccgaaaaaatcacgttcattcttaaattgcttaattagcacctcgaaatgatcgcgccgtctcctttccctccgccaacgattaaataggatggcgcaaccgtagtgatgcgactcaatttgtcaacagcctcctggtaattgtccacagtttccaacactttgcgcagttcaaatgcgattggatgacgaaagcgggtgatcagtgccatcaaaagattatcccatgggccaccggaatctgatcgcgacaaattattacgcaaaatcaacgctattcgggaacagtttacatcgagcattgagagacaaagtgaacgcgtgagggcgttgtccggtcaaaagtccactataaaggatgaattggatgccggtgaattgcactcgtccgtccctgacataatccaccacaatgtggtggctctctgagcagctgagtccacccatagtcgagattgcgtccgtgcaaaatttgaccgtccaagtc

SEQ ID NO: 36577 - DNA, 1136 bp, Heterodera glycines
ccttccgttcgtccgatcgcttttctgatcacttcctctgatcagtccactttcgcccgtccttccgttcgtccgatcgctttttgatcacttcctctgatcagccaactttcgcccgtccctccgttcttccgatcacttctgattacttcctctgatcagtcaactttcgcccgtccttccgttcgtccgattgcttttttgatcacttcctctgatcagccaactttcgcccgtcccgccgtccgtctttcttttccccgcccaattcgcttctctccaattagtggtgctaattcagcaaacctcaagcaaaatgaactgtgtacattccaagcattcacttgcgacaataacaacagcagatgtcgtcgcgttacgaaacggcgaaaagcaaagggacgaaacggacgcggaatcaatgggagagggaaacggacggaacgacaacggcaccagcagcaacagcagagaagaagcactgatcagactgatcaaaagccacatccgactcggtgccatgtgcggcagcattggctcgttcatttggcacattcaacggcaggtaaaagaggccatggcacggagagaatcattttaatatccatttgaactgttcagattttctacgcccattgtgccaaattggtggcactgttcgctgtcgccgtcgcccaccttctcttcctccacccttttctcgatttgttttcgcgcctcgaaaaatacgccagccaattggactttagcagcgtggacgccgaactgatcagacaaagtgtgcacgacttggccgatgtgagtgttggcacggatttgtcggcttaagtgtcggttgccgcccagcggggacacttttggcatttgtccaaattttgtgggcctttcccccgggccctctcagcacaagcatttccagtacaaaaagaacgtgtggatgaccgtggccgtgctgtgtgtcggactgtccaccagctccttcttcctgtttctgctgccctcgtcgtcgcccgtgcgcaaatgccacgtttatttggtgggtgagacgatgggaaaagggcggagcccaaacaaatgaaatggggcaatcaccagcagacagtgtccgggagtctcgacaacaccccccccccccc

SEQ ID NO: 36578 - DNA, 742 bp, Heterodera glycines
ccagatcggacgggtgtgcatgattccacagatccaagcaccacaccacaagcaaaatgatatcaccaagatataacgaaaaatgttttacgaggtcagctctccatcttcgtttcagatagtcaagcatcagagtgctaaaagtcagcaatcgttgcttaacttgccagatcggacagcactgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaac

SEQ ID NO: 36579 - DNA, 1419 bp, Heterodera glycines
cgcagtgcgtcgccgaggcgggcgcagcaagaatatgatggcagactttcggagacgcactgaggcggaggaggaagcgattttgaggtttgtttcgcattgggttttctttctcttgctctgactaagtgaattttgcaaccctgtcaaaaaaaagttgaatgaatacagagttgactgatgtttgcttatttcgctaaaattttcacaatttttttaggtgtgtggtgaaggagcaaaaggatggacaaagtggtgatcagcagcaattagacgaacaacagctaagacaaaaggtctgtcgccggtggtcattaggcaatcatttgtgacgaattaaaaatagtcattttttggcgaaaaatggattggatacaaacccatgtaaaacatgcctcccaattcatgtttttttgaaaaaatacagccccgaaagtcagtgtgcccttaaacaatttgtttttacgtaattatatgtttatttcagggggcaaatgtggactacatggaaatgggcggggaggaggaggacggactgtccaacggcggaggacgcaaaatgctcaaaatggagtcatcgtcgcccgtcaacaacagcaaggcatgtggttaactgggggaaaatgagccgaaccgtggaatggacggagattatactcttgcatttttagatgattttcattggtccggtcaagcccattgtccaacaatcgccgaccgcacctcaaaagctgcccaaggtggagctgcgcaaccagtccatcatgttggacctttctgatgttggttgggttgggtaaattgggcgttgggcggtgggcaaattaatggacggacacacaaaatcgaaatacggacaaactcaggaaattaggtgaacaggtcgagacataatgagcgagggagtgtcttaggtgttagggtccacattggtgaccattgacatgtaagagaaataaagtcatccgctggaaaatgtggcactgatagcaattaaattttttacagtcaaagactgtttggacgaggaaattcaatccgattggcgactgtcgggtagtcggcagctaatcgacggatagaaaggcatgcagggttggtctactcctttcatttcttgtgtgctatttttgtcgaatttcagagtaatctatcagtagataggtcactccttcgcctcatcagttggcaatgtttctcgatgttccgttacgtccagagatcagtgtcgtcgatatgatggaggcccgcaattacattgcaaaggtgcgttacctctcttattaagtgtatatgttagtaaatgtatcatttttatctgttcggacacgcatatgttcactcggtatccattaaaggggatgcgaattgcagaggagcgggatggttggccgggttagccgcaatcgaggtatggat

SEQ ID NO: 36580 - DNA, 967 bp, Heterodera glycines
tccccataattggtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggtgcagtccccactgaccgatgcgcccagatttatggggagaccgatccttcggaatagcttcctatagcctgtactttaattct

SEQ ID NO: 36581 - DNA, 954 bp, Heterodera glycines
  misc_feature (919)..(919): n is a, c, g, or t
  misc_feature (930)..(930): n is a, c, g, or t
agtaaaaataatttaaaaatgcttaaaagacccagaataatatgatgctgtttcagcaggcataaaacattaattcattcattttaatcgacaggattttattagagaatcatgcagaaaatatttaattatttttaaaactcaaaaaataaaatagtccaattgctcctcagatatatgatgttgtctaggatttccacatgagggggtacggcttaagagaaatagcaatcgttaccggacatttatataaagggtcaatagtaaaaataattcaaaaatgcttaaaagacccagaataataggatgctgtttcagctggcataaaacattaattgattcattttaatcgacaggattttattagagaatcatgcagaaaatatttaattatttttaaaactcaaaaaataaaatagtccaattgctcctcagatatatgatgttgtctaggatttccacatgagggggtacggcttaagagaaatagcaatcgttaccggacatttatataaagagtcaatagtaaaaataattcaaaaatgcttaaaagacccagaataataggatgctgtttcagctggcataaaacattaattcattcattttaatcgacaggattttattagagaatcatgcagaaaatatttaattatttttaaaactcaaaaaataaaatagtccaattgctcctcagatatatgaggttgtctgggattttcacatgagggggtacggcttaagagaaatagcaatcgttaccggacatttatataaagagtcaatagtaaaaataattcaaaaatgcttaaaagacccagaataataggatgctgtttcagcaggcataaaacattaattgattcattttaatcgacaggattttattagagaatcatgcagaaaatatttaattatntttaaactcanaaaataaaatagtccaattgctcc

SEQ ID NO: 36582 - DNA, 1118 bp, Heterodera glycines
aattttcaaattttaagcattgaaacttcaaattttcaaattttttcaattttaatcattgaaaactctaaaaacactaaaattttcaaattttaagcattgaaacttcaaattttcaactttttcaatttttagcattgaaatctctgaaagaatttacattttttatttttttcaatttaatcattgaaaactctaaaagcattcaaattttcaaatttttttaaatttttaagcgttgaaaactcccaaaaatgcgttcttttttcttcgccagcctcgctttggtgctcatttgtgcctccaccactgtttcaaagccccacccgacggtattgtggtcatttttgaaaatgcatttaactgtaattttttttcttttaagcctgccccatctgccaagaccaatgaaaaaggttgctatcaagtgtgctttgtcgttgtgtgcatcaacatttgccctaaggccaaggttggcatttttttgtttataaaactttgggttcagaatttatgtgctaaaataattcaatttaattgccaagaacgatgaaaatggtgctgctgtgaaatggcttaacatttccgtgccaatccccgacgccatttccctgccttcctttaacatgacaaacattacccaaggcgaggagcaggaagaataaatggaagggtgaagagaattggaaggagcataaaaatttaaaatatttgtatgttcaattaagattatttgatgttaatggtttaatatttgagtttttttgaataaaacatttaaatttaaaaaaattgttaggcatttctttatggtgtaattgcgtatatgtattaagaaaagaagatggtttttccagcggttgaatttctgtggccttttttcaaagaattgtgagtcgaaagattttttacacaaattgtggctattagagaccggcgcgggacagaatcccacgcgtggttttgcgggatccctgccgcaatcccgaatatcgatcagacaaaatgtcgaaaccggcgaacagtcccggaccgaccaactatagtacttagaagcaaaacctttccgtcaaccaattcaatagaattcgccgcgactgatgagaaacccatgccca

SEQ ID NO: 36583 - DNA, 963 bp, Heterodera glycines
  misc_feature (908)..(909): n is a, c, g, or t
  misc_feature (915)..(915): n is a, c, g, or t
  misc_feature (920)..(920): n is a, c, g, or t
  misc_feature (951)..(951): n is a, c, g, or t
cacaaataatgaccaattaacgtgttgccttcctcttcagaagaacgattgtcattttgtggcaaaagcatgtcaatgatctgatagaaaataataaaagtcgcaaataaaccaatgaattgagaaaccttgactttgcccttctcattatcatacaaataacagagaaaacaatagaaaacggcaagtcgaagacggaagggttgtcgttcagaagtcatcgacagaagcaaaatcagtaaagcgggccttagaaaaggcgtgaaattcaggagattttcattgttttattcatgaaattcttacaattttaacttatcagtatttttgtttttttcttccagctatacacacacacctaacgccgtcctggtcagccactgtggattgtgcaaagaattcctggttggcgtaattggcccggatggtctccgctacagtgatcaccgactcggccaaaacctccacagacacacccaattgtgacagcaaaactttacacagcaaatcgagcattcctgaaacaactatgaaaatataatgaaaatgtgtttcaccagcttgaagcagagatttttgtgctgaatgcgtagtttggtgaatgttgtcaaccggggaaacaagggcacgaatgcattgcaaaatgagcataaaattggcaattttctgagagctccattcgtcgtcgggcaatccgccagaagggacgaaagacgggtcgacctgttcagtcggaaatatgaacgaattggccaactgagtgagttgcttggtcaaactaaaatttttttgaaaggtataatataagaagttgagacttcgcttcgcgaaagccctcttgattgctcgggttcttcttcaataagttgagaataacgaacaaacaatccctcaccccacatactgannaggaanactgntactccgaataaagtgaatgaattaataaancaattgaaatga

SEQ ID NO: 36584 - DNA, 819 bp, Heterodera glycines
atggggcgaggaaacgtactgctcttgctcctcgcggtgggacgaattaaccaggtcaaaattcattttccccacatttctatcccagtgtcaacaatgtcaccgccgttttggatgcaatgttacgcatcaaattgtccgttgtgcccggcccgttgctcagcgtgttcgtgcaaaacattgccaagctgtacaccttccaactgtgcaaattggaggcggacgacgattgggacggaattgaaacgttggacaatttgctcacctccaaattgcccgagtagttttgcatgatttttggtgtgtgaccccaaggaaattatcttttgggaggtccatgttttaaaacgaaaatcagtggcctaattaaaaatcattgattttttcatttggatcatgaggcaagcaactgttttcgtgaatcttgagccgtgtattgtgccagcgctcagggacggtcccaggattttggctggggggggggggcacctccccccgggcgacgacctttttttttttgcttctttttttttgcttttcacacccgttttttatgtggcggtccggcggtgccgataggcgccgccgggaaaatttttgcggttttaaatgcggtttgttaacagattttgtccaaaaaatgaccaaattttgtgattttgagccatttttagcagattttcattaacaatttgtggattttttgaaaaatttagcgaaatttcttggaacatttgggtgaggctaggtctgggggggggggggggtaccagtaaggaaaaacctaaaattttcagccaaaatattattttttcctta

SEQ ID NO: 36585 - DNA, 1884 bp, Heterodera glycines
  misc_feature (1017)..(1017): n is a, c, g, or t
  misc_feature (1026)..(1026): n is a, c, g, or t
  misc_feature (1033)..(1035): n is a, c, g, or t
  misc_feature (1041)..(1041): n is a, c, g, or t
  misc_feature (1053)..(1053): n is a, c, g, or t
gcctccgactcgtccgtgaaagccaaaatctccttgctaaggttcgtcgttgtcagcaccgtcccaatgttgtatttgaagccattcccgacaatcaaataggacaacgcgccatcccgccgacaaaccccgatgcgctccattttgacaggaaactccgcaatttccgctggcaggccattttcttcataaaccttggccgtgaattgctgctttctacggcttgtgccgggctggcactcctccaccgcctgctgcgcctctcccgcaccggtagtccgtcttgctgcggcctgcttcagctgctcattcagaaaacggatgcccaaacctcccgcatcccagactgccgaccactttttgtcgtcgcgcaaatacgacaacaattcggcgtaaaaattggccgtcagccaaaattcgtaagttccaagcatttttttactaggactcagtcgattttaaaaagagagagagagagagagcaatgcaaaatatgcgaacgagcctgagggcacaatacagactataaaaaacaagcgagatgtcctacaatttattctcgacctaattcccattgcaaacattttaaaataccccaacacttaattccatccaaaattacacatttcgaatcaaaaagcatttatttaaaacatttaaaatgattaaaagaaaacaaccattaatcgtaaaaacattctttctttctctttcacttctctggtctcgccatttttcttctgtcttctttcgccgtggccgccattcttcgacccatcaaaattgtcgccgcgccattcaccagaaacgacctaaaatgaaattggaatattagcaaaaaaaaaaataaaaaaataaataaaataataataatattttttttgaactgcttgaaccctatatacagctcggacccgatgccttgctgaaagccatgtttctgttttctccttacccctaccaatttttaaattcaaaagcacgtaaaaattggtaggggattttgaaattatccanaattcaccncaaatannnccacgnggaagagctgtntaattgtctaaattttgattcccaaaactaatttcccaaacagcaaatctttgagcttaattaaagcattttcatttatcagtaaaactatggctcagtggtttttcaaatttttttaaagggccaggttcgatgccccaccatgttaaattatttttattcagtttctcattttttcccccgattttatcccgtcccttcagaatttccccgatttatgcaaacctgaaattgggcaaccaaaaaggagagtttggctcatcgggtaccaagcgaaattggacgaggcttttcaaaggcctcagagccaacgggacaaaaagctgaaaaatggataaattaaattttttttttttcttttcttttctctctctcgctcagccttaaaaaatgctaattattttcttagaaataagcacaaatgctttaaaattgcgtaaagtacggagcctgagggcacaatacaaagaaacaaccgattaaggattgatctttaaaaaaaaaaaacaaaaaaattttttggtggttgaaagtaataaggataatttgatcgccagcaaattaaaacaaaacaagtatctcttaaggcgacaagtgctgcaccatggtacaaactgacaatgcctaaaacggttaaaggtcaaaaaaaaaaaaaaattttttttattattttttttactttttccttataaattgcacaacccaagaaaatgctctgaaaactataaattctatattatgggcagcgatgccgaactcaaataatctctatgaattgaatggaaatgtatagcgtcaggcctgagggccaaatactacttaaaaaccctt

SEQ ID NO: 36586 - DNA, 1019 bp, Heterodera glycines
tgcatgtgccgaacgccgtcgccccgttccgctcgtgtttacctctgcaagcggttcaaatgcaacgcccacgagctgcatgtgcttttcaaaagcctagagaaacgccgggacattgtggagcatttgcgctccgtccaactgcgcaccgcccacctgcgcccgtccgtgcgcaattttccggtccgctgtaatgacctgtccatcctggacacccactcggcccccgcgtaccgaggctacctcggcataacggtatttttatttgttttgtttgtcggtaacaaaaaatttaaaggtccggatgcactattacataaagcatggcatccgcttgcgccaccccaacttgccgtgcgtcgttgaatttggaggcggagatcacaaaacttttttccctcttgaaattttgtccattgttttgtagatgtgttcaatttccaattatactgttgtttttaaaataaatgttcaacctttatctcgggagcaatttttggcaattgcgcagcgtggcgtaaacactgagtacaaccccagccgcttccacgcaatcatcatgcgcatacgtgcaacaacaacgactaaaactgtggcagcactggtcttccaatcggcgcgtgtggtcctcaccggagtgccccacccaagcagcgcaaataaaatggcggcacgcgttttgcggcgcatccaacacacacagagcatcccactcggaatctaccaactgcgtgtggtcaacattgtcggcgttcaaaccttcccccagcgaatcagtgtagagcgactccaaaacactctgggtggcacatatgaccccactatttttccagcccttaggtgcaaattgtcgaatggggtcacttgcctaatttatatttcggggaaagtcattgtcactggggcaaagtctcttgatattttgcatcagtcatttaccaatttgtctaatcttataccaaactattttcttagaataaattgattgatcacaatttgtacaaatttcgaaaaaataa

SEQ ID NO: 36587 - DNA, 922 bp, Heterodera glycines
cttaggtctgttaccgtaatcataaatacggtggaacccccccgatacaataataacaattaagttatttttttacctatttattaattaattgtccaccttgcattcgtcacccagcaaaaacacatggggatgatcatcttcactcattgcaaatttgaccggcttccgtgaagtttgttgctttgccacggtagttgtagtagaggtagcggttgtagtagttatggtagttgtagtaggggcagcggttgtagtgcttacggtagttgttacagtaacagtttcttcggtaggcaatacggttgtgaggttgtttaacgaaatttcatcgttctcagtagaaacattttgtgaagcgtcaggcacagagacaatttgctcagatgttgtctgaaaacaaattttcaaaataatttgctatttaaaaaaatttcccattgaaattggaaaattttaatttataaataaatatgaaataaataaatataagaatttcattcagcataaaaaatgttatcagaacttttgaagattttatcataaaatttatgtgcagctgattgtgagtgaagtggcctatttaaatgtattgaaaattttcaattttcaattttgtaatcaaaaacctaattaattaattagttaatcaattagcttatataacaaaacccaattaatgaattattaaaataatatttagaaaattaccggaacatcagacacatttgctgccctcaaattcacatttgatgcaatttcatttgtgttactggtgttgttgctgtccaattcagcgtcattttcaagcagtttaacgctaccggacgaagtgttggattcattttctgattctgctgttccttgctcagtctgtgaagaagtcttagttttttatttttaattaaaaaaaaacatttat

SEQ ID NO: 36588 - DNA, 766 bp, Heterodera glycines
cgaaagaccgggaagaaaaccaccagccccagagagagcgcaaggaggcagccacaacaaccggacaacgacgcaccgacgccacgcacagcgccgcagggcgccccacgagcgcgcaacccacaaagaagcagcgaaccagccaggcgaggcggacacgccaccgacacaaggccacgcagcagccagacacaggcggacacacgggcagcacagagcgggagaccacagcaccaacgcaaggaagcaccccaaaagcatgggacgcgaggcagctgccccgaaaagcggggcagcggccacaagccagcacgaacgaccggggcccaacagcggacgggggcaaacgggggggccaacgcgagcccaacaggacagcaggcaggaggcgaagaggaaccaccaggggaaagagccagcagcaggaacacccacagcgaccccgacacgacgagagcccggcccaagccacagcgaggaaaccggaaccagacagcacaccgaccgaagccggaacaccaaccgcccccgaagaacacgaaaaggctcagacccgggcagcgacgggcggcgagaacaaagggcagggacgaatgcagagcgagcggatgactcgcccctacaaggaattcctcgttcacggacaataattgcaatgtccgatcccaatcacggcaaattttcaccggcttaccaacccttttcgggggaaggactagcacgctgattttgccagtgtagcgcgcgtgcagccccggacatctaa

SEQ ID NO: 36589 - DNA, 1054 bp, Heterodera glycines
aaggggcgatatgaaggtcgtattcgtattcggcgaccctgaaaaccctaaattagactcctttcccgggtttttatgagctttttcgagttttggacatttcgtgtttttacccttatggacatttcgaggcctggacatttcgtggcttggacatttcgttggtcagcgtctcgcgaagagaaaataaaatatgacacgcaaatttcatcaacaggcaaattgttaatatttttcgcttaacaacaaccaatcggttggaaaattaagaacttttgtttggcacttttttacattttttatttttctccaatgtgttggatgaggcaagaaagaaaatttaaaacattgacgattatttcaccaatttgtcatttgaaaccactataaatgaacagagacttaaaatttgtggtttaaaaaagcttagcgatagacgaaaaatcactgatatgactatgccgttcaaaatttgccggggtaaaaaatcagtttagaaccaaaaaattattttatcttttcatctcgtccccagccaaaattatcaagactccaagttcgaaatacaaaaataaattattttaaagcacaattaaattatggaataattaacataatgcagcaatggaacttcccaccactgccaagtttaaaaatttattcagaattacatatattcccaagagtcctgagtgtttgatatgactttaagttagagttacacgggtccgggtatttggacaaaaaccgggtccggggaagtgcccttttagaaaagccgagtccgggtcgaagatgacgtagcaccgtttgaaaggtctctgccaccaccctgccctcccggacttcatctgtaattaatgaaaacaccgactgatggatggacgctgcccgatctgagctgctcgccatttcattcgcatgtgacaaaagcggtacaccatacaggacgccgtcattatgcgaattttgccggacgagtaatgcaacaacaatggtgaaatccatggccaggtgacgccgatcggtcttcaaattgaaggacattcaggaa

SEQ ID NO: 36590 - DNA, 1157 bp, Heterodera glycines
aaaaaatgcaaatttttattaaatgctagcttcacaattgcaattcaaatacatctcaaaatttttgtaatagtctcattctgttttcagcgaaaattttcggaagcggacaaatatctaaaaaacattccaaaatttcgaaaaaaattctttttaaaggtgtattttttaaaaatttccaaaaaagtcgatctttcggggtgtattttatttgcccgagtctatccgcggaaattgcgggacggaagagccagcggaaatgcgctaatttataagaaaatttaataataataaaaataatattgtgatttcaatgttaactcaattaaatgagcggaaaaaatgctttgatctttgaatgtttttcccatcaattttctgttctttaattttgtcattgtcactattttcaattcaaaataatcttacaaatacccaaattgttcgctcctccattaaattgacgaatttttttaaatttatttatacgaaaattcacaaatggtaaaacaatacagtaaaaagtcatacaattgttacagtaatttacaaaaatattaaataaggtggccaaatcaccggaacattttcaacgccctccctctccactaatcggcgctgctccggcgccaaccgccgaagagatcgccacgaatattcgcctccgtccggtaattgctggtgaggcttgagaaggcgctggaattttaaaaataaaattaaatgattaaaattcgaagtgccgtcttcgtgctcagcgtgtgaaaaaaataaaaaacagtacagtaaccgcctactcctccctcaccctcccgtactgtctactagactttcgtgatccccgttatttcatatgtgaccccagcttacagagtagggatggcacgaaattccgagttccgacatttttggggtcagaattccgatttcgtaaatttttggggtctcggaatgccatccctgatacagagtatgccattcaaaatgccatcttcacccatccctcgtttgcttttgcacttctgccgggaattggttggccgcttttgaaaagaaattgggacgataatgaggctgaagttggaaccaatcgcgttccgaagctgggacctgaagaaggaaaccgtctttctcccaccctgttcgattttttcccg

SEQ ID NO: 36591 - DNA, 604 bp, Heterodera glycines
tcccaattcccaacaatcactccctcccctccccccctcccctcatatcattccctcctcctttcatttgtccacccattcgctgatgacttattgtcagcaagcagaacaatgtgaaagatgcatgaactgctgctgatgaaatagcccaattaacagcagcaaatttttgccagcatttcatccatcagcaacagaaaatcaaaaacaattaattgaaaaagtcaaaaagaatccatttggcaagtttttatgcaaattgtgaagggggggggggtgaaatcgatggatagaaattgagctgtcaaaaggacggacaaagaagaaaagggggagggaggggaagcgaagtgaaatggaacgaatgaacgtgaagggaggaaaaaagacaaaagaaatgggtgaaaagcacccttaaataacattaattgtcccttttcaaataatttcatccataaaattggccacaaaatcaatcgggtctaaggaaactgtaaaaattggatgattcgtcgcggttattttggtccagctcatccatatggatggatgagtgggtaggagagagaatggtttggttgaatccctcagctccccgggactt

SEQ ID NO: 36592 - DNA, 654 bp, Heterodera glycines
agagtggccacgggaatacaaaaaaaaattgaaaacaatttaatttctgtagagggattgaactaggggaaagaagtaaggaaagtcaaggagactagccactaggccatttgcacacttaggagttttacttttaaagaatatattaattattattttttatttttccctttgactccaattttcttcactaatttttcactcagaccccccattcttaccagtgcttgtttttcccggttcccggttgccctaccgggaccgggaccgggacctgagcttttcaaaacccgggaccgggaaccgggaaaaacaagcactggtaagaattgattgactctcatttacaatggtccatcttctgatccgctcctcgacgttcgacgtctcggtttttttaaaggcgattgatataagttatttttgagaatgttatatggaaaatagacgatcttgggattatgcagatgcgatagagagccggcagctcaaaaaagttctgtggccgaaaatcggaagatggatcatataatttgagaaatcgtgaatccagcggcacgaaacatttgagtaatcggaattccgatggatcaaaaaatttcggactatcgaaaataggaattccgacggttcaaaatgaaaaatttgggcaat

SEQ ID NO: 36593 - DNA, 1187 bp, Heterodera glycines
  misc_feature (1079)..(1079): n is a, c, g, or t
ttgagatgccaccgctcattctccgcgaatggaaaccttatatgagggagttcgatggatgttatgaaacaaacggacaaaggagtggagattgcccattgaccgatcattccgatgcatcatttggaggagacttcttccatgtaattttgcacactcacgaaatggatcttcaacgtgtgtgcgacggaactggaacttgaaaattaatcaaaattatcattgcttataacaaatgattgggtttcgagtgtgggcgattggcctgtttttctaacattgtgtacatccgtcgttcaccgatctgtttgttctgcgtctgtccaacgtttagtggcccataattatggattcccgatcactatttcgaaatttgggaattcatcttattttcttttggcaaaaattgtgtccataaaaatatgggacgacatatttgacattagcctttaaaattttttccggaaaattttaaaaaactaatgttgaatggtccattggcaacaaataaaaattatttgtcccttacttttatatattttcaggccgaagacgagttcactctttcccacatcccttttctgggcgatgccgaggacgacacgtcattctgtgccgaactgatgaaaacattccaggacggcatccacggcacggtcaaaggctgcggagagttcgttggcccaccaatttgtctgtaaataaagtgcgaaatttttcggtatatcaacgactacattttatactacacactgaggcaactgagtgaacaactcccacacacgggcaagaatattttattgtttaaatgcgaattttgattaatttataaaaattgttgtccgattgccaaccttccatcggtataaattcaaattttaaattggacaagaaaatgccgagaacgacacaatcaccatacaattaacggcctctgttgtttcagacatggacaacatggttcagggtggtccaccagcagtttcctaacaaagcctccttccacgaactgcgagccctgtaatatttttttaattttctgaacttttcatttttcccctttttcagctaccccgatntgcagcgccgttttcagcccgagacaatttgacagcagcgcttcaccaacgagcaaggcgagctggtggaaaaatcaaaaatgaccgtctactgaacagctacgaact

SEQ ID NO: 36594 - DNA, 722 bp, Heterodera glycines
aagtgaggccgtcgactaatcatcacaatacaaatatgtaattttaaaggaactaaattttaatcaaaacattaatataaaataaattaatttgtcctgatagcgattctaaaaacaaaaaagatcccccctttgggttttcgtcgggtgcccataaagtaaaaaagtgccgctttttgtcaaaattttacctgataaaaattgccagccaccgggtcgccaagttcgtgctttttcgcgaatttttcagttttccaccctccacggttgtcaccttaaattttaatatataattttctccagggatttagataaattagaaaaaaaccaaatattaccagaacgattggtcaggtggccgtgttcggtgtctttaattgtgttcttttgttggtaaatcaggtagacgtaacggtgcagacccgtgtcctggggaggccccgaaccaacttaaaacggaaaattaaaaaaataaataaaataactaaccatattcacttagcacatcgcccttgtccacctcggtgccaggaatgttcacgacgagcctaaaagtcatggtttgataaaatcaaagtgttataggaagataaaaacgcaccagtggtgccattcgcggaatttcggctccttgcgactcggtgcgtcggggtctgaaaaataaacacgtttttgcggagacgataagccgaaaattcacaaaggttgttctttaccggtca

SEQ ID NO: 36595 - DNA, 467 bp, Heterodera glycines
ggtaagttaatcgctacattaaagaggagggtgtagcgtgtggtagtgcgggacacatcgctccctttatctaccacagaactcctcaatttttttggtgcccaatgctttggtgcgttctcgccgcgggcaccgttagtaggcatttagccgaaacgaaacccaaagcaaaaacaataaaaataaacattattttgaaaacatatttaagaaaattaaaaattagcactagcgcaaggtgcgcgagcgaagcgagcgcacctgcgctagttatattaatcggcagttaaccccgcccaccgttcaaaacaaagaatttttcgacgcgatttcttttcccttccattcttctccccgagggtgtttatttactgctttttcccttttttgctcactgctttttgtttaccattttcaatgactgcaaacttttttatttgtcatttttgcataaatttttgaatgat

SEQ ID NO: 36596 - DNA, 1477 bp, Heterodera glycines
  misc_feature (1372)..(1372): n is a, c, g, or t
  misc_feature (1397)..(1397): n is a, c, g, or t
cgaaaatataattacataaaaatgaaaaaaccttttgaactgaataacggaaaattgtttgaaaaggaaaagtgcatttcctcaggaatgaaaggaacgaaaattaattaatattaaattgcgaattctgttaaggattgttcgtaaacaaattattaataattaatatattaaagaaattggaattgtaaagggaaaacggaaaagcaaacaattaatgggaaaatggcaaatccaaacggataacacacaaaaacatattttaattaaaattagaaattgtagcgtactttggtgcaaaaaaaatcgtatttaaaggggtggacttttccggaaatttcagattcgagacaaacggttccctccgaagtttcccggcacccgcccaccgcctttcactgcacccggccttcgctgctctctgtctgtgcgagtgccctccctgtccgcgcctgctcgagtgccctccctttcctttgccattgtgtggcccttttggaccagccgttgcccgaatgcccttccttttcccatcgccgtttcgccgttctgaccccttttgattttgccacatttttccatttgtgatttatttactgtcaccgtttttgtgcccccttttccccgttcacattatcatgtttgtcccccatttttcgtttccctcaccgtcccgattgggacggtttaattacccaagtttgaggtcgacacaataaacatactcttattaaaattgtgcccaacttggtctatttgcctggacgaaaaccggcacgactcatcgctctccgatcggtcccgaccccctacgttcccccgaccggctactctgcgcgcctcgcccatttcatccccttcccgtccccttcaccccgcagagttcgacgcaaattttttgtcgccacgacaaaaattggtgccacgacccgggaccgtgcctttcccgctgtgcccatttgtcctgccgtgcgtcccgctgtgctcgttcgccctgttgtgcctgtccactccgctgtgcccatttgtcctgccgtgcctgccgctctgcccgtttgtcttgctgtgcccattcgtcttactgtgctgcctgtccggtctgcacctgattgccccgtcaaaacgtcaaattcaccgttgcgcaactgctcgtcatccggaagtataagggtcaccaagcccatacaaaatcaagggttgacaaacccaatttaaaaaaacacacacacacacacacacggatcaccaaacccaatcaaaaaaccgaaaaaggacaccataaaaagccaaacataattaaaagtcataataaaccctacagcaaacccatcactaatttaaataattaagtggacagagcgactcctaattncattactccgacgaccaaagccaancacgaaaagaaaacagtggcgaaaagcactacactgactgaacttataaaattaaaaacacaaacggggtacaaattaac

SEQ ID NO: 36597 - DNA, 962 bp, Heterodera glycines
  misc_feature (891)..(891): n is a, c, g, or t
gggggtcgggagcgtcaaaatgcgtgaattttgaccattagtgcgaacaatttgtccaaatagcttaatcgcttcacacaaaagctttgaagctaattactaaaagttcatacactgtacatagaacactttccttgaaaatgatggcaaatttaattattttaattggccactgaaaaaaagtttggcctttggctcgcgcggcgccggtggcaattggcctggcaatcgaaaagccaacgaccgaccacctgctgctgttgccgctaatagccccatcaaaaagggaggggtggggtcgattacacgatttgaactcattaaagccaattaaggggcgacggcggacaaaaaaaggacaacgaaaattggtatcatattcgtccaccactttctcacccattggtgtgccatacttaatttggtgatggcggcgatgtgcctgccatacgaggaacggcggcagcggtacggcacggcacgcacacagtcccatttaattggcattttggcaatgccagcatgatcattattataaattattattgcctttaccaaatttgggcggtgggccaattactgactaactgctgctgatattgctcccattattcttaattgtttaaactgatgctgcaaaaactttcctaatttttccgagactcttgagtcggaaattgacttgagactgaaaatttatgacttgagatccaagactcgggaataatagttggctcgagattcccaagtctgacaattggctcaacctgagactgagtttttatcaaaattctcgttccgtgacactctaattaatgtaatgcttaatttgtccgccgctcgaataattaaaattggctcggaactttctaggcctgaaattggctgaanaatcgtcggaaatgttccggcttcagactgatttcgtgagggtcacgagtcctaagaatttggctcgaaaa

SEQ ID NO: 36598 - DNA, 926 bp, Heterodera glycines
  misc_feature (751)..(751): n is a, c, g, or t
  misc_feature (761)..(762): n is a, c, g, or t
  misc_feature (790)..(790): n is a, c, g, or t
  misc_feature (794)..(794): n is a, c, g, or t
  misc_feature (832)..(832): n is a, c, g, or t
tagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactccagaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgcccccgaaacccaaaaaaaattttttggnataaaattannttaatgaactgactagataatatttaanatangttatttctcttcctttcagtatccctgcaaaagttgntgcgcttctgatcagtttctgaaaaaaaagtaagcctaaactttttgcctgtttaaaaaaattaaaaattttaaaaattttatcatctcccttt

SEQ ID NO: 36599 - DNA, 303 bp, Heterodera glycines
atgattgaaagaaatcatataccgtaaatccgctagttgaaggcccgggggccttctattattcaacccctccaaaaagtggcctttaattggagggggccttctaccagcagaggggagcttaatactcaaaaaaccccaatttttttctctatatatattttatttagttcttgtttttaccattttcggaaaaagttataaaaataaaagtgctttggtaattttggaccaaggggggggggggcaaatgttttttgagtggaaaattttttttcacccaaatttagctgaaaaatactt

SEQ ID NO: 36600 - DNA, 1476 bp, Heterodera glycines
tatatttcccccccccccccaatgttgtgtgtgtgtcactctcaaaaaattttccctttttttggcgtcacagcaattttcattagttgcaaaaaattcttggaattttctccatgttcagcagcaggtgggcgggcagtaaatagttattcgttttcattaaatcagcaattaaaaatttattgaattaaaaattttttgaaaatttcaaattccactgattttttaaaaaattaatttataatagaaatttatttttttataaattttgcattttccatagagggaagttaacattttacaaatattctggaaattttaaagattttttctcaaatttttcttcaattgtctaatccctaattttcttgacatgattacagggaattaggttagattaatttaagatttataatccgtttttacaaaatttctttggactttgtttgttttaattttcaataaatcgtgattacaattttacatatgttctctaatttttttctctaattatctttaaatccctaattgtcttgacctggttacagggaattaggttatgacggaaattttgagaattttatttataaaatttttcactttttaaaaaaaataaaaattatttccgcctttattaaataggataattagtttgcatttattacattttttaaaattatcatcattgtctcttccattaaattctccactttcccaatttcgtctcacctccccccccccccatttccattaatttttgttcaatttgcctttgtccctgccgccccattgttgtcaaactctcaaaaaatttctcagtattttttttttgtgtcacaacaattccatttttattattacaaaaaattcatggaatttccattcgttttccatcaaaatttgtcttcattttccacccgaaacttcgaatcaaatatttacaaaaattatacaattgcataaaatttctgagtttttgtgtgtatttttgaataggaaatttaatttaaaataatatttttaattattaaaaagatttgcattttccttttttattatggcttatttattttcaaatgaataaacaaaacaaaaaaaagtaatcatttatttctattcatttatcaaaacaaattaaattttattcgattcttttaatgaaaacttttttgctcaaatttaattctaaaataattaaactctattataaaatttattcattaaacaaaaaataaaataaattaattaaaagttttcaaaaaaaattcatttcaatttaaattctccccaaaatgtcaaattttcgtatttccttttctgtcgcccatcatcccacattaatcaaccaccacacatttccaatccaacatttctcaccaccgccgccgccgccgcattatttgctgcaacaaaaaatcctcccgcgaaaaaaaaagaatttttccaacccaaaaatcccacgtcattcacacatta

SEQ ID NO: 36601 - DNA, 1243 bp, Heterodera glycines
ttgcctttgtgccaccaaagttgctcatgctgtgccccctcctacgattcatttcggcattttagaatcaattaattaacatagaattttaatttaaactttaagaattgtccgtgtccatgaaaacagtaagaattttttgaaaatttttaaaaatcaaaatttagtctgtttgaactttgcttatttggcccaaagtgtgtccattcaattggccgttattgttgatggtcgaactgtgtttcagattacagtatcgggtgatttcttactgtatttgtgtttggtaaaaacagggagaatacaggaaccgacagatttttgaggggaggcggaattttgccaaatttattttaatttattcattcacaaggaattatttttcttggattattttgaataaaaaatatttggcaatctatcacttagagttttcccatttttcaataatttttcactattttaaaatttaaaattcttaatttagccataaatcctccgccaatttgcttgcctttatttgtcggcgaattgtgctttgaattttacaatgtaaaaagaaaaataatttagtttaatttaatttaatttttaattttttaaattttttagctcaatgtctcgcataatttgttcagcggatgtgccctttttgatatggttttgctccatcaaaaagtcattcacgaagaattgggctgcttcaaaattccgtgaattttattttaatttatttttttaaaatttaatttatcaactttaaattttgaatttagagttccaattgcttcggaaaatgaacattgaaagatgccatcgagaattagctaatttttgcgatgaaattacgattataattgttattggagaaatgattccgttttatttggccctgaaaaaaaagattgaaattaaatattagaaaaaccgcaagttaggcttaatgaataatattcctaagccttcttttgagaataatgaatttgctcaaggataaattaaaatattgcggataaaatttagaaaatttataaaattggttttttcttaaggttgaaactcggcacaaaattttaaaaaaattattaataaatattttgattcaaaattgtgccaatttttggaatttatctatttctttttttactgttatgcctcgctgatttgtctgtttgtctggtctcccgctgtttcatatgtccccatttatctctatcaatttgtctcatttctcttgcccatg

SEQ ID NO: 36602 - DNA, 1060 bp, Heterodera glycines
gagaacacagggatagttctgtctattcctaaatcggaatgaaaaaacgaattgacaaaaaactgaatcgaactatttttatcctttatttatttttcgctatattatgggatataatcgacatccgattttcatccctttgaacttaaagtactttctgtttagaggaccagatttgatttttttaaataaacaaatagaactgaaactggcgcggagatgcaattattcgaaaaatctttgcttaaaattaatggcatttatgcctccgaaactagaattagaatggcatgcgcgtattttttacaaatgcgtcttttgttacctttaaaaaaatcaaatccgatccactgaacagaaaagtaccaaacttaaaaccttccaagtccaaaacggctttcaccatttacccccccccccttttttgggcaataattgtacgaatttcgctgttaattattgcactgctaatgtttccatgtttataagtatttttggcgtttttttcggaaatatttaattgaatcggcattttcaaaaataaatctgcttcttacttcatacaattgcaacaggcgcgaagatgtaattccatgaaatctgctgtaaattattagcatgtatgcctccaaattaataatatggcacgcgcgcattttttacaatttacttcgccttttttttgatccagcaaagtaccaaacttaaaaagcttccaagtccaaaacggctttcacattttatcccccccccccgccctctctctcccatcagccatcacaagcccttttccttttctcctttatgccttttcattcataccctcctccctttccccattttctcagcccgcgctcaatgtgtctttccattccctccccctttcattttcaatcgatacaaaactgattgaagcgcctagagaaagataaacaaatgagagcagtcagacacagacgacccttgaaagggccattcgaagagcaatctcaacacgaggagaatgatgagagagagaaggcactgcgaaaggggaactcgtcgtcctttctgtcttaga

SEQ ID NO: 36603 - DNA, 838 bp, Heterodera glycines
aagtttattaggggaaaaaaagactttacaaaataatccccccctggagaagggagtgggaaacatgatttcaaaattttcaattttttctagtctaatctactcaaaccggttcagaattcaataaaaataacattcacggtgcgaaaaaaggggtttgaaaagtttattttgaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaatttttgttgaaatatttgtcgtgctctgaagggcgtgggaggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactatgcagggatactccccggtaaaggactaacttacactgaaatgagcgccgagctagctggctcaaaaaaaattttcgaaaatctgagtctttcgtttttatttattttttgcgaaattaattcataaatattttttcagaaagggttctgaaacgcaccaaattttatttacaagttaataaggctctctgatgctttttctatcaataatgga

SEQ ID NO: 36604 - DNA, 1139 bp, Heterodera glycines
  misc_feature (971)..(971): n is a, c, g, or t
  misc_feature (1124)..(1124): n is a, c, g, or t
acattggcgtacacaaaatcattcacagaagagaaggtggagagggaattatgccgtaattagcaccattagtgccaccaaaaatggatatcggtgagtgttgggcacctggcaaccaaccgaccgacccatccacccattgaacgtgttgatgagtattgtgagtgagtgagtggatgaaattgagcggagtgtgcactatttacatattaaattggggcagctattcacacaaataacaataataaatattgtttaaggaatattatttggtaaattaggaccaaattaattgggaatgtatttatgcgtaattttagtagtggcaaaaataataaaaacagctaattaaatagtgaaaaacagcgaaattcttttagagggaggtgggggacagaaaagaatggaaattttttagcaaatttaaaaggcgaaaatgaattataatcaattaagaaaaaaaagtaaaagcaagtgtctcatattttaactttagaaaaaacaacataaagtgaaaaattttgggaaccaaaaaatattcttaaatttatattttaaaaagattttcattatgggaaaaagacaagcctagatatctttgtctgcccaaaaaaatttcaaaaatttcatggcttatgtgtttacaattttttttcttaaatttatatttatcaggttttttatagctaaataattgcagacttctaattaaaaaatttaaaaaaaattcaaattaattttcttgcaatccgtacaaaaacttatttaaaaaatatattttgccatttttgataattgattttttttgttgcttcaaatcactacaaattcacatgcattgagccggaaaagccttcctttttcacacgcgcagcaaaacattgtttctcatgtgttcaataaccaacaacaaattgttcattcgtctgcttcggtcgtctcaatcggcggacgaaaagtgaataaatggngggacaggcagaaaatcctgttcttacgggggtaatttgttgctgggtgatgtgctgctgatcacctcgatcagtcagctgttaataggcgaacattttgtcactttacaggaaaaaaagtgaaattaaaaatatacaaaaatttatgaatancaattagtcattgaa

SEQ ID NO: 36605 - DNA, 1003 bp, Heterodera glycines
tttgccatgcaagtcaccgactgtggaaagcatttccttattaagttcaagcaaaagtttctgccacgcgagattagagtttgaagagagttggaccacccgaacctcgtctacttgtacaacgatttccagtggagcgactatcagttcctagtgatgcaattggctgttggtggagacttggtaattccctcttttgttttatgagtgttgcattacttcaccatttactcttcagctttcgttcctccaaaaatgtggccccgtcagcgaaacgacctgtcacaattggatgctccaaattgttgctgctttggattatctccaccgtaagggaatcgctcatcgcgatctgaagctggaaaacgtccttctttgtgaaaacggcgtcatcaaagtcactgactacggattctctaagcaggtggtgaaaattgtttttgcttatttgaagttgattttcagagttctgatttgtcttcaacattttgcgggtcgcgttcctattcgtcaccggagattttgcttggcatcgcttatgacatgttcaaatcggacatttggtcaaactctgttgtgccatcctttttatgctgatcataatttcaggtcattaggcgtcgccgcgttcatcatgatcacaaacacaatgcctttccatgaagacttgcccaaccagcaaatcgttgactcgcagcggaagcgccgttacaaatacccgtcatggcttaacattacgaagcaatgccgcactgccatcgatgccttgctgacttaccaaccggcttttcgtccggtagggttttgcttttaattcgcttctcattttctttcccattcagaacatctttgaatgtgccaagttggaatggtttgcccaagattccgcctctttgtggtgcggtggtcgtcgtgccggtgttggagtgatgggtcaagtgcgtgggcgatgataggccgtgtgatgaccaacggaagaagatacatttgataggattaaatc

SEQ ID NO: 36606 - DNA, 862 bp, Heterodera glycines
ttttgttctttttttcgtatttatttgaatatttttactaccctaatagatgcaatttattcgaattgttaacagattttttaaatgaaaatttaaggatttatttgtcaaattctggaaaaaatccaatggcattggacccgaatttagaaaagtgccaaaaagtaaaaaaagtgaacctctgatccgcccaccccccttttgtttggtctttgccttgtgaatgcgtccgacgcggcacaaaaaacggcaatttcacgcacattcccatttttgatctgacagaaaaattattttaaaaatattttatttttgatataggtaatttaattaatttattttttttgagcgcttactctgttttaaatttttgtgaattcacttttaattgtaaatttttttgattttccaatttatattttaaattaacaaaaaagctttctgttgatgatttaaacatttattgatgcattgcgaggagaccgcattgtgaagcccggcgaggttcggcaccagcacgggatagctgacgccggcaaattttttgcagcgactgatcacttcggcatggtcggccatctgtgctgaacggaatggcactaattgtttttaatggatttgccaattattccaggataaatgattagaaataattaattgcagtggcttttctttcttttacctgtgggacccatttgggcgacacaaaacttgtcgcttcgatggttttgagcccacaatcgctgagtctgtcgatcaaagtcactttggtcgctgttggacaattttctaaactatcgacattttaattgcctttaaaatttttttttaatttcgctgaaccctccactctcgaatctcg

SEQ ID NO: 36607 - DNA, 784 bp, Heterodera glycines
aaattattcgacagaaaagcaaatcaaaaaggaacaacaaattgaggaaggaacggagattaatgggcaaacaaaaggtgagttcatccatcaaaatcaactacctcacgcgaacgaacggtttttcttttccaacggcgaaccaatatttggggacccgacttatagggattcccgatatttggggaacacgacatttggggaccccacttttggggatcccgacttatagtgactcggcatttgggtttccgatatttggagaacccgacatttggggatttgtaacatggcgacacgacatttggggacccgacttatagtgactcgacacagggattccgacattttgggaccacacttttggggatcccgattacaaatgcccaaatatcgcgccaagtccttaatctaaggaattgggagggatttaaaatgtacccgcgaagctcagtcagttggttgtactccgaacggcatgaaaggccgtcatgggttcgagtcccaacgcggaacgattttgacatttcgtcatccgtcaaaatctccacattgcattaaaatattcaaaaaaatttccggctgcgcctatcggcaccaccggacctctacatattttaccatatttttttgtacgggacgggaccggggtgggaattcccggtctccgatgtcccagttcccgattaaaatattttgtgatttctactcatgggtttcttaccgagaaaatatggattctcttggttttttttaattgcacatattttatcttttttttaaa

SEQ ID NO: 36608 - DNA, 614 bp, Heterodera glycines
tagggttgagcggtaccggtaccggtaccggtaccgaccggtaattaccggtttttttggtaccggtaccgataccggtttttgcattaccggtcagtaccggtactggtttttttacaattaccgattaccgctcaactctagttttgtttctttgtttttctttcaaaaataatttctcatttacttttgtgttaatttgtatttatatgaattttattgtcttcatttattttaattagctatataaaataatttgtaaatgttcaaagtgctcttttttatgctgtcaattgttatgctttattctgtttatattagagaccagacgggatcggaattccgcgggattaaattcgggatcccgacatctggatccgtcccgacgatttttgaaattcatcgggattgatcgggatcgggatttcatcgggatcccgaaccgggatccctcccgaccattttaccaatcccgcaagatcccgcgggattgaagtcacgataattttttgaaaaaaatctccatttaataattaagatcttgaatttttaattaaaaaatattgtcatttgctaatttttcttaaaaatcctttaaaatcccaaaaattttc

SEQ ID NO: 36609 - DNA, 507 bp, Heterodera glycines
ggaaaggccagggattgtgtttgatggtaaatgaaaagattagggtgtagaagaggctgaatctggagaataatgggggtggtctgttggaagagggagggacgggaagagagcaatgcgaaattcagcggggaatggggagggagatgaatggaatggatagcagcaccagcagaggagcgattgaactgctgcaagtgggggggggggaggagtgcttggatgagagatggtaaaggctttgagcgcaatcgatcggggtggatgggatgcaggtggaagaagcgggcagccgaccccccccccccccgccccgtccccgcatcagccacccattacgcaccgattgctccatttaaggaaaggtttgctcattgtcagaggtatgcaaggaaattaaagtgaaaaccagcaagaacatgctgaagaatgccatttaataggtagataaatttcaagaacaaagaaaagcgagtttaatttaaatctactaagggattgaaactt

SEQ ID NO: 36610 - DNA, 728 bp, Heterodera glycines
aatgagtaattcttttttacaatttccaaataatttcttttagtcttcatttatattcatttaatttttacttttcaatatttaattaattgactttttaattcattatttaaaaaaattgttttgattgtgttttactaattgtaatttttaacaaaatttaaatcaatttcatctttgtatttatttctcatgcaaaaaacttgctgttattttgacttgtgagcaggtgagtttatatatatatatatatatatatatatattttaaatatatattttaatttaaatgaattactctttttaaaaatttatttaattcgcaaaaatttataattttttagcgttttttcgattgttgaaatattttaattttcttcataaatttcaattttattttctatattattatttttatatttttattaaattaaatttatattccttatttttaattaattgtatattataaaagtaatgaatttacttttttttataaatgtgaattatgattttttctctaataatttaatcttaaattaaataagcaatagaaataaaatcacattagttagaactctgaaaatattattctttttattcaatttttcttagattttctaaatattatgttttttaattagcttttatatactaataatttatattgtaactcttattaatttaaattatttaaataatcatcagtatttatggattcctttttaa

SEQ ID NO: 36611 - DNA, 953 bp, Heterodera glycines
  misc_feature (796)..(796): n is a, c, g, or t
  misc_feature (818)..(818): n is a, c, g, or t
  misc_feature (832)..(832): n is a, c, g, or t
  misc_feature (853)..(853): n is a, c, g, or t
aaattctttttcatgtttattattatcttattttttatttcacaaatacagaaattaaagcgttaaaatttttctttttgacgtgtccgatttcatgttaagttatgcgcagtaaaatttattttttacaaattaatgattttttgattatatatcgcttcacttcattcttttaaaataaaattatataattatttttattaatttttgaaaaaagttctttttttattctttttagttactgcattattcgtggcattgattcataaaaagtgaatcaaacacttgattgtatatgtttataatgaaattattaaatttaagttagaaatcatttagaaaaaatacaatcatttttattaaaaaagttaatataataaaattagttttgctattagcgtagtttcatggctctcagttgactgacgctcaatttgaaaaacaataaatttccacaaacgctgttttcacagcagtttggatttatatgaaaatcgactattttgcaaatagatatttttcgtgttcaattttggtaatttatacgatttacataaatataaataataatttttaaacaacatttaaatggttttaattatgaacctagaagaattaattttattattatttttttttataattttaaattgcttttgtagtattttatgttttaaaatgttgtattttctagagcaaagaaacaaaagaagaatattttttactcatataaaaatataagaatatgttttaattgcttctttcatttttgcatcaaataattttactttcactntctcctggcaaggataagcttngtgttttcaatggnggaaagactaaatacaagtgngtgagcatcaaaagtacgcaattttattatttagataatgaattaaaatgaatactttcatattcatatattttagaaaagattgatttttaattaattt

SEQ ID NO: 36612 - DNA, 1373 bp, Heterodera glycines
ttttattggatcgcaagataattgagcggcattttcgggcaacatgccaacctactaagaatgccgaaaccatttttgaattctcggttctgcttgccgaccataaaaaaaacaaaaaattgccaaatttaatttaattttaatttttttggaagggggcccaattatatgctaatttgtaagtaagtgcaaaagtatttttaaaaaatcaggcttaataaacagcacccatcagcagaatattggaatgcttctgttggtgatgatgccattccttcttggtatatatttttgaccctttttttttgtcatttattcttttaaatacccagattttagcctttcttttcaatgccattttgcgcgcatcaatttaagtgagcaacggatttgatgacgtgaaatgtaaaggacagcagaagagtcgtaaaaagaaagaagcaaatttttgcaccaaaaaaaatttaaatcgctaattatgtttattatcagaaatatttggccaaaactccataaaatagtcatttattaatttttcgtgccaatttatttattcgggtcgctcgccaccgtattcatttgctccgcagccatgcacttgcccaaattctgcaccatttttgtgaaaaaaggcagaaatttggcaagtacaaaggacagggacaagaatggtgtactgtaggtagtgaagacggtaacaatgagatgaatactgtattcatacctgcattggccgcaaataaataatagattaattgaaggcaatttatgaatacataaaatggcatttgaatatggcggcatgtcgaggggatggatgatacagtagtattgtactgttggccttagaaatatttaaacgaaaaaatacaatttgataattaattagcatgaatttgttcgactcgaaaaaaatctcgagattttgcggtcttctattctcggttaattattttggtgccgaattattaaacgctctaagcaaaaaaaaaaaaaaaatggtttaaattgactgaaaatcaaaacccgtagaggcaatagattatttttttaataaaatttaaaaaagctatttaattaaatggtagttttttctttataaatgctctttctccgccgtcattttctaaggttttctatagtttgaaaaatcaaatcaaaataggatgaaaacattgttgtaacaaaaatattgtactgcacaaaatacaatgaaaatggaattaaatttgaaaaaaaaaaaattcaaaagaaaaagcacaacaggtgtcttctgtcgtctgtctgtctggctaaaagcgatgaaaaaacgaaaaatgttgaaaaatttattattttttaaatataaaaaaacttaattaatgatttggcag

SEQ ID NO: 36613 - DNA, 654 bp, Heterodera glycines
ttgagtcccagtgatttgaatgctggtgggttgagtcccagtgattggaatgctggtgggttgagtcccagcgattggaacgatggtggattgagtcccagtgattggaatgctggtgggttgagtcccagtgattggaatgctggagggttgattccggcgattggaatgctggtgggttgagtcccagtgattggaatgctggtgggttggttcccggcgattggaatgctggtgggttggttcccggcgattggaatgctggtgggttgagtcccagtgattgtaatgctggtggggtggttcccggcgattggaatgctggtgggttggttcccggcgattggattgctggtgggttgagtcccagtgatttgaatgctggtgggttgagtcccactgattgaaatcttggtgggttgagtcccgacgattggaacgatggtggattgagtcgcagtgattgaatgcaggtgggttgagtcccagtgattggaatgctggtggattgagtcctggcgattgaaatgctgtgggttgagtcccagtgattggaatgccgcagatttgagtcccaatgtttggaatgctggtgggttgagtcccggcgattggaacgatggtggattgagtcctggcgattgaaatgctgtg

SEQ ID NO: 36614 - DNA, 805 bp, Heterodera glycines
acaaggctaaaatttataaaaatataagtttaccctttataattattagagggtgtaaaaaagtctcggttaaattctggagcggttgattttctgtaattttttttaacccataatttcgattcaataagacagattgaaaaatgaatttttctaaaaaaaattgaatttaaattaaaaaaaatttctctttattttttttaatgaaattatttttgtggaatttttgtcggtgagaaaaaattggtctgattgaaaagaaaacagataaaaatgctttttttgagcttttcatgcgatagcatattcgcaaaaaaaatatgtttaaacataaaaatcccagcactgataatgagggtttgaaatctcatagattgagtgaaaattcaaaattttcttaaaaaaatcattaaaataatttgaaaattttttaaggtataaaagaaatgattttattttttaaattaaattaatttacttaaaaattgtaaaattaattttgaaaactttgattttcttttcttgaaaaaattcccattttgtcccatttcgtttctccgattgccatcttattcataaatttaaaatttcccctttgtttgatatgtatgttgggtttaagtgtgaacttttttagtctagtcaagtcaataacccggccacgggttaatcagtgaatcattttgtggtttgggaagggatggcgagggggaggaaataaatttgaaccttccttcgcgattggatctaacaaattatttatctacataacaatatgtatgacgaaaaatgtgaaatgatcaga

SEQ ID NO: 36615 - DNA, 1293 bp, Heterodera glycines
  misc_feature (1183)..(1183): n is a, c, g, or t
ctgtcgcaatcgttctcacattgtccccattttgccgttccatttccggttctcacctagctttcctttatttggtttttgtccgcttcgactcaaattcatattttaaagtttttcgaagagctttcgcttttgggctcgtctaattattgggtagcgtgccataccgcgatagcgctctaaatcatcacaataatgcaattaatcttttgtatgttttaaaataacaaatgagcatgtccattttctcttcatccaaaagccaattgcctacgccgcccccgtcaattcccacacgctagtttagatactactaaagaaacagatgaactcattgctaaaacaaaaatctcgggaaccgctggcgggagggactcgggatttcgaccttgggggcaacttttgacggcgcatccaggaaaactataggcattccggtccgagggccaactgagcgccagcggcgctgaaacggcttttttaaatttttttttgctgtttttgggattcaaaaattttttaaagtcctaaatgaaaaatcggcctcgataggaaatcaagttgggaggtttggcacaactttttgctcttcaccgacctcgtagggcctaccagtttttccgaaaaactgcgcaaaaattgcatacttttttggccatttcagcgccggcggaataactcgtcggggtttggagggaggaggtcggtgtaagcggcttttttgtacagctcgacgagctctatccaaccatgtttttggatttctgaaattttcagaaattttcgagctaggccccctcgaaaattttccgttttttaattttattattttttacagatttttccggggaaaactgagaccactttcaagcaaccgtttttcatgctctatcgattggtggcattttcaaaaaaaattttcaaaatttttttggaaatagaaaatttttggttggtaagcctcaatttcagttctgtggctataacttgtcaggagttgattttatcaaaaaatcgtctaagagcttttttgtagagaattttaagcccaatctaatgtgctttatctcatgtttttaccatgagtttaaaaaaagttataaaattaattgtgattttgaaactcaaaaccataggggggaccccatggttttgcatttcatgaaaatttttttggtcctanattagccaaaatgcatttttatggcataatttgaggtgctgaatacgtatatacgctttatttttgcgttcagactttttggaaaggtgggtaaaaattttttgaaaatc

SEQ ID NO: 36616 - DNA, 145 bp, Heterodera glycines
ccctccattttttaaatgttttattattttaagtgtcgccaaggcttagtgatcaggcacaaaaattgttgcgcagcgaagcggagaaatacgctgcattattaatgagtgttgtacaggtgcaattattctttcatagattttt

SEQ ID NO: 36617 - DNA, 1189 bp, Heterodera glycines
aaaatagatggatgacttttacattgtgctaccctagaacacgccggaaccagggaacagtacatcaaaattcacagtacgactccccgagattttggaattgggcacaaatttggtcagtagctctctcatcaattatttacccctactcattcaccttactcggtataaacggtcaagagtttattaaagtatgggaaaacgacagcagtgtcccgactcaagtttatttaccggacatgaattttaaaaccgccgggggcctgggaaataaaattaacgaggcattcagccatcattacaaaatcaaaaaacaacgtggaaggagagaagccaaggctgaagataccaaagactcaaaaattgatgtcgcaaagagggccgcagaacgcgccgggagagacgtagaaagacattttaatcagatcaacaatatctcgaattccatccaaacccaactaaacacactacgagaaacaaatcctcaaattttagaagagcctgatataaaaatttggtttgacaaaatggttgagatgggaaccgaaattcaaacatcccgaaatgaacttaaggcttttcaagaagaagtagataaagccaaaaacataacattggagcatgtggaaaagaatgacttgaaaaaagcaaagaaatcagccgacgtcgcaaagggaatcgccagacaggcaaagaccaaatatacatcaactctcgagggatataatgataaatcggaaaagggttttagcgggatagtgataggcttaatgaggcgctcggtgagcatattaaacgtaaagatattgaaaatagacaagtatctgaaactgagaaaggaccacaaaaaagagaaagactagccaatgaggatgttcaatttcaatatgacagcattgatcaaaaatttattgtctatctttccgctgctgtctcccatatagatttgtcaaaacacctagcctatgtgctcggttttaagaacacaaggctatttcacgcggaagaggcgaattatataccagatttgacgggaggcgtaaggcagctatacatttatgcaccaaatttaatagaaaacacaattatcggggaccagatggctccactcttaagaatagttaacgtagtcaatgacccaggatcgattagtgaagttatatatagcaccgagtactttcatcgtcta

SEQ ID NO: 36618 - DNA, 1175 bp, Heterodera glycines
acgaaaacggcctggcccctacactggctacatgaagctctacctagtgctttcaaatgttcccactccgagtaagtgacatcggaaagaaaggaagaaaaagggacacgcggtggggaagggcgacgttctcgcgcctttttaaattgaggctattgtaaatcttcacgcaaattaggctcattccgttcggcgtgtccctctctgcccccgggggcgttcgttcgttcgtcggttggtccctttgtccttccctttcatttctcctcgctttctaaactatcaatagatttgataaataaacaaatatgcatcaacaacagttcattattataatttataaacttaattcgttgggcaactcattaaaatgcatttaattaagtaatttgtccagtcattctttcgccttcgcttctctttctgcccttttgtccagttgcttcgtctatacatcaagtgattgaataacccgagatgatcattgtgacagcgaacgaaaatttattggagcgattggtaattaaaggcattcattcgagtgccaaacgctttttggcactttcgcttcggtccctttgaaaggtccttttggtgcaaaataagccccgcggtgacaatgccagctttccgccgccggtgcgtgcgcagactgtgctgatcgcctcttcggccaacagttcggaatcggtcggattgcccactcattcgctggcccattgttccactggcgagggaagcactccgccacggaattgggtgttgctaatggccaagaagggattcggcgaacatttgaacactttgcgaacgctggccgacctctaccgactttccatgtcaaattcagtgggcatttgaaaaaaaacaatgaaaaaggaggaaaaattatttattgcttgaggatgaaaagggaacagcagcagcaacaggccaaagtcacatgcgaatacttatcatcaaaaaggatcgatcggacgacgacaaacggtgccttcaggaacacctcgacgcggtgcgggcggaatgggtgggcgaatggagcgccaggtgggagaagaacaggtggagacggaaggaacaccatcggaagaatagaacgattgatcggacaatgaatgagatgcttatgacagttcggcgaaagcgatgcgcaaaaagagcatttaatgcgc

SEQ ID NO: 36619 - DNA, 872 bp, Heterodera glycines
tttgtctttctgttgtagcgggtgaataaaagcactaaatagtgtgtttgaaaaacgcacgaaaaaatagttcattgacaaaaaaatgtgctatcttctgaaaagtcatctattaaaatcccctacccgggaaatgggacaccaaactctttgtctttctattgtagcggtggaataaaagcactaataagtgtgtttggaaacggcacgaaaaaatagttctgaccaaaaaagggtttttttgaaaagcccttattaaatccctccgggaaatgggccccaacttttgttttttgttgtagcggtgaataaacccctaatagtgtgtttgaaaacgcccgaaaaatagttattgacaaaaaatggctatctttgaaagtccctattaaatccctcccgggaattggaccccaacttttgtcttctgttgtagcggtgaataaaacactaatagtgtgtttgaaaacgcacgaaaaatagttattgacaaaaaatggctatctctgaaagtcactattaaatccctaccgggaattggacaccaacttttgtcttctgttgtagcgctgaataaagcactaatagtgtgtttgaaaacgcacgaaaaatagttattgacaaaaaatggctatctctgaaagtcactattaaatccctaccgggaattggacaccaacttttgtcttctgttgtagcgctgaataaaacactaatagtgtgtttgaaaacgcacgaaaaatagttcttgacaaaaaatggctatctctgaaagtcactattaaatccctaccgggaattggacaccaacttttgtcttctgttgtagcgctgaataaaacactaatagtgtgttgaaaacgcacgaaaaatag

SEQ ID NO: 36620 - DNA, 913 bp, Heterodera glycines
ttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgttttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctagtgattgggatgccgacgaattgcagagattgagtcccagcgattcgaatgctggtgggttgagtcccggtgattggaatgttggtggattcagtccgtgattggaatgccggagaattgagtcccagtgactggaatgggggcctctaaaagggggtcggggtcactttggcgcggaccacttcggcgccgcaaattttgaaatgctataacttttttatttttggcatcatttgaaagctctatgtgtgctctatatttcagggcggccaagtgtccttttttcgaagatttgtccttttttggaggggccggatctttgaaaactaaaatgtccttttttcgaagatttgtcctttttttggcatggcctacttgttttgtgcttattcatggat

SEQ ID NO: 36621 - DNA, 723 bp, Heterodera glycines
  misc_feature (402)..(402): n is a, c, g, or t
aaaattttgtaatttttaatgcgatttgttaacagaatttgtaaaaaaaatgaccaattgattaagttttgggtttttaggatacttaacatgaaagaaaaaagttggaatattttttaaaattaaaattttaattaaaataatggtaaagaaaatgtgaggaatattctatccaagtggggaattgaacccaggcgaaaaattatgaaaggtagaaagtttaaccactacaccacatgtgcatgtgtgtaatcccatgactaaatggaataaaatttaattttttctcaaaaatttctccttcttcaccaatttcctactcttttctcgaccagacccccattcttaccagtgcaaatttttaccggcggtaccggtactagacaaaccggtaccggtttntttcaaaaatgaaattaccgttaccggtttgtctagtaccggtaccgccggtaaaaatttgcactggtaagaatgggggtctggtcgagaaaagagtaggaaattggtgaagaaggagaaatttttgagaaaaaattaaattttatttcatttagtcatggaattacacacatgcacatgtggtgtagtggttaaactttctacctttcataatttttcgcctgggttcaattccccacttggatagaataatttacatggccggagaccccttcgcaaaatgggaaaattggctgctgacccctgttttgcaataatctg

SEQ ID NO: 36622 - DNA, 1020 bp, Heterodera glycines
aaaaaggagaagaataaaaaatctaaaaatttttattgtttttaaatatgcgaaaaatttaggcttacttttttttaaaaaactgatcagaagcgcaccagattttgcgaaggcatcaaaaagacaaggaaaagcacagctatgatgctaactccagtaattctgaatttaaaattttttattaatttttaaagcttcactattttattttttagcaaaattaattcatcaaattttttgaatttttttaagtgaaaaagtggtgggtgtctgcaaaaaattttcaccgggtttaaaaaatctagaaaaattagtaagcatttgtagtgttccgatacgtatccctgcaaaatttggtgagcacctgatcaattacaatttatttatggacgatcaaattttttgaaatttttttaagtgaaaaagtggtgggtgtctgcaaaaaattttcaccgggtttaaaaaatctagaaaaattagtaagcatttgtagtgttccgatacgtatccctgcaaaatttggtgagcccctgatcaattacaaattatttatggacgatcaaattttttgaaatttttttaagtgaaaaagtggtgggtgtctgcaaaaaattttcaccgggtttaaaaaatctagaaaaattagtaagcatttgtagtgttccgatacgtatccctgcaaaatttggtgagcccctgatcaattacaaattatttatggacgatcaaattttaaacgcaccaaattttatttacaagttattttaggcactcagatgctttctctatcaaaaagggagatgaataaaaaatctaaaaatttttaattcctttttaaacaggccaaaaagtttaggcttaactttttttttcagaaactgatcagaagcgcaccaaactttgcagggaaactccccggtaaaggactaacttacactgaaatgagcgccgagctagctgggtttaaaaattttttcaatgaatcacagtctttcgtttttatttcattatttattattt

SEQ ID NO: 36623 - DNA, 953 bp, Heterodera glycines
  misc_feature (9)..(9): n is a, c, g, or t
aaaattttnttgaaaatgtacccctaaaaaatagtttttttcgaaaaaagagatattaaaaatcaatttttaaaatactaaaaatgtgattctatgcctattttggtcattttgtggcattttgtgcctattttactttttacgatgaatttttatacaaaaaataagcattttaaaaattttatttacatattttagtacatagttggaggttttagtacatatttcatacatattttagcattttttatacatattttatttacatatttcgcgatttttcttacataaaaaaaagaagccctgctgatcagcactgaactgttattaacttttgatttccctccaaaatcgtattaattaatcgcccctggcataggtcggccccttcaattaccgcgtcgtgaacaaccgcgacttggtgccgcatatgccgcccctttggttcgaagggtaccgccaccatatgactgaagtgggacattcggcaaaatgactttaaaaacaaatcctaaggttttctataacaacgcaaagaacaaaaccgaggaatttgtcatctgcgcggatgaagccgaatcggaggaatgtgcgggaaaatattggtaagcaaagaaaggcacaattggaaaacaatttcaaaaaatgtgccaaaactgttgttcaggttctacaatgttcgggaccatttgaattattttgggaaatcggtgtccgaatggggagagaagggatgtgccaactgacagaaaaggacaaaaaagaatgaatgaattgtgcaattaataattcactaattgtagtagcaaaataataatccaaaatattttttaattttttattattattatccgaagaatgaaacttaaaaatatattaaattttaagggctctttttgatttgagtgggccattctcaactgaacatctgccaaatgatcccaaaaaatgat

SEQ ID NO: 36624 - DNA, 764 bp, Heterodera glycines
gactagggttcggaccccgcccccgtcacccccgccgggggcgggacaggttttttggcctcacccccgtccccgcgactctgacccccgcaatcacgcccccgcgaccttcgcccccgcgggggcacggggatgaaaatacacccctaagaatggcatattagtgggataaaaggcaaaaaatttatacaaatgtgaatttttaaccatctttgacaaattttttatgaaataaaataaattttgctgttaatttccgatatatttgttggtttagtggttagtgcttcaacactaacagtatttcttgttaggagttcgacaccggttgacgttttcatttgaatttatttttatctgattaatgcagggtttctttatgttcttatttctaagaaatgttctgattttagggcgtattttcatccaaaagaatgaaatttggctaatttctaacaaaatccataaaaaaaatttttcccggcggcgcctatcggcaccaccggcccccaaaaaacctatttttcttaaaaaattagcataaatttggtcattctttagacaaaatctgtgtaatttatgccaaaaggaattgaatcgaggcgatacatcgacgaaaaggaatgtggagccaacacatcattcataaaaattaatttttttttgtgagattttttggagctattcaaatcaaaaacccccgcccccgtccccgcggggaaggaattatcgtgcccccgcccccgcgaaaagccacccccgcc

SEQ ID NO: 36625 - DNA, 1121 bp, Heterodera glycines
agtgcgaaatgggtcatgaaacatttgtgatggcgacatttttagttgacttagataatttgatttgtttactagtgtctacatcgccactctgatgaaaatgctgcggacatcgcgtagatccacgatgtctttactgagtatgagttcccacatggtgaaatttttgggtcaagaattccatccacagtttgtgaaattgggagctagtggtgataacgcggatggtccttatccgagtgcacttccgttgaattgtgcgctcagtggtccagcagagggaggcgcaccgcggggcgcaaaatgaaggatgaacagcgaggcggacaagcggtcaagccccttgatgatccgtcgggattggtgctcgtccgcgttcagtcgctgctgctcatcattgctgagcaccaaaatgacaacccgagcaccttctcttgaatttaaaaaaaaattacaataataattattattttatgtaaatacgtattttttccagaatttaacaggctctattgaacatatttttctaaatatttattctcgcttttttttttagtttatttaaggtttttaaattggaaaatttcttttgaaaaaaattgaaaaattgtacctcgaattttattcaaaaaacaatatttttacttatcataaaagaaaaaaattaatttaatgcaaattttaaatgccgaattgatatttataaaatcattaaataaataaaaataaatttttttgtaagagaatttatgaatttaaatactattttacgacctatggaattggcggagatcgtcaatggacatttgcaatttgtctgccaatggcacagtgccgccaagttcggctgggtccagctgagcacggtcaagggcaaacagtgcatcatccaaatcaattgcagttttcaaggacaccaacactcgcgcattgatcagaagtgagagacgaattcgcttttggtagtgctcagcggaagcttgtcttaaaattaggcaatgatcaattataaataaatttaaaaaacaaaaaatattaaaaaaaacaaaaacaaaaaataaacatccgtcccttccatcccattaatgggatagttagtatcaaattaaaataagatttta

SEQ ID NO: 36626 - DNA, 669 bp, Heterodera glycines
ctaaataaatcccataaaattctcctgatttttctttatttttaaagctttatttcattaaaattggccaatacaacacattgttatgaattttcaaatattaggccaaaatcccgagggccaaaaaattgccaaatattttcgaatttttaaaaaattccaaaaattctgaaacttaaaatagacatcatattcgtacttagcaccttaaaaatacccagaaaaaaatttttcaccctctttttcaacccaaaaaaaatttccgaaaatttctagggggcctagctcgaaaatttttgaaaatttccggccatataatacactattcgatagcattttaaaagctctacaattttgccctaaggcgttttttcgataaaatcaacccctaacgagttatggacccggaactcaaatgtgccgcatatgtgaagatgataaatttatcttgggagagaaatgataaatatatgacaataatggacatactagacatttgtaggagcggaaaattcttattattctaagaaaattgacattatttattattttacttatgaattaaaaattgaaaggaaggctatctaataattaagactttcgttaaaagcatatcaaaataaaaagcacattagttggctagcgatggcatatgcgaggccgctccat

SEQ ID NO: 36627 - DNA, 560 bp, Heterodera glycines
  misc_feature (454)..(454): n is a, c, g, or t
catatattctttcaatcaaataatttttatttcttctctttacattcagttaatcagtcttcatcacttttctcaacgatttgacaaataaaaagcctaattcccataatccaatttgtctatttggtttcttttaccctccaactgaatttttcaattttcgttttaatttcaaatcgaactagctctgctatagctttgttctccctgatcaacagtgctgatcagtaggcttttcccagcctcccccctccttcaatgcttcttccgttgatccaaggcttccttcccaatgcttacatatcatcatcatcatcatcccatcctttcccagacattcacgccggcagcagaagcattggtgcagccagcagcatcagcatttaacattcgttgcacattgccgccgaggcaacggggcggggaaggagggacccatccgccggtggggggnggggggagataatcctaatcccattcaatattccatcgttccacgaattcatcctcctccagctaaagaagcatcagcgccaggcacacacatataagatggtggt

SEQ ID NO: 36628 - DNA, 955 bp, Heterodera glycines
gggtaacactacgcacttatataccagactcccaaatttgcggattccgccgcgggattggaattcaaatttttttttttttgcgggacggttccagcggtattaatcccgcaaatcccgtatttaaaatttgcagaatcccgcgcgggattttggaaactcgaattgtggttacataaatggatgttagagtcgtggtccctgtatggttggtcctctcttttgtaattcattttggttgtccgagttacagtgacacttttctttgttacagtgatgtgccagtgatttcacccgctgcattgaagctggaggcgtggctgaagttgcgcaagtttactgtttacgtaagcacaatgctagaaataaaaacttatatacgtaagccatttgccaataggcattggccacgcccatatatacgtaagccatttggcaatagacattggccacgcccaccatgcagtggccaatgaacattggtcacgcccaccaggcgggggccaatgggcagtcacacccaccatgcagtggccaataggcattggtcacacccatcaagaaggagatttggcatggtcacgcccaccaggcgggggtcaatgggcattggtcatgtcagccctgactggtcaggccacaatgcaattagcattattgatctgttatttaaaatacggtatataactcccctatgtgtactgtacaagttgttgtttgatttttaattttcattaattttttctaagcgtgtaaccagtgggttcctgtttgccgatctgtttggccagcagcgtgtgccatttgtggagctaaacggcaagcaactgaccggcaccactgatcgcatcattgaagagttggagaaatcggaagtggccaaagaaaaagcccatttgataatggacgaggaaaattttgaacgccatgggtacaatgagaaagctgaactgcg

SEQ ID NO: 36629 - DNA, 718 bp, Heterodera glycines
aaatttcgtaaattccaaaaattaaagtcaaaaataagactttttgcttatcagctttaaaatttagatcaattaaaatttattgcattaattcttacccaattaattaaaattgaaaaaaaatgtttaaaataaacattcaaaaacttaaggactgcaaaattcgtaggtcggtttacgcacgtaatccaccaaaaagactgatccatgcgtattaaactcttcaaaaaatccatggatgatgtagtcactcggattaaaactatcctccggacagaatgtttgccggatgcacttcgtgacgtactcacccgggccgagtctgatttgaaagccctgtttggacttggtcgttccttcacggtcgatgcatagggttattaaatccatcttgaaacttctcgaccgttgtccccgtgttgtaactcaatttcatcgctctggctcctctactccgaatactttattgccatcacataagagcgatttcaccgctcatatcccttctccggtacaacctataactagctcaacaataaaaacattgccttaaaaatattcatcgcaacccccgcattcgtacaactcctcagtagtgggtcaaaacctttcgtaatgtcgttaatcagtatccttctaaactcaattaattgacagcaataatattctccgtgtgcctttccgtaataatcttttcaattcatcatccaaataaaaa

SEQ ID NO: 36630 - DNA, 1134 bp, Heterodera glycines
  misc_feature (1032)..(1032): n is a, c, g, or t
acgagagtgtccaatttatggccgagagtctcgactttgcccacgaaattatccaagtgttgcttgtttttgtcattgtcaatcttctcgatgagagtgccaactttctgcacaagtgcatcaatttggttgttcttcttgtcatcatcatcattgttgttcttcttcactagagtccacaaaaatttgggatcatcttcgtttccaccggcgtaagctgaagacacctgtgaaaatgatgggcaaaattagggaaatggcaaaaacaattttatgccaacaattcatagccctcggcaatttttgcattttagcaaattttgatcagaaaagggagggcaacgagaaaaaaatgattgattgcgagaatttcttttaattttttgtgttttttatagaacaattttaagggaatttgttaaaaaaaattgtttttttcacaaaaaataaattaaatttttctgaattttataaaaaatgtaagttcgaaagtattagccaaaagccaacacgtttctggctataactttttcctttgccaaccaaatccaacattatttggatcattcgatatacctaagtgttctctgtaagcctgtataaatttagttaatccacattgtatcattcgttagatagacctaagtgtcctctattagcctgctaaattttgaaaaatttcgttaatgttcaagaaaatttatggctagaagaattattcaaaaaccagatttttccaactctttttggctcaaactttttttaaacttaacgaaattttttggaattttgcaggctaatagagcatgtgaagggctctcgaatatgcaccaagtttgttggatttggctttttttggtctcggtctcggggttttgggtctcggtctcggggtcgagtctcggtctcgagtctcgggaaatgcatttaccatcccaaatttggtgagagtgttgtcaaaaaagcatttttcttcttcttttcaattcttctggccataattttcttgaaacataataatacattttttanaagtcatttatttttctctgccacgcttcgtttgatcattgatttgagttttggtaagccagctcatgcttcttcctcttttgcgtacgtgtccttttctcc

SEQ ID NO: 36631 - DNA, 959 bp, Heterodera glycines
agacagaagagcatcaactggaaggataaaagggacaaactatagaaaagccgatggaagggattaacaaaagccgatggaagagatggattgattgggacgaaggccaaaacgtgtccaatcactgctcaaccaatcatgcggaaattggaaacggaagtcattgggacgaggcgaagagatggcattggcattttaacgtcaacagaagaagagaaggaaatgcccttgggggcttttcagcaatttgtgactgtgagggatttgccattggaggacgacgacctgcgaaaagtgacaatggcatacagagggatgaatagaaaaagttggcaaacttggccaagagagcgtcggaattgggccaattcttcactcttttgcgctttgatgcttaattgcaagacaattggctcagtgcgcaagtcatggacatttgatgacgagcatttggggggagggaagagggagggggagaaggagagcgagacagacagaggggagagagagagaaagagagggaagagagagagaaagagagaggggagaaagcgagaaagagagaggggagagagagagaaagagagggaagagagagagaaagagagaggggagaaagcgagaaagagagaggggagagagagagaaagagagggaagagggagggggagaaggagagcgagaaagagaggggagagagagagaaagagagaggggagagagagagaaagagagagaaagaagggaagagggagggggaggggggagagtgagagggagagcgagaaagagagaggggagagagagagaaagaagggaagagggagggggagagttagagggagagcgagaaagaaagaggggagagagagagagaaagaaagggaagagagagagaaagagagaggggagaaagagatataggggagagagagagaaagagatgaagagggaggggg

SEQ ID NO: 36632 - DNA, 785 bp, Heterodera glycines
tactcacttaatccgaagtttgtccccaattgaaagcttggaaagtgcgttcatcgcctttgtgttgctttccgggacagccaaccaaccaagcactttggtgaagccggcatcctccaccttacgagattggcacagaaactgctcaccgccaatgtcaaaactgtcataagtgggggggggggggggcaataattaaattaaaatacttacgtcgtcgaaaaaagggaacattttcattcattccctagcctaattcaaaaaaatttcaagggcatatagtttttcagtaacatctgggcttttgatgaaaaaatttcttgagattttaaaaaaattctgcggcgacgttttggggtacactgcccggcgccctccctcactgaaatatttcctgtaaggaaaacttacaagggaacgacccgaactgtaactcggaaaatgcatatgtgttatataccattggatagagcagggtcgacttctattgtggatttttaattttacgggcatatagcaagaaataaaaaagttatggggcctcaaaaatcgaaattttggccgtgttttcacttaaagttggtggctcagttggttaaatttgcatttttggagcttgggttcaaatcccacatgaaaataaataaattttaattaaggtataatataactaagtaatttaaaaaatcattttttaggctaacaaaaacgtatgctactatttctttagtaaaaataagcaaaaatataaataattgcaaaggttgggaattaatagaaagtga

SEQ ID NO: 36633 - DNA, 576 bp, Heterodera glycines
tcccatttttcagctggtgcaggagggcataagatacttcgccggcaaacgtctgatcactgtcttctcggtgccgcgctacaacaatcaaatgaacaccggagcagcactaacaatcgcggaggacctgagccacggcgtcacattcttcccgccaaattgaggacgcgatgcaatttgatgctcagattcccagttgtgccctcgttctctcccatgtccatatattgatgatcccttggcatatatatgtatgactcacttccaatttaatgtccatgtacagattcccattgcaactgttcatttactgcttctcacaaccccattttcgtgcattgtacatacatactgttcttttgatggcaataaataatgcatactaaggagaatgatagttctttttaagtgttaaaattatatcggctcttataccgtttaacccccataattttttcggaagaaaattttttgttttaaaaagtcgtgaaaacaagtttatgagggttttctgggtcgctgatcacgaattcggcatccatttcgatcaatttcgaatcccggacccgaattcga

SEQ ID NO: 36634 - DNA, 953 bp, Heterodera glycines
tgggatagagtataaatataaaaattccctcaaataaaagatcgattgcgcaccgccctccctatcatgctcgagagcatttgttgtgtataaaatttatcaaaaaaagagatagccatttttctgggatagagtataaatttaaaaattccctcaaataaaaggtttattgcgcaccgccctccctatcatgctcgagagcatttgttgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaagatctattgcgcaccgccctccctatcatgctcgagagcatttgttgtgtataaaatttatcaaaaaaagagatagccatttttctgggatagagtataaatttaaaaattccctcaaataaaagatcgattgcgcaccgccctccctatcatgctcgagagcatttgttgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaataaaagatcgattgcgcaccgccctccctatcatgctcgagagcatttgttgtgtataaaatttatcaaaaaaagagatagccatttttctgggatagagtataaatttaaaaattccctcaaataaaagatcgattgcgcaccgccctccctatcatgctcgagag

SEQ ID NO: 36635 - DNA, 1387 bp, Heterodera glycines
  misc_feature (115)..(115): n is a, c, g, or t
  misc_feature (178)..(178): n is a, c, g, or t
  misc_feature (213)..(213): n is a, c, g, or t
ttttttgtaaatgtctatcgcgaaacaatagcttagaaaaagcttctaaacatgtaatctttcgaaatgatatcaaaaatgatggatttggatgacattgaaaaaagttataganagttgtagtggaaaaacattctggcgcccaaacgagtgggtcccgaggtgtacatcaatcatnattatattaaatacttagttacaaaaactttattntattttttttgggaaatttttatttttttttggtagtgcttttaaaaaatacgtataagcaaagtgatcattccaacaaaaaaagaaaacattttatgagcacggcaaaaatcatttttaaattccttaattcaaaccgatcgtccatttcttaacttccattcacttaagccgagcaatccgttgagaagcctaaaaataaacagaaaaataaatttgaatttttgaataagcattcaatcattcattcactgacccgtccccgattttgtcagaaccagttatgttaatgcgcatttgattgcactgatcacgaatatgccagccaagcgcctccttttcccatttcgcccatttgtccgcgtcacgcacaattggacaacggatcagcagaaaacgacggctcttgtcgtcaatttccttcagcatcaattgttccccagtcgatttgttggtgatcgaaaatggcaccacgggaattggcaaaggcgacgcatcaaaccaaatggaaacaatgaaattgacgggagatgaagcggaggaaaatgtctaaaatgtgtaaaaattagtaaaaaaaaaacaatttaattaattaataaataatgccattaatgattaataagcaccagtttgaagacgtcaagtttcgtcgccaaactgtcgtcgttgtgtgagtcgcatttgaacacttttggcacgttgttttgaagcggagtgaaaagccatttggcgaatgcttgtccatccgatgccgcggcactgtcatcgcatgggaattcggcaaagagatcaccggcataaaaattgacaaaacgaagtgatggacattcgttaagaattgatggcgccatttgtcgcaaatgatggaaaaatgtggcggtcatttcaatgctatggatttttttcccgagaattggccaaatgttgcgcaaaatgagctccgagatgcaattgcgatcactgtccgtgttgatgcacaaaatgatttgacaggcggcaaaaagaggacgaaaatggtgaagaaaagtgatgatatttcggtcgatgtatctgtgaaaatgaatgggaagtgttggctaaaaacttttacatttggccatatcttacaagatgttgatccgttttccgatgatttgaatggcaacggtttttgcggaattggcaatggaattcc

SEQ ID NO: 36636 - DNA, 615 bp, Heterodera glycines
aatttcccaccggtgatgaaatgatgccctcctccagacaaatcagcgcctcgttgacgaaccgcgacaccacccgaatttgttggtcctccaccgacgaggcgccctccgatggactcagtttgtagcgtgccaaaatttcttgggccttcgcatttggcactttcttcgactttttgccaccctcggccgaataggtgtaaatgcctgacaaattaaggaaaaaaggttttcttttttttaattttttttactagcaaaatcaatttctgtcgattgggaaaaacaagaaggtcggtaagcagaaaaatttaatttttacgaaaaaggcaacattttttccttctttcaatgttattttacaaaattttaagtagcagcgaaaaaaaaacaggaataatagctatttttctaaccgaattttaatattcctggattaaattttcaaaaaatttggtagaggtccggcggtgccgatgggcactgccggggggaggggggaaatattttgtaatttaaagaaatacgaaaattaacgataggaaaattgaaggataataataattcttggacccacctgcacccgactttttgcccttagagccggcctttgtc

SEQ ID NO: 36637 - DNA, 1248 bp, Heterodera glycines
  misc_feature (1203)..(1203): n is a, c, g, or t
ggcgcatcggttcggggggactgccccgaaaacaaaacaatcgattttctcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccnagctagctaggcgctcatttcagtgtaagttagtcctttaccggg

SEQ ID NO: 36638 - DNA, 1104 bp, Heterodera glycines
  misc_feature (948)..(948): n is a, c, g, or t
ttataatgccgcataaaaattctgtttcaatttattttcttttatttaaataaacattgtacttttttaatttattctcttttttattcaccattttaatttaaattgataagagaacaattagtccattcttccctcggtgtccaataggaaccaccttagaatttttgaaaaattgaccagtctcgaaaaaattataatcattatgaatattaattaaaggctaattaaatttttagtaatttttaattcttttcacttttttaaaataatcatttttaagcattgttcatttattttataataggaatgtcggcattattatttatactcatgataatttattctatgattttttgctatatttaagaatttaattttatatttttaaatgatagatgctttgaaatattatttttcgtttctatttttaaataattaaatatttcttcaaatataatgtaatttcttaaatttaattgggttatcacttatgcaagagttaattattgatatgtcctactgctttattacttaattgctcattaaatgatgttataataaattctgtttaaacttcatatatttgattttttaatataataatgaattaaattaaagcatgcccattgacgtccttagtttaaccatttaataaatttattttacgtcattcgctttctaaataaaacaataattaattaattcatatttaaatccatgtccggtaaacatcaaatcgattcgatattaaagtgagtttctttaaattgattaatataaatttactgtgtttttaagtggttttcttaaatattaaaacagaattgcttttatttatacattaaatttgctaaaaaaataataatttatttttggctctaattatttttcttttgaatgattttctttttaagttttcatttaaacaattaaaactctgtttanatattctatagtgaaaataatataatttattttaattagttggtttgtttctactctttttcgcccttttatatgtttattttgtttaattaaatcatgtaacaaacaaatcttcgttccttgatatatggatttggtaaaaaaatttttgctttt

SEQ ID NO: 36639 - DNA, 1313 bp, Heterodera glycines
aattgctaaacccacgcggattcgaaccatcagtcaccacttcgccattgtgcaccacttgaccaccatcactgaagggaaaacacaaggaaatttccggtttttgaggccccataacttacttgtttttcgctatcggcccgtaaaattaaacaaaaaatgatgcttattttacaggattcgttcatcggaagcgcggacgaagacggcgacctttccttgaccggtgcgcccattgacaagcagggcatgtacagcttgagcctgttggacccggacaaggcccgcctgatcatgtaccagcagcacaagttgtacgacgacgtcatggaggtggcagcaatggggaaatgtgttacacgaggagaacattcatttggggaagcaatttattgtaaaacagcaaatcgcctgggaaaatgagaaatgtcccccccccaaatttttaagtgggcacccgccatgttttggtctataacttttttctttgtccaccaaatccaacattgttgatgtccttcgatagccaaaagtgtcctctattagcatgcaaaattccaaaaaattacgtcaattttgaacaaacttatggccaagtacatcagaaaccagattttcaatcatttttggccataacttttttttaaaccttaacgaaacttttcgaaattttgcaggttaattgctctctcaattattttagatttttaacctatctttcaactttgtgtcgcatctaattaagatgacatttacatctttttgatcggacgcttcaatttattgtcgtttgtcattttaggtttaaaaattttccttattcgaaaaaatttaaaaaattttaaatgcctatttccaagccctttcatgcttttttcaattttttatgtctttttgtgagattctttagagctaattcaaagcaaacccccgccccacgaaaagccatccccgctcacggagctcgaactcttttttaaatgctctttgttcagttttgtttgaattattatgccattgctctccgtcatcgtgccattttgtttatttttctacactaaattttggtggattgtctgtttgtattttgtttggtttctttacgactttgacacgccgagaagaggctcaagaaattgggtgctttttaaattcgcatttattaaaaaataattatatttttaattaatttccagttatggtacaaaaattcattcatatggaagcattttgctgattattttccaatcaaactaatcaaaacagctgaccttccaccgatcaataattacatattagggcacgatttaatt

SEQ ID NO: 36640 - DNA, 726 bp, Heterodera glycines
  misc_feature (101)..(101): n is a, c, g, or t
  misc_feature (104)..(104): n is a, c, g, or t
  misc_feature (109)..(109): n is a, c, g, or t
tttatgttgataaaattattgttgttaattaatgtaaaccttctaagaaagtgaagagagaaattgacatttatacacacctttattccaactaaaaagtnagnaaaantcagaaaattatcagaaaaatagcgaaaacattctgttggaaattgaatcgaaattgttggacaattcgatttgttggattttggagacggcggaaatgccaaaaatagcgaaaaatgaaaaggaaaaattggagaaaacttttgagaaaattttggagaattataaaaaaatagcatcagaaactaataattctgtgcgaaaaaattgcgaattttggaaattttggcgaaaagcggcaaaaaatttcggtttattatttttatttaatttacacaaaatttaaaataaaaattaaggaaaaaatataaaaatggcaaatgaaaaaggaaatttcgaatgtgagaacaaagaaataaagcgaagcttcgaaagtgccgtctataatgcatttgccgaagacattttaatggggcatttgaacgcactttcgaatttattgaagccaaaaaaaggcgaggaaaagccaattcaaatgggaaaagcagaggaacagcagaaagacggcacaaataattggtgtaaataaaaagattaaatggaaataaatttacattttaaggaatttcgacggatttttttgtaaggaaaaaatgaaaaacgaatcgaattttgcgc

SEQ ID NO: 36641 - DNA, 1385 bp, Heterodera glycines
gaataatatacatggcgaataaaaaggtggagagagcaatgactcggccgacaatctgaaatataaaataatttatcaactatttgttttgctttttaatagagtccggaatgtaggaaagtaccggactgttataattgtcaggcccagcaaaaaaagtacgtctaaccgggcggcacgggcccggtgtatttttgaaactggcccagcaaaagcccgtcgggctctttttttaatatgaccgagtgaaaaatgtgtcgtctttattttaaggggtggggggcatctaatttaggtaaaaataaaaaaataaccacaaaacggcgatgcactgttggggagaccaaattgtgcgggaaagtggagtgattggcacggttggacaacatcgggacgaatggcacaagaagggcggcacttttggggcgaaacgaacctaaaggaaaaaacaaaatggaagacaataaaaagatttttaaaagtcagggcttcacattggccagtctgtatttcgcagaccaaaacccaaacccgggtctttctttcttttcaggtcgaattcgaacaaataattaaaaaatacaaagttgggaagtcagttgctaaaatgtgtaagaaagaagtaaaaattggagaacctgctcctttggtcccaactctgttgcgagaaagcttcaaaagccacttggaccaggtcggtctggtggtgtaaatgacaccgataacagtggcactgccaaaggtgagcattatcagactgtcacgggcataacgctctctgtgccacacgtcgttgggaaactgaccaatcaaacaatcttttatttgtaaaaaaaggattttcaagataccctaaagaatagtctgaggctaaaatcttagtccctggtgacattgaggtaaggatttctcttttgaacattaaaaacaccaaatttaaaaattctaaacaaatacaataccttttctcgtggcaatttgtgtttctgtttgatgatcggctccaactccataattgcaataaaaaaatttcaaggaatatttatttggcttctggctggttttaggagaaatgaatggtgaatggaatggaaagcaaatcgatgcaaaaaaataataacatttcgccataagaattaaatttcaaatttaaaatagtgacgagaattattaatttttagtgcgatttgataaataaaattatgtaaaatattatatattctgccattatttctgtcgacgataaacgggcgatcggttcggacatgggcaatatgcttaaaatgaaacccgaaataaaatgtttgattccccccaccggcatctgtgccgggaagtccaattgtgccgcggatgcccgctgatcacgcgcgccagggaggcca

SEQ ID NO: 36642 - DNA, 732 bp, Heterodera glycines
atcactgggactcaacccaccaacattccaatcaatggcactcaattcttctgcatttcaatcactgggactcaacccaccaacattccaatcaatgggactcaattcttctgcatttcaatcactgggactcaatccaccaacattccaatcaacaggactcaacccaccaacattccaatcaacaggactcaacccaccaacattccaatcagtgggactcaacccaccagcatttcaatcactgggactcaattcttctgcatttcaatcactgggactcaacccaccaacattccaatcaatgggactcaattcttctgcatttcaatcactgggactcaacccaccagcatttcaatcactgggactcaattcttctgcatttcaatcactgggactcaacccaccaacattccaatcaatgggactcaaccgaccagcattcaatcactgggactcaattcttctgcatttcaatcactgggactcaaccctccaacatttcaatcgccgggactcaattatcagactttccaatcgctgggactcaacccaccaacattccaatcagtgggactcaacccaccaacatttcaatcactgggactcaattcttctgcatttcaatcactgggactcaacccatcaacattccaatcgctgggactcaacccaccaacattccaatcaacgggactcaatccaccagaatttcaattaccgggactc

SEQ ID NO: 36643 - DNA, 1154 bp, Heterodera glycines
atttccttattttattaagtaaaataatgatttattcagttttttaatcagaaaaaaatcatttaaatgcctcgaaaaatgaattgccatttaattgaagaaaaataaaataaaatcatttcgagacgacaaaaatgaaattatttccgctacttttattaattatattatttttaattgtcaaaattggagcagaaaagaaaaagttacaacaaaagtcatttggcgaaatatttggagaaaaatggcaagaaaaagaagaagaaaaacgaaatgagcagaaaaaaagagaaataattgaaaaatattataaaataaaagagaaaataaagcaaaaaggaagaaaatacccaacaaaagaatgggataaaattaactcaaaaatagcgaaaaaattggggacaaatcgaaattacattcaaaaatggatcaaagaattggggcttaatcaaaagaaattttataaatcaaaaagtgatgaagaaaaacgtcaaattattcaaaaattcattaaaatgaaaaatgaatttaagcaaaaaagaaaatattctgcaaaagaatggcaccaaaattatgccgaaatttgtaagaaaattggagttggccatgacacaattaaaaaatggaagaatcaatgtggcattagctgtaaaataacggagaaagaaaaaactggaaaaaattaaaatttattggaaaataaaaatgaaaagccaaaaaagaatgatgaaaatattgtaaaaaaccttggattttttagaaagaaattgttgacttttttccttttataaaaattcccatttattttctttaatttattaatttatacgcaaagcttaagaatatacaaaacaaaaacaatggaaaaaattcaaataaatagccaaaaaattggggacaaatcgcccagatagattgaagttcgaactagagctgagcgggaccgggaccggggcgggaaatcccagttttttcaggtcccggtcccggtttttggaaaaattgaaatccggtcccggttttgccagtcccggttcctgcaggactaaataagcactggtaagaatggggggtcttgtgagaaaagagaaggcaattggtggagattgagaaatttttgagaaaaaaattaaattttttatttcttttaaagt

SEQ ID NO: 36644 - DNA, 795 bp, Heterodera glycines
tggtgaaaattgggccaaattgggaggacatgaagttggagcagtacaaccaggaaatgggcgatgacaattgggacaggacaaatgagcgcatggaaatggaaatgagggaggtgcgcatggaaataaattggccaaagagggggcaaaaatgggacaaatatggcggtgaacggggccgaggagttggagctgttcaactcccaatttgttgtcgatttggagaaatgaagtgctgtttgttaagcacacattaaaagggacggaaaatggggagagttgattttcgaaatccgtgtttcgacaaaatgcacaacaaaaaaacactttggaggacattagcacgacggcgctggagtcggagccgagccgacgaatgaggagctggagacctttgccaagatgttcaaacagcggcgggttcagctcggcttcacccaggcggaagtgggacaacaactgtacgacctttgtggccaagtgttctcccaaacgaccatttgccgtttcgaagcattgtatcaaagggcggggggggggggaagctcccggacaatctgtcagtggacagttcgttagcaaaatttattttaaaacaccatattttatttaaaatcagtttgaaaataaatttaaattgctaaaaaagagaataataatttgtattattttataaaaaattatgaaataagatattaaattatattgaagtataagtaactagaaatactgacggattgtccttcactaacggattatccactgatggattgtccgtccgtgccccgggggagg

SEQ ID NO: 36645 - DNA, 410 bp, Heterodera glycines
taccagggatgggccgaggtttcgcttttcgcatttcgcctttcgcattattcgcattttttggcgtttcgcatttcgcttttcgcatttcgctttttggcgcgaaatgcgacttttacacccctaagaattggattaaattcccataaaatttttcaaaattttacctataaattggctaattttcagtgaaaaactgtttataaatgatcaaaatttccaattttttccccggcggcgcctatcggcaccgctgcgcccccaaaactcctattttttcttagaaaatggcccaaaatcgcaaaatttggtaatttgatgaaaaaactgttctcagcggcgcgccaaaactcttatttctcattaaaaaaatgatacaaaaatcacaaaatttgatgatttattggtga

SEQ ID NO: 36646 - DNA, 536 bp, Heterodera glycines
cctgcaaagtttggtgcgcttctgataagtttctgaaaaaaaagttaagcctaaactttttggcctgtttaaaaaggaattaaaaatttttaaaaattttattcatctccctttttgatagaaaaagcatcagagtgcctaaactaacatgtaaataaaatctggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaactaaaaaatttttaaaatttaataattttcctgcaccgaaggtactcactcggcctcttcgcggcctcgtggtgggccttcggcgccggaaaattattaaattttaaaaatttttta

SEQ ID NO: 36647 - DNA, 708 bp, Heterodera glycines
tcgtcggcaaatttatcacagcaattacaacggaggcactccaatttttgaccattcttaacgcgttttttagtgattttcttaaattgggtaagcaattctaaaaaatattttcaaaagatttacaaaatgaataattgcaaaaaagcgaataaattcactcattttacagcaattaccattacgaaaataggaccacaaaacaaggtttgatttatagtcccgacagacttacgttgcaaaacgaacaaagtgcggtttgtactcaatgcaatgcccgcaccaactcgaatagaattcgacgaaaaatgccataggctaaaaaacaaataatttccttaaaattttgttctaattgactactaaatagaatagtggggatgaaaagaactgcataaaataaaattcttaagcttttttaggaaacgatacctaaatccataaaatttaagctaaaacctctaaaatgaccaaatatgacattgacccctttagaaaaaaaaacaaaaattcatgttcagcagtgaccgccattgtttttacggacaaaatttttcttcaaaaaagggaaaggagatcgccagtattacttactaaaattcgtttataattcataaaatattttttgaaatttaagaaattgatttaaaggaagggcgctttaatagagggagtgattctaacagagaagtttgagaaaatccgaaa

SEQ ID NO: 36648 - DNA, 388 bp, Heterodera glycines
  misc_feature (83)..(83): n is a, c, g, or t
aattagaatttcttataaaaaagtttctaaaaattttttcttgaaatatttttaagttagtgaattttattaaaaaaaatttncgggggaaacaataaggggggatcagattgtgagctgctcccaccagagccgacctgttcaggaagctgacgcataaacgacacattccatccctccaccagctgtgctttctggtcctaaaatttcgtatggaaaatggacaaaaatagggacgaaacacacattttgcagaaacggcaacaccggtgggtcgacacgttgcagaaaatggatgagcatcacaatgtaggcatatgaagagattgagccggcctaaacacaccgacaaataaataaggaggtcacagacaacaatttgttcaat

SEQ ID NO: 36649 - DNA, 1778 bp, Heterodera glycines
  misc_feature (702)..(702): n is a, c, g, or t
tcgtttttattacatttttgttaataattttgggcaaaacgccaaaataggttttttcatttttttaggtttttatgttctaaaaaataaaaacctaatataggttttaaaaacacgaaaagtagcttaacaaccaccaaaaaacatattttcgtgcttttcaggccatagggaactcaggaaaaaataggctaaaataaaaatacatccctagttacagtgcccccatgacaaaatgaaacgcgcctatgacactatgacacgtcgtgtcatacgtcgcatatgatttttgcggtgatttaattaatatgacactattaattccttcataacttttttgagaaacaagcaattttaatttagttttatattagatagcccgaaattctctattattcagccaaatttcaaaaaatttcttgagtttcaaaaaagttagggtcataattgttcagtccaaatttttcggaagtttttggttacaacttcttgtgaattttagttagatttttaaaaaaattaaatatagtagaggaaatgtagagatactttctaatgccaagtttaattaatttgaataagtttaagataagttataatttattatatagcaaataaaattaaaacaataattaagtttaattatttcgaacattgatactttggggacgggacaaaatcgccgaaatatcgccggccganatgtcgccgagacaaaatatcgccgtgccgcagaaattaaaaaaaaaaaatcttcgggcggcgatatttctgcggcgatattccggcggcgatattttgggggtgtactcgatactttttgtcacttgggctcaccacgcatgaaaattacgaaaaaatcgaaatttttaattttttcttaataactttttatggttatcgggaaaagggtttattaaaatatttagggtcatgtcgttgtaatctgacaaaaagggacaatcagttttggttattacctagattcgttttttgccacaagtcacttttgagagataattggtgaaacaaatattgagaaaattaatttactttaaagatgtatttttaaattattattattattattattattattatagcaatattttattacaaattggaaaatatatagcttcatcgggactctgatgttctagttttggtatttgttctgagatttgagaaactatgccaaaccaagcattaaaacagtgccaattttttgaaattgttgaaatgcgacgactgatttgcttagaaatgtttaaattctttttttgatattatacagtcatggtcatatgtttacaaagccgggtgttaaaaccaaagaatccaataaattggcactcaaaacaaatgcaaagataaccattcccggcaatgggcctactcaaaatttccataaaaattttcttaaccccctaggaatttttttcgaaaattaacatgtaaacggtagatgatgaaatagtaagctcacaaatacagaatccggcattatttttctttggtaattagcttgtttttttccaaatttaaatttttttaaattggataagagagagaggcgcccgtggtgccaacaggcgccggatacggaaaaattggaaagtccggtcccgatttgcccaaaataaactctcttcccataaagtctaagtttaaaaaccaatatttttagtctgtaaaactcaggaaaaatataaatttatgacgacttagcaataggaatgaaagtgtaacataagttaaaacatattcttcgcccatta

SEQ ID NO: 36650 - DNA, 1234 bp, Heterodera glycines
  misc_feature (1095)..(1095): n is a, c, g, or t
cataccataccatatcataccatatcataccataccatatcataccgtatcataccatagcataccatacccccccctgttttgttatgtcactgtgttaacctttaaaaaactaataaaaattattccaatagaaattaatttgttttacttcgtcccatttattttattttatgattttttttacatgtaattttaatgttattagcatcactgaaaccttaatactagtttctttttattaatccagagttattaaagtattattccaataaaaaagaattttgattttttacttcgttccattttattttatgaattcattaataataataatttatttttatttttataagaattagtgaacttaccatttaaatttttctccatggcaaactccaatcataatcaacttcagcaaggacagtcagcacttggaaatgtatattttggcacatttaatattaatatatcattaaaaaaaatgggttgttttactcaattgatctgactagccaacatagatttgtcatttatattaatttccataattgttcaagaatgtattctgcaccgatggaacgcacaatattcagttcttgaatggatgcgttacccaaattggccaacctttaccgtatgtttttttgatggtgaagactttaaatttgtgttccaagaccgctctgcctgatcgttgtttcaattgatcaccggcccgaacaacagactcccgcaggattgctttctgtgactaatgttgtgttgcgcaatgccgatggtcatcggattgaagcttcgggatggcaaactcaagcgggtgttttggcgtcattgtccataggaactgcttactggttcatgaactgtatggcacgttcacggtatcagcgactggattgttggtaccgaattggcgttgatggtagaaatgctaccataattcctcacccaatacaccaggtaatttttattattattattattattaaaaaaaatcactgattagcaaacaaccaatgctcgtcctaatgaatcagttggacttcgtcactcaatcgcatctattttgggggaacaaattcaagtttttanaaatcaactaaagttgtgtataatttaattaaggctcaaccggtgcaaattcagacggggagtggtcgcaatgaagtggtctgatttatttaaaaaaaaattttaaaaaaatatataggtaaatggaaatttgaatggt

SEQ ID NO: 36651 - DNA, 947 bp, Heterodera glycines
aaaaaatgagaaaaaagagatagacattttttggtcaagaattttttttgtttgcgtttcaaatatcgtaagattgtttgatagggccagacaagagaaggcaactgttggtaccaagtttgcggtaaaaaaatgagaaaaaagagatagacattttttggtcaagaattttttttgtttgcgtttcaaatatcgtaagattgtttgatagggccagacaaaagaaggcaactgttggtaccaattttgcggtaaaaaaatgagaaaaaagagataaccattttttggtcaagaattttttttgttgcgtttcaaatatcgtaagattgtttgatagggccagacaagagaaggcaactgttggtaccaattttgcggtaaaaaaatgagaaaaaagagataaccatttttggtcaagaattttttttgtttgcgtttcaaatatcgtaagattgtttgatagggccagacaagagaaggcaactgttggtaccaagtttgcggtaaaaaaatgagaaaaaagagatagacattttttggtcaagaattttttttgtttgcgtttcaaatatcgtaagattgtttgatagggccagacaaaagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagataaccattttttggtcaagaattttttttgtttgcgtttcaaatatcgtaagattgtttgatagggccagacaagagaaggcaactgttggtaccaagtttgcggtaaaaaaatgagaaaaagagataaccattttttggtcagaattttttttgtttgcgtttcaa

SEQ ID NO: 36652 - DNA, 1104 bp, Heterodera glycines
ttgaaatcgactgaagaagccagcaactgggtttgccaaatcgccaatttcttctcaaattccggcagcacgatgcatgcacaaacaacttttcaatatcaaacttttttacaaggaaatagatgcggttcgaactgcgatggtgtatggcttggaaaagcgattctttgatctgcgattcaaacggtgattttaagtggtgtcttttataattttttattcaatttcttttaatttttagttgcattgccatttcgaccttcttggacccccgattcaaggaccgtctggtgatggaagacgcggaggttttccgtgaaagagtccgcccgtggcttttcgaagaggcatcaattgctttcaaccaaattgaaaacgaagaaaatgatttgattgctacaacttctattgaatcgccgccagcaaaaaggaacgaatcattttttgctcaaatggaggaaattgccaattttgcacaagaaaaaagtcgtttttgttatcattttatttttcactttaaatattttagctcaaattgcctctcaaagcgacattaactcagaatttaacgaattacttagtttcgacagagcaccaatcaattctgacccgtttgaatggtggaagaagcatggaccaaaacttccaatgttatcaaaattggcgatgaagtatttgtcagcccctgcaacaagcgtgccgagcgaacagactttcaaagtggcgagggatgtttatgattatcgacgttcgagattaaagccgaaaaccgcagaaatgttgatatttttgaacaaggccatcccaatgttggactacaaatactgatttaattttgttggatgataaaaagttcataaaattttccataaaattttggtttagaacaaagaaaagaaattacgcaatttttttatatttataaatgcatttttaaaatttgaaaaaagcccgggcccggcgggcgcccgacaaaaattttggaccgggcccgggacgcccggtaaaacgggcttttttttgaccgggcggcccgggcccggctaattgtcgaagcccgagcccgggcccggtcccggcattttcaaaattccggtctctagt

SEQ ID NO: 36653 - DNA, 792 bp, Heterodera glycines
  misc_feature (703)..(703): n is a, c, g, or t
  misc_feature (758)..(758): n is a, c, g, or t
  misc_feature (778)..(778): n is a, c, g, or t
atggccctattttttccagcaacgaccgatggcacaaccaaaaatggcaatcaaaaaacgcttttcatgcactctttgcacaaaaagttttgactggttctcagacttaaagagagatatgcgcgtccacacgggcgagaagccatttgtggtgagttacagatcttacattttaataagtaagataaaaaaaatgcaatttttattatctgttaacggagtaaagaccgtttaagtttaaaaaagaaaattattttctaagtttattttttaacaaatggagtaattaaataaataataataattgaattttacttattttttcaatatagtgagaattttgtgacaaggcatttgctcgaaagcatcatcttgactgtcatcaacgtattcatacgggcgaccggccctataaggtgagttgaaaattgtttttgaatttaaaatttagtcccccacccctcaaaaaatttttttattttttaataatgcgattttggggtataatgatttgaaaaaaaaatttcaaataattttaaaagatgaatttacaatttatttgttagtgtgaccattgtggcaaacgcttttcggatggcagcgccatgaaacggcaccagcgcatacacacgggggaaaagccttatggggtaaaaatgaactcatggaaaattaaattgtgctctgtaaatgcatgctgttnaaacagggacgtgggccagccattccatgtaattactgaatttgaaccccccggnggtctatttttcaacccctncaaagggggattta

SEQ ID NO: 36654 - DNA, 932 bp, Heterodera glycines
cgcgaagaggccgagtgagtaccttcggtgcaggaatattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttccctatagcctgtactttaattctgcgttggatttttgctcccccataattgtttgagtaccccaaacggacacttgaaaaaatcgatttatttttgttttcggggcagtccccccgaaccgatgcgcccagatttatggggagaccgaatccttcgggagtagcttccctatagcctgaactttaattctgcgtgggatatttgctccccataattggttgaggacccccaaacggacacttgaaaaaaaccgattttttttgttttccggggcatgcccccccgaaccga

SEQ ID NO: 36655 - DNA, 1018 bp, Heterodera glycines
gggagggagagagagagataaattgagagagggagaggagagggaggggagagggagagagagagagatagaaagagagaggggcaggggggagagcgcagcgcgagatagaaagggtggggagaaggaggggagatgaagatggacatggggagggagagagagtgtggggggaactggacagagatatggaggggagtgaggtggagagagggagggcggggaaataatataaagcaaattttgagaaaaataaaataattttggagggttttttcaagtttcaaacacaggggaaaggaaaattggagagttaaaatttaattggcacatatttccgacacaggcggcagaaatttaaatatttttaccaatagcattacttttctcatgcaaaattataaaatgaaatatttttccaataaattttttttaatccttctcacaagggtgaggatttttttagtttcatgtacttttttatggttttgtttcacttataaatgcacaaaaaaacattatttttatcgcggaaacattcattttatgtcactattcgtaaccattttgaattttagaaatagaaacaaaaaattcaataaatcgaaaaatacctaagacttgtatttctacaaaattaaaaaaatgattcctagagtcagaaatgttcaatttttaataaatttctattgcaaaattctataattgtcttttgacaaactaatcctcaccctttgtcactaatcaaccacttttctttttctcttcctcttctccttctccctttttctcttcctcttctccttcttcctttttctcttcctcttctccttcttcctttttctcttcctcttctccttcttcctttttctcttcctcttctccttctccctttttctcttcctcttctccttcttcctttttctcttcatctgctccttcttcctttttctcttcctcttttccttcttctatttcatcatgtgcaccccttaattattttaaacaaataaatcaa

SEQ ID NO: 36656 - DNA, 785 bp, Heterodera glycines
tctagagtcataggacatggtagactactgaaagagggaatacagttcttttgaggagatacagtggatgcgctaatggagaggaagacggtaggcaggacagttactagggatacggcgactacatcagcaaaggatatgaatatggtaggctatggaggtggagcatacggtgactatggaaagggatacggtaggattaaacttattaatgaattcctcattaattaaactgtcataagattactcaaatggaaagggaaattacggtgccggaggaacgggttacggtggttacaagccggcgaatgcggattcatccgattacagccagacgaaagggacgactgcatacggcagccaaaagtaccaactgcaacagcagggcaaatacagtagacctttcaacatcaacagctacagaaagcattactacgacagtgagacagtcaaatgcgatcaaatttggtgaatactgtaaatatcccaccaaggccattactgctcagtgcacggttcattttcattggcaatggccactgaatatagtaaagactagctgaaagaggcgacgacatatggtaccccaagcgagttattattcaaaattttaaatttttttattcagcaagtgaaaatgcaaatgcttatcagcagcagaaaaaggtttactctccgtacaaagcgcggtactacacgcgccaattctgtcgctacacagccgcgtcaagcccacgcgcgtgcgaattctgttgccgagtggtggcacgcaagcggcaacacga

SEQ ID NO: 36657 - DNA, 1266 bp, Heterodera glycines
  misc_feature (21)..(21): n is a, c, g, or t
tatttgaataattgatttttntggttaataattttatcctttattataatttatatttgaatattcttttattattacccataaaaatattaaatcgactacaagctaaaaatttcgctaaaaacgccccttaaaagtacctctcaacttcgcgcaacatggccagctttctgcgctgttcctgttggtgttgctttaccatgtccaaataggctacacggtcgtacagatcagtgtcaggcttaactcattttttttgtcaatttttaaaattttttattttagaaaaaaatattattaaaaattttagtaacttggcctaattctcgcaaaatttcgaaataattccaggaaataaaacaatttcaactttttgtttatttttgtggatattcagcaaattttttttttctgtagaatttaggttatcaaaaaattttaaaaccatttttaaaaatttttcttcaagtatttaattattttttttgcggcgacgttaagtaccgacgtcgtttcgtccggcaaccatcttatacaatcctttttttaaaacatcaaaatgattgtagataaataaattgataaaaataggattttgatcctccttttacgcccattttaaagcctatgtttaattttgaaaaaattggatcccatcaaattttatttatttattttatttttttgaaatcggcggttggccggcctaacaaaccaacctcgtccaggccaagtacaatccgctcaatttcctcaaattcttcgtccgacattttttcgggccagcaaagttcagcagcggttcattttttctcgtgtcccaaatgccattctgaccatcgcaaaaatgccaaaaaaatttggcacaatttcaccccacaaaaattttggccgaaccggaaattttttgggtcggaaaagggcaattttagagcagaaaaaaatgcgctcgttttatggcacatttttactcacccacctttacaattcatggaagtacattatgtccgccggatgtaggcacatataaaaattttgatgatatttaaacgatgggcaaaaaaagaaattagagaaatttgtaaatttaattagttttttctttaagttccgcaaaattgttctaatatttttttcaagtgtaaaaccaattcattataattattattattatttcctttataattggagaaaaggctttgaaagatggctcgaagtttatcaaagatttttgaaagtttttaatttctattttttaaaggcttt

SEQ ID NO: 36658 - DNA, 875 bp, Heterodera glycines
agtaaaaaaattcactcactgtcgtaatgtacactgtccaattgtccacttctgtccaaaagagttcactgtccaaatgtccgctgtccagatgtccgctgtccaaatgtccgggagcccgtattaagtgcgcaaaaattttaagtatttaccaaaatttccccgccctaataataattgaagatgattttgtaaataaaattaatcaacactattaaaaaatggaagactattttggaatttttagcacatttaagtcaataaaaattgaaaaatacgccactaaaaatcaactttatttgccattcttattgcattttcaaaattttctttatttatttctgccaaattgaattcttaatttgtcattggatttcgaagttccctgctggaagtttcaaattataaaaatgatttagcaaaaaaaggaacaattttaccactgaacaccttgaaatttatttggtttacttgttcggacgaaaatgaaaaagaatgagatttttgtggatttttaatgcataaatactagagaccggacatgagggtcggtcggtcggtttcggttaaaaaccgaaaaaaaccgaaaaacttaaaaatttgtcagtcggtcggtttcggttaaaaaaccgaagaaaaattttcggtataccgtttcggtttttttgaatttttttatcttttcccaaaaaaaacaataaaccatttttatcaatagaaaaagcgaaagatcacctctgagtaaaattgtagagcgaagctctatcaatggtgtataagttgggaaaataattgaaaaggcagccaaaaacgtttggtagctcctgattctctaaaaaataagggtgctcccccacccctgggggggggggggg

SEQ ID NO: 36659 - DNA, 1023 bp, Heterodera glycines
tcaaaaaaattttcgaaaatctgagtctttgttttttatttattttttgcaaaattaattcttaaatattttttcagaaagggttctgaaacgcaccaaatcttatttacatgttagtttaggcactctgatgctttttctatcaaaaagggagatgaataaaatttttaaaaatttttaattcctttttaaacagcccaaaaagtttaggcttatcttttttttcagaaactgatcagaagcgcaccacactttgcagggatactgaaaggaagagaaatgacctattttaaatattatatagtcagttcatttaaataattacccctaacggacacttgaaaaaatcgatttattttgtgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttt

SEQ ID NO: 36660 - DNA, 1369 bp, Heterodera glycines
  misc_feature (1360)..(1360): n is a, c, g, or t
atttttttaattagtaaaacaaggtaaaaggtaacattttccattcaatagatttccatttcaacaacttattttaaaaatttcaaagattcttcaaatattttccaacttaatttaattcttctattttgaaaacaattcattccttatttcattaattattccatatcattcatttgagcgattattcattatagtgacaatctgttttttgttatttttaaaaattctttttcattttaattaattcaatctgatgccaagatacttataaataatatatttttaatctttttaaatattctaatggaaagaagtcgatggttgtcgtcatctatggcttgtcattttctttatgacataatattttaattaaaatatttttatgaacaacttttatacatcagtagttgcaacgtattaatgatcaggctatttaattaaacaatatattaataaatataatcacttgcagaaatatcatcttttataatttgacttagaaattttatattttttgactgatttttgaccccaaaatctgattttttgggcccgatcgcgagatagagagggagagagagagagtattttacacttttaattcgtttaagtattgaaaatggtaatccgttttcaaattaaaaaattctttcgtctaataattttttccttattttttaaaatttttatggaaagtgttattcttttttaattcattcatttattttatataatttttttatttctataaaatgccggaggctgcatctaatcatatttgttttattttgaaaacatttatttattattattacgattgatttaaatttcgctcgagtagtatgtagcttacagtaacatgctgcttggttaggaagtcacatttctggtattatctgagactttttaaattcattttaattaaaaattactattttttctcattattcattaaatttttaatacaaaaaaaatttaccttcgatagaatattcaattcttttttattttagtacaggattaacaattttaattttttgtagttcgtattttattatacatgctttattttcacttcctgctcttttgttcggcaataattctcttttgatccagcagtattttaatgtattactaatcaggatatttaataaaacaatattttattttttgacctaaaaatattaatttttataatgaaattttttctttattatttttttactcaattcttttattctgggcatctatatgatttttaattctagccatttgcttatttattaaaatatcttccagttaattttacttacagaaatacctttgtttttaaatactcattttaattaaaaaacanaaatttatt

SEQ ID NO: 36661 - DNA, 1062 bp, Heterodera glycines
  misc_feature (27)..(27): n is a, c, g, or t
tgcacttctttcttcggtttaattacncaagtttgaggtacttggcgtgtcctgccaataatatctgtggcatggaataaattttggaactgcgctgcctaacggcggtgcttaaagtgcgctaaaaatgatcaaatgattatcaatttttatttttcttaattccaaaatgaattcgaaacgcaaaaatttaatcataattcatgtggtaaaaaatgcatttaaaaataaaaaaaattcttgaatttgcttctgaattttttaattttaaatagtaaattactttttcgaaattttgcacaaataagaggcgaagaaattcaacgaaatttttattaggattttgatttaaaatgttgagaggtttaacaaatttgtacactgaatgttggatcgtcaacaccaatgagaaatgactaacagaaaagagggagaaaagggcgttgttggcttaggaaaatagcttataataaaggagagacgagcagacgatgagtgagagaaaaatagtggtaaaaatggtaaactgctgcattggcagagtcagagaggggtcacaaagagttcgcacagcatcgaatatttccttcattttgggcgtcattcttccccactgcacttctttcttcggtttaattacccaagtttgaggtacttggcgtgtcctgcccataatatctgtggcatggaataaattttggaactgcgctgcctaacggcggtgcttaaagtgcgctaaaaatgatcaaatgattatcaatttttatttttcttaattccaaaatgaattcgaaacgcaaaaatttaatcataatacatgtggtaaaaaatgcatttaaaaataaaaaaaattcttgaatttgcttctgaattttttaattttaaatagtaaattactttttcgaaaattttgcacaaataagaggcggagaaattcaacgaaatttttattaggattttgatttaaaatgttgagaggtttaacaaatttgtacactgaatgttggatcgtcaacaccaatgagaaatgactaacagaaaagagggagaaaaagggcgtgg

SEQ ID NO: 36662 - DNA, 854 bp, Heterodera glycines
cttcatggtgatctgaaaatcctaaaatgggcttcgaactcttggaaattttcagaaaaaaattccaatggggctgttaaacatttttcgtgaaaaatcattaaactcgtcttaaagagcactaaattctccacaaaatggcctttggatgattgctctatggcaactctccgctgagctgcgtttggttaaatatcgactacccaaaaaaagactaattttaagccatttttccttactttttgcgacattcgtatttagccaaacgctcctcagcagagacgcatcgcagagccaccaagcaaaggccattttgtagagaattttgtgctctttctgttcgtcatattcatcttctacggaaaatttttcccaaccccttagaattttttttcgaatttactcagattttagcattttttcacccgcaaaaattttgtgtttaatgacttttttctggcataaagtgaatagaaaatgcttataggatgtctatactttatcttagtgttgattgctgacaatttgatacatccgagaaagagggacaaggacagacactcgccacaacaacggccgcaaccacaaaggcccaatttctcggcatcaaaattcccgagaccgcgcaccaatcccacagcaaccggaacgcacattcatcacctcagcggcggatgacaatcacaaaaggctgatcaatcgacatcctcaacacaggacacagcaaacaaaggcctcgcgcaccacaaccgcaacaaaaaaacttggcgccttttcaacatcaaaaagcaatttcccactcaacgtgcaaatgcaaccaacaatcaaccacaatttccaacttcaacgtgcca

SEQ ID NO: 36663 - DNA, 781 bp, Heterodera glycines
aaagaggaagtgaaaaagcctgaagaaaagagacaaaaagaagcggaagaggaaaaacggatagaggagcaagaaaagagaagaaaagcggaagaggaaaagacggaagagaagaaaccaaaagaagcggaagaggaaaaaagaatggaggaggaagagaagagacggatggatggggaagagaagagacgaaaagcggaagaggaaaagccggaagagaagaaacgaaaaaaagctgaagagaaaaaacggactatgaatgaggaacacaaaaaacggatggatggggaagagaagagacgaaaagtggaagaggaaaagccggaagagaaaaacccaaaagaagcgggagaggaaaaacggatggatgaagaagagaggagacgaaaagcggaagaggaaaagccggaagagaagaaaccaaaagaagcggaagaggaaaaaagaatggaggaggaagagaagagacggatggatggggaagagaagagacgaaaagaaacggaagagcaaagacggaatgaagagaagaaacgaaaaaaagcggaagagaaaaaacgactggatgaggaagagaagagacggatggatggggaagagaagagacgaaaagaagtggaagaggagaaacagaaggatgaggaagagatgagacaaaaagcgaaagaggaagtgaaaaaacaggaagaaaagagacaaaaagaagcggaagaggaaaaacggatagaggagcaagaaaagagaagaaaagcggaagaggaaaagccggaagagaagagac

SEQ ID NO: 36664 - DNA, 1012 bp, Heterodera glycines
  misc_feature (48)..(48): n is a, c, g, or t
aaaattgatgatttgacaacttcggtgttttggttctttcttggtaanaattatttggcttaaatggaaaaaatccccttttgataagaaaaactaaaagccgattggtagttgctcgagaaaaaaaatgaataacaaaaaagtaaggatgctgtccgatcgctattgttttaagcaaaatgcctaggatttgccaaatgacttttttgttccatcaactgctgactctcgtaattgccaattaatttctttccgatcatcttatttttggcgacatttgccaattttcattatctttatttttgttcaacaattggcctttgctttttcgcttctgttcctttaagttttcgttaattacttttggccgttaattatttatccaattgagctcaattttctatcggaatttctcgtgatttctttcattctttcattttcactttcaacatcaacatttttgtcattggtttatccaagcagccccttcggccaacaataggcgcctttatcgtttgccgtcagccgcttttcggcctttgctcgccacttctgcgatcggagcaattaaaagatgaacagatgtgttcggagaattaactattttttttttttttttttgtgaatttgaaaagaagtcggggcggggtgtgaaggaaatggaaaatttaaataattgttcaaaaagagtgaatttgaatggacaagggatggggacattgattcgatggtaaacgccgttaattttcgcacttcctccggccagtcatttcgttccgtaatttattttatttcttcttattgaaagcaaaatttgaattatggccgaaactgcctgggaaacgaaggcaaattgtgccgtgccctgtgaattgcccaatgtttgttgggagcccgtgctttataccagtcccaacatttgccttcctcctggtgccaatccccacacttttgaaaactacatttcattgcatgccatttctttcctttggcttttccttgctgcttttat

SEQ ID NO: 36665 - DNA, 803 bp, Heterodera glycines
tttatttatttattcataaaaatagaaaagtcatcagaagggggaaaccctcttcttctgacgcctgtcagttaatgtgtcgtagagtaaggaataaaatattatggatgatcccaggaaaaaaaacaaaaatatgggaaaataaataaataaataattgtaaggccgggaccggaaatggcctttacccttccccccccccccccccccattttatctctccgatagggctcctcccatcccgaggggcgcttaaaaggcaacggataaccagccaaaggggacagtcggatcagtcgggagccatctcagtgaaaaaaaattgtccatgcatggttttcgacaattctctgcaataaaaaaaaaaatgaaaattgtccatgcgcatggtttcaaaaaaaaaattaacttcaattaaaaaaaaaaatatccatgcatggtttcggaaattttgtagttcaaaaaaaaaatcccattcataggaggtcaaaagaaaagacaaaaaataataatttacggatgaattagccatcttttagaggtgcccttaaaaaggaggggaattttaatgaaccccacggggtctaataaaatgtattttgctctttcaaaaaaaaaaaaaaatcaaaaactgcttaattttaatcggaattccattaaccctgaggggatcaattaatttgaaaagcgataatcagataatcataaataaatgattaaataaataataataattaattgaaaaagatattaaaatcaaaaagaaataaaaaaataaataattttaaattaaaagagggaaa

SEQ ID NO: 36666 - DNA, 668 bp, Heterodera glycines
ttgtgctctttccagtgagcttgtccattttctctagaagaaattttccagccccctagggatttcgaaaattccccgattttcagtgtattttgggtgtcccggtcactaggaaggagtgatctgatcaagttggtgtaagagacttttttgatcagcaccaaaagttatgcaagcatgaattatttcaagtttttaaatgaactataagatagtttttcaggttattaattaattaaaatattattcggtactgaaatgacccgcctcttctgatcatcactcattcggactttttgcacttcgactcaccacgtgttataacagggctcggattcgtacttggatgccaagtacgtactcggatttcggctttgtgcttagaaaattttaactgtattcatttccatgtaattggaaaccggtatttttgcgtatgagtgtaaaaaatgtacattttatgtaaaaaaatcaaatttttagcattttgtcataacaatcattaatttttgctaaatttaaccaaaaaatcgaaaattttcagtgaaaatctgttaaaaaagagcaaaatttcaaattttttagcgcccaatggcaccgcccatcgcccttccaaaaaaaaaattccccttttttttttaaaaaatttaaaaaaaaaaccccaaaaa

SEQ ID NO: 36667 - DNA, 824 bp, Heterodera glycines
gatttagaaaaccatgttaatgggttttaactattctttatcaaaacaaaccaaaattcattaacgaacaattctaccggtgtgaatttttttctgtttaaaaataagagtcaatgttgcgacatatttttactaattaatgaatagaagtagaaaaattaaagcggaaaaagaagtgcaatcagtcaagaaaacgaatgattaatgtttgattcagattcggaacagggcgattctgaggaatgaaatgaaacattgataaagtgcggtgcgcttattaatattgtaaattattacaattggcttttatgaaatcaaaaaaaaaacaaacaaaaataggtaacgcaaaacgaaataaaatctcaatatgaaagccctaagcaaaacaattcggtgaaagcctaaaaaagtggtgaaccgcgttttagtgacaatgggaagagattatgggtcgcacgagaattagcaaaagaaggcaaatcagcaaaagttaaccggacaatcaaacggatgagtgaagtcaaagcagcggatgggaaaaacaaaaggtaacatggaaaggacataaagaaggttaaaacggacaatgaatggccttctgtctttccgtggccccatccattggcatcgtttgctttcttccgcgtcactttcatctctccctttcccctcttaaatgccttctctatgttcctcttcctcctcctgttcaccttccccctcttcttcctcctcaccaaattccccctcctccccttcctcctcgtcgtccgattccaatgaactttcacttttcgctctctccagtggaaattccgaaaaat

SEQ ID NO: 36668 - DNA, 1273 bp, Heterodera glycines
  misc_feature (1251)..(1251): n is a, c, g, or t
aaactcaaagtgaagtgcaaagaaaactgaaataaaatttattagagtcatttaaagtttggttaggggtttggttgtaaaggaggaaagctagaatgccatgacacggaaagaggtagtgagtgaggagggcaaggaactatcgggaggcattatgccgtggcgtcatttatgaatgcagggagtgagaaatagggtttgtaaaatgtaaattgtgacatggaaactgcgttaggaatggagtgatgtcaaaaaacaaaaaaattttttaatattaatttgcaacaggtttataattgcttctctgcaagatatcccgttgaggaaaatccgcgagtactttgtttttagaatggttggatattggggttcgcttggaaaaacaaaacactaatttcgggatttattgatgcaaaaggatggatagattaatttcggctaactaaacaattaggaaacgaaacggaaattatgattggaagctaatggataaattcaaaaatttagaaaaatagggcacaaattctgaaatgaaagcttgtgagttggggaattgagataataattagccctttttactaattgaaaacgatttatttggatttgtagtggatctatgcaatatatccctttgaggaaaatcgcttttctcttttttttaagatggttgcattttgggcttcatggaaaaaatactaatttcgggattaatgtaatttaggatggatttaagataaattttcggctaattattgttaggaaactagaggaatttgattgaaagctaaagtataaattcaagaaaaatagggcagttttttttaaaaaaacgataacatacgaaaattaatttccaggatattgtaccgttaatgctttttgaatattaaagtaaaaaggaattgattgattacgaaaattggggaaacaaaatcattgggaaaaattgtttggtattcagggaggaagccggaattggtctgaaatcgagggaaaagctggccttaataaccaaccaagcagaattaaaaatccaaatacggaaaactttaaattaatcaaaggggaaaaatcatggatttaaggaggttaaactgagagaggagctaagagttttgttgtttttttagcaagataacccagtgagggtaatccacttgtttatgtatatggaatttgcataacataggaattttggtacttgaggatttaatttaattgaaaaaatttagggatagtattttgaccgantaaattcggaagggtacaagag

SEQ ID NO: 36669 - DNA, 1132 bp, Heterodera glycines
  misc_feature (1030)..(1030): n is a, c, g, or t
tttcctccgcttttcagctgttgccgggaggatgcgttctgtgctcggaatgcgctctctccgcagtgtttgcgttgcgatttccgtccgtttgtcttcttggtgattttattgtcgtcaattgtactcagtccgctgcctttgtcaattgcgctggcgacggcgtcgtcccccgtgccaatgtccccgccgttgtacgccttcaagcaaagtgccgtttctgttggcaacttgaacagagcgaaattatgtgtgaggagcggaagaactgctcgaccaacgagttgacactgtacatgatcaaatgctgggagaaaccgaacgcaatctatgcggggcggaggcatttcttcaaaaatgtccgaacggtgcgttatcgatcagcagcatgactttgttgatgatgatgatcctttttttcgtttttccattgtcagttggcattggacgagtgggcacagctggcggaaggcgctttttctgtccttcactctcggcgggttcggcgttgacaggtggtgaaaaggggcaaaagagtggaatggttctgccaattttttcgcttaggttttatttgggctatcggaaaagtgccatcggaaaactgtgagtattttttatgcactaaataattatttttaaaatctttggaaaaaaatgaaaaatttctcaatgttctatgattcgaaggttctctttcggtggtcttggcgtgtggacacttctcgacattgtgctcattgacttcggttacattcagcccgctgatgaatcgctttacatttgaaagaaaagcaaattgttttccattaagttgtatcaacttacagtggttatttatttaaaattgtgtctcttctctcaactcaaagggtggccaaagggattgagaaaattgtccaaattttaatgcttattgagtaaataatttttttcttcccattgatctctgtccttccgtcacttctgtcgttcttttgttttgttttctctattttataaattttctacattttttgccgctctcttncgtaaacagcttaccctccccctcccccacatcccgtgacccttccgccccccggggcaatacattagccaacaattaaccaccacaataaaatccattgaa

SEQ ID NO: 36670 - DNA, 605 bp, Heterodera glycines
ttttacggcggtaaactaaggaatggagggcaatgggtttcgaactgtttttgtttgtcagtggcaatacggacaggaagcgttgacagtccgatcgggctaccggaagttgaacaaagtgttcatttacatgaacatgcaaagggaggacgcccctcggctggagcgatatgtgagggattgggggaggcaaaggaaaggcacgtcaaccgcttccattttcagtatgccgaagagcgagtgaaagtggcgttggaagaactgcacacggacttttatgtgttccagcggatgttgcgtcgtgcccacattttgctcgacctccgcgcgctcgcccaattggccatttacgagcccgactctttcaaagtttggccgcaagttacgacgaaaaatcactttctaattttagtgtctcgtggatttggcccaaaaaatggcgctgattgacggcgaaatggtcgtccaatcgccagaggaattggcccacgtccaatgcgacggaagtctttttggcgaccctttcccggaaagcgagctttacccagaaagggcggtagaaaccatctcgaagtgccaagagagctcacattggacgaatttta

SEQ ID NO: 36671 - DNA, 1026 bp, Heterodera glycines
ttcgatatgaatgccggggaaaacgagcttttacactttcggaagccgactcccggcccagcaaatgatatgcagagtgatcgcagctgcagaggaaggcaaagacgagtgccaaacaactttgttgcttgacccgggaagccatgtcgacggcgcagatacggagctaattcaacaactcgaaccgcaacccatcgacaagcggccgcttacagttcaagtgttcggaggaaagaagcagcggattcggtcagcaacttatcgcctacgactcaaacggaccgacggcaaattggagagcattgaggtgtccgaagtacctcagatctgtacgccaatcagaacagaactcatcgagtcgggagcaacacccgatagcgacccgcgaaccatcacacagacaacgcaacctcaaataatgatcggcattcgaaagttctgggattacgtggtcggatttcggaaaatcgagagtggcgcgcatgtgattgacaccgtgtttggacaagttttgtgtggcgaaggcacccaagcgagcagcggggcaactcccgcagcatcaatcctaacaaccatgccatgcggaaatatccaccaaactcgaacaaataaacgacaacaaatcggagaagtacgtcgaaattggaagcgaaaacgaaagagtcggaaaaacaattcgcgagggattgttagccgagaccgccacaactcacctgcagagtttggtcccgatcggttgggtgcgaacgaagttcttacgtctcgagcggagccaattggggaaatggaccctaaccagcgaaagtggcccatcggacggatagtcgagacaaaaggagcgagcgagcataacagaaacgccataatcagaatggccaacggacgaactcggagacgaccgatcaagaaaatttggccgctgaaagaagcgcggctaaaaacgggcgaaacggacgaccgagctgacgaagcagtacataaacgaccacgaagaagaaacgcgagcagccaagactcagagcgaaa

SEQ ID NO: 36672 - DNA, 969 bp, Heterodera glycines
  misc_feature (20)..(20): n is a, c, g, or t
  misc_feature (34)..(34): n is a, c, g, or t
aattcggccctgtgagtccngcgccttttccgcncaacagtcgtcgatgtgcacaaattggtagccgacctcgcggaatccgtcctctgccagccgatcggccatgtcctgatcaaacaatgccaatggatgattacgaaattggcagtttaaaaaaaagcggattgaccagaaaaattagaataactggtcattggctatccgtttagcgcataaaatgaataattaaaaaatattatatatattttgaattaattcttatgagcattttcaatctatccattccttaatgaagcgtaattactgttaattgtttattttattaccatataaagttgttcattgatgcaactgaatgggtgtttggcacaatcggtttggcaatagaatttggtccacgacatccaacccatcggaggggttcttaaagcattcttttataaatgttactcatttaaaatattttccattaaatataatcaccataaaatataatgcttaaatgatatttaaaaaatatttttattttattataaaataacaattagcaaagataattaaattaattgccttgcgagtccgttgtccaatgaataagccattgaaatgatggaaaataataaaatgaacacattcattttttagtatttcttatactctctagaaatatttttaatgcatttaaattgccaaatttttatttcattattattaaaagataaaatgagtattttattaaatttattgtttattaattgttttataaaaaataaaattctaataaacgccaaagtgatgaacaacacattacattatttgatgcgattttcaacactttatccatcggcagaacgaaaaattaatgtcagaggacgacagttggctattagcaaaatgctaataaaatcaaaagacaaaagtggatcacagaaaagaaaatgtgtcatggtcaggactctagagatcccc

SEQ ID NO: 36673 - DNA, 907 bp, Heterodera glycines
aaattttcaaaagagggcttctttaaactagcgcccaaaagtttgaaattactaaatccaaagatccctaaaacgaattttggtgggcagcggacggtccggcaacggaaatgccacccttttgccatcgatccgttcagacagtttcggtgttggtccttcgtccttgttaattgatatttctttccaaattgtcaattcgctttttccatcaaaatgcatgtccacaagcgcatcgaaacggtcggaaagcaatgccattttgagtccgagttgggcatggtcaaaagatggcagaatgtccatccacacgtcgctacaaatccatctgaaagatgaaaaaaagaattgggtaaacgaaaaaatttgtaattttttaaaaatttccctaccgtcggttcatttttgctgaaattatcacaattttccgttttccaattgattgatgccagaataaatgccaaattaggtaattaattgtctttgaaaaatccctttctaaacaacaaacgaaacactttaaatttttataatcactgaaaatgaacagaaactttttacaacgtttattggttttcaatattttatattcttcgaccttttccattttttgtttcataaaatctttccgtctattttaaaccggtttaaaaaatgcgaaatttttagtttattttccgaattcgagcgcagagttttctgaatttatgccggcctcttaatcagcaacttcgaaaattcttggaagcattttcaatagttttttttaaaaatgggggaggggggacatcatccttttatttctcttcccaatttgcctccagcagagctgagaccgagtggaatcgaatttgatatcttataaaaatgtatgatttaagaactactggactggaaaagtctgttt

SEQ ID NO: 36674 - DNA, 1049 bp, Heterodera glycines
  misc_feature (1009)..(1010): n is a, c, g, or t
gacatgagtaataaacattttgattattacaattaaaataagcttttattattatacatttataaaaaaaatggctaacaattaaaaaatatattcatatttaataatctcaataatgtcagtatctaaaaaataatataaacgcttttcattaattgttaaaataatgaaaatcttgcttaaattatttcatttaatgtgcatgaaaataggcctaaacaggtcaagcaactgcgataacaagactactttcgtttttaaattttaattattttgttattccaaataaaaaaatactatttatttaaaataagttttaatacatataatagcccgtcctcaacacttgcagggcgttttcatgcatttttggcaggtcatatctgttactgtcatttaaaaacaatataactttctgattataatattagcataaattattgtttttaaatactgaaaaatagaaaattttttgctctttaatgctttttatggtaatttaatattttatttttctttgtggtaattatgattttcatcaattccagataatggcagttaaacaatatgaatttaaaaaccatgacccaagtttcaagtaaagtataatattaattatttacatcagaaagacgaattgaaccaataattaaaattaaataaaaataattgattcgcttactaaaatactgatattaatttccaatcataatttttattataatttttttgtactgttgagtaaattatgaataaattcacaaattactagttcaaatttttaaaatttatttataagagatcaaattttcaattttaaaaagatgcatcaacgcaagagtgcataaaatatatagaaaaagatagaagaattgagaatatgtgtaaaagatgcgaaacgtaagcgttcaattggatgtcaaattttattaacattaatggataaaacgttaaaagtttaatgaacgcctaagcatatataacaaatctatgaaagatatcaaattannagcattattactcaaaaacattaaaaaacataaataatt

SEQ ID NO: 36675 - DNA, 939 bp, Heterodera glycines
aaccaatccaggtattcgttagggagtcagcaaccactcctttccaaggacgtccatttattttggcattatttcgtattaccccgaaaaaagagatagtcgttttttgaaaaaaattataacgagcaaaaccaatccaggtattcgttagggagtcagcaattattttttccaaggacgtccatttattttggcattatatcgtattaccccgaaaaaagagatagtcgttttttgaaaaaaaattataacgagcaaaaccaatccaggtattcgttagggagtcagcaattattttttccaaggacgtccatttattatatatatgttatataggttttgagtttcgtttcaaaaaacaaaatctcccggccgaaggccgggagcgccctgaaagtggtggaagggtcttacaactttttgaggagaatccgggaaaactataggtttttttctccgagggccaactgagtcccggcggctaatttctcacttttgcttgcgtttgatggcccataactttttttctaaaactcgaatcaaaaaatgttcgctgtgagggggctaagttgaagtgttttctaaaaaacaaaaaaaattccaggcctctacctataatatgaagggctgcagaaaaatggagaaattcagtaccaactttgtccacttcagtcccaggcgaataactcgccagggtttgaactgagcgagggggtgccagcagacttattgtagagttcaatgagctggatttttccagtttttaaaatttcgaaaattttcaaaatttttcgagctaggcctaaaaaacggttttcgggtttttgaatttttggaatttttaacgaattttcccagaaaaacggagaccactttcaagcaaccgtttttcgagctctatcgattggtgatatttttgaaaaatttcgattttttccc

SEQ ID NO: 36676 - DNA, 1333 bp, Heterodera glycines
ttaaataaaatgcattgatttccttaaatccttattctttcttatttattgggtttttggaaattaaaatggaaaatctataaatgtttaattatgtttttaatttgattttctcactaataattgatataaataattatttttcttttctttaattttcattaatcagtttattttttaaagaatttcatatttaacatatattcatgtaaataaagattgaaaacccgaaaaattttgaattttttgtaagaacttttgagaaaaaaatagttgatataagaaaaatgtcttttgttttagcataatgataaaaattttaaaaattctagattgcatatataaatttaaaaaatcaaaatttttttgaagttatctaaaaacgctccttagccattgttttggtgtttttatgtatttttataacaatttttgcatttttgagggttcaaagctatttttggcagtttttaacgcatattttagtgaatatttgggcgtttttcgtgtttttagggcatatttgggggatttttagtgcatattttatgcgcatatttggcattttttagtgaatccaacctataactctagtgatgataatagatatttaagcaattcaatatttaaaaaaaaattaattttaaaaaatttaaaattaagtttaacatttttacggtcgatcggttactgataattggaattgcaaaaactttgccccattttagcaaattggaattgaccgataaggtaattttcgaacttgtaaattaaagtaaattagaaggtatccaattataaaaaacatgatatgtcgatacattaacgaacgacccacggacaaaggaattaattaaaaaaaaaaaaattttttttaataaaataaaaggtaataatcagggttgtcaaatatgcacgaaaaatggccaaaatatgcaccaaatatgcacaaaaaaatcttgaaaaggtgcaaattcattaaaaaattttattccgcataaattttatcggttttctttttttgcaagcaaatcaaaaatttctcaaggttttcggcagtgaagtcactgttgatccactcgcgcatccattcaaatttgaatttaattttaggcataatcaaattttttcctaaggtatattcaaatcagaaaatatttgacgaaaaatggcaaaatatgcaaaaaaaaaatctgaaaatatgtacaaaaaatggcaaaatatgcatgaaatatgcataaaaacccaaaatatgcaaataaaagtcccgatttttatacgcaaacacaaaaaaggaagtatttttcctactatttagagcatggagaagcca

SEQ ID NO: 36677 - DNA, 996 bp, Heterodera glycines
agagagataaagagaaaaggaaagaacagaggtagagtcattgagagagagagaaaagaggagagagagagagggggagagataagagtagagaggggaaaagagaagcgagagagggagggagagaaaaagagtagatagaggaaaagagaagagagagaggaagggagagagagagagagaaagaggaatgagaaaagaaaagtggagagagagagtgagatatgatagagaaaaagagagagagagagagagaaatgcagagaggataagttgagtcagagagaccgacgagcaaagagatgaggagagagggaaagggagagaaacagagagtcgaaagagacagagaaaatttaaatagagagtatgagaggcacaaaaacaattgtgtgaagagaatatatagagaaaggagagaaaaagagagagaaagaatgagtatggtttattaaaaagaattttaaaaatcaaaatgaattaatattttttaaccaagtaaaaccgaatttaagtggtttttctggttaaagattctaaatcatttttttctgaaaattttttataagagattatttcttttttttaaatgcttattccactgagtttaatatctttgcacttttaatcactcattttcggatttttactctttatttcccaaattttttactttttttcttttatttgaaataaatgtgatcactgatcagtagtagggttagacgggtccgggtatttggccaaaaactgagtccaggtattgcccggtccagaaaatccgggtaccgggtcgggtactaattttcaaaccgggtccgggtacccggtaacgggtattgaaaaattatttaaaaaatccatttttttaaaagaccattttttacggtgattttccaaaaaaaaaaaaaaattcgggagcaggggcaggaagtccggtgatgccgataggcgtcccccgggaaaaattttgaaaatttacttctgttttgttaa

SEQ ID NO: 36678 - DNA, 1289 bp, Heterodera glycines
  misc_feature (1231)..(1231): n is a, c, g, or t
  misc_feature (1238)..(1239): n is a, c, g, or t
  misc_feature (1283)..(1283): n is a, c, g, or t
ttttagatgtacgccctaaaataagtttttgcccttattttggcgtttcgtgcttattttcgttcttatttcgcgatttttaaatttttcatgaaaattcagaaattcttaacaaaaaagcaatgaaaaaaaatttttttgacacaatcacaatttttggcgacttgtttataaaattttcaaaaatttttccactaaatttgtttttctttcttgaccaaattttggtttttgaaatttatttatttatagaaaaatgtattcaaaaatttcgaatatatttaattattttcaactgtaatcaatgaaaaagaaattattttcatataaaagcaatttgaaaaattatacccctaaatttgcaattttttcatgcttattttcgcacttatttaaggccttattttggactttttcgcgcttaaaaatcctcaccctaccaatcaatgaacattttccatttcttaggccatatatttttaaaattaaataaagatatgtatgtatcaacgatttttgacttattgtaacgtatataatttgttttggcgggctcctacagtataatataccgtatttttccgattaatagaccgttcgattataagaccccttttgcgaggggctgaacaatagaagagaccccggtccgataatcgaaaaaatacggtacgacaaattgaaggttaagatctattcggctttacgaaacttttattaaaaatgtttaggagcaatattctttatttgctcagctttatccgattgttgtgtacaccaaatgtaagattgttcacctgcttagtgaattggttttttgctacaaaacagatgatcaaaagaaatagcaaatcagtccatataattatataggttttttaaagaacgaatacctttgctataattacaagccctgataagcaatcttaaaaattttttgcaaatcaaaaaagggttgaattttaatttcatcttttcgtctgttctttttcttcggtctctccccctttttgccccgtttcccattctaagcttatttttattgattatttttcctccattttcttttctttgactttttcaatcgttttgccaattactcgacaatttaaaagcaattttacataatatttaagccgtatgcaatttcctgtaactttgtaaatttattcattttaattcccactgcttttttctcattttcatctctcaaattatgtgtttcattccntttccanntattatccctcattttacatcgacttttattgatttttctttgntgattt

SEQ ID NO: 36679 - DNA, 737 bp, Heterodera glycines
ttcatggggtttacttactgtatattctttcttaccgtattcgttcttactcactattgtatccgaaatataaatcattgaatacattcgttaaaacagacattcaatttaaacaaatatgtagaattcacacttaaattatgaacacactaaaaacgggaagaatgaatgacaatgctaaattaaacttaaattaaaactatttaagtctcctggcatcataaaattatttttttacttatggaccaagttatggcacaaaaaatcacccggcgacgcttactcttgaagcaggagaacgaaactcgactcgggacaaaaaaaaacaaaatcgaccgagacaccaataccaaccattttttagccaaattctcgagcagataaagccgagccaaacaaaaatcaaagtttatgtaattttaggcttagtagggtacataaataaaacttcatttagtccatttaaattatgaatgcactaaaaacgggatgacaatgctaaatctaaactcaatatagcaatttaagctcctggggcatcataaaatcgttttcagtttttcgatttttgaaaaagaaagttgcattgaacggttttcccgggatgtacacacaaatgatgatgatgatgatgataataatgatgacgatgatgatggtgagtagtgaattttagccctgtgttgtgttgccaaatttggggggggggggggggtaagccgggtcctcctcgcctt

SEQ ID NO: 36680 - DNA, 896 bp, Heterodera glycines
accaaaaaaatttatgaatttcggtaaatttttgtttttcttcgatatgtattttgtcaaaatatgccaagacggaccgggtcggttgggccccgccgattgggccccgccagttgggccccgccgattgggccccggtacgattgggccccgccgattgggccccgccgattgggccccatagagcacatggacaaggggggggggtcagaataaaaaagttatattgtcaaatgttattgtttgcgtgtttcattgcatatttgtaaatatatttggtttcatatttgttttctaatttttttatattttccaattcttgattgcctaactaaaataccattaattcagcttattatttaatatattaatatcacgatggaaaataatatcttatcgaagatgaaccacaaaaaacttgaacatgaaggtcatctttatgttttcgccaaacttagcgcggatggttttatcaaattttggaggtgtgagaacaaaaacaataaggacatgaagtgccgagggcgtctgcacaccaatttgaatgacgtagtgttgaaacaagtcaatgagcatgtctgtggagcaaaccctgcgcgagtggaagcacagcgcgtcgttacaggttaggttatatcaaatgctcaagattttgcatgcttatttgacaattttaggaataaaacgtagagccattgaaaccgccgagccgccatctacacttcgctcaattgcactccaaaatgtgggaacccctgtgttgtctgaagtcccaacaaaaaatgcaacaaaacaagttgtgttaatttctctgcgctcattgtatggccttttttagctaatcaaaagggccccgcaatgaaggaattactcccgcaatgcccgcttattctaaa

SEQ ID NO: 36681 - DNA, 963 bp, Heterodera glycines
  misc_feature (55)..(55): n is a, c, g, or t
caaatttccttcgggcctcagaaaatggctatctcttttcggccaatttgtaccngatcaagggaaaatggcttatttcaggcccaaatgtgcgcctgaatcgctaattagcttggcactttcgaatattacatataaattagccctctcaaattttcctcgggcctcagaaaatggctatctctttttcggccaattttgtaccgatcaaagggaaaatggcttaattcaggccccaatgtgcgcctgaatcgctaattagcttggcactttcgaatattacatagaaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgaaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattatcttggcactttcgaatattacatataaattagccctctcaaaattttccttcaggccccaaaaaaatggataattcctttttccgccaatttt

SEQ ID NO: 36682 - DNA, 1086 bp, Heterodera glycines
  misc_feature (9)..(9): n is a, c, g, or t
  misc_feature (853)..(853): n is a, c, g, or t
caatttgancagtatcagatttgatctgtggagtttcgataaatccattgagtgagcagcagcaatagcatttgaattttatcgaaaaataaaatatttaattaattttaggccattgtcgccacaaaacggaagaagaaaaagaagaagaagaagcggataaaagcaacggaaatgtcgtctgctgattaagtgtacggaaatgaatgattgaataattctatttgagaaatgatctatctcaatttgttgtgcttttttctctcagaaatgcttttgttaattgtttcgttccaattatataaaacatttattttattggcttttttgttgaacatttattaattatcaatgaaacgattatttatagaatgtggaaatacagtagtttttgtttccttcctcctcgcttagaaaaaaattcactagggtaataaatagggatgcgatttttagatgtttacatatttttttcctgagatccccgtggcctgaaacgcacgaaaaacatgtttttttgggctgttgttaagctacttttcgagttattagcacctattttctaggtttttatttttagcacctaaaaaacctaaaaaaaattttaaaaacttattttcacctattttggcattttgcccaaaatttgttaacaaaaatacaataaaaggaaaaatagacccctaagaatcgacccaattttttttcaaaaaatataccccgaagaatcgacccaattttttttcaaaaaatataccccgaagaatcgacccaattttttttcaaaaaatataccccgaagaatcgaattgaaaattttcaaaaatataccctgagaaatgaaaatttctcnaaaattcatctacaaaatttatttgtttaattttttgacgagaattgttgatttttgaaaattatgtatctcattaatgatttggcgtaatatttttgctttttaagaaaattttcgattttaccccctaaatccaaactttttggcccctattttccatttttagcacctattttggggttttttaataacttaaaacctacccatttttggatgtttttaacacctaaaaa

SEQ ID NO: 36683 - DNA, 1321 bp, Heterodera glycines
  misc_feature (25)..(25): n is a, c, g, or t
  misc_feature (31)..(31): n is a, c, g, or t
acaaatgatgaatgggcagtttaanttattnggacggagatgacgacgaagcaccggttcaaggcactcattccgccagtttacgttcggcacccctttttaactttgtcaacgcggcaccgtttggagttcatggatggctggcgcattttggcaaaccttacattggcaccactcaattcgagattgatcgtggagcggaggcatttgaacccaatgctgatgtcggggcaatggtaaagattattggactaagtttttagaaatcattttcaggggtattccgaggcgcttattacgaatttcaataaaatgattaattttccaaaaaaaaatccaattcaaaccattctattttactaccgtatttggtgaaaaaattgttgagaggagcttagatatttcggcgtttttgagcactaaaagcctaaaaatagctgcaaaaaacatgaaaagtgactaaacaatagcacacaaaaattgggggtgtctaattaattggactcaaaaatgcaccggaaccgataattcctcctgctcttgagcagtcttaattggtgcatttatgtaaaaaaaggaaagaaataaaatattttcgtcggaaagaattttcaaaataaacgagaaaaaaagatcagatcaatttgtcaattcaataatcttccaaatagccgatcatttctcaattatatttcacttccgcacaattcgacgcccttttccgccgggtaaattaatcgaaattttaaattttagtgttttaaatgtgttcaatatcagtgtatttttatttttttttttaaatacacaattttttttcaattcttttcatttttacacgaattctgttttgctcttactcaaccaatgcaattgacaccactcaaaataatgctgacattgttcaacttttcgtccttccattgaacaatttgcccaatttggcatcgcttcatcacccaattattttctgattctttgctcagtgtcagcttttcctttgtttgttcgttgaccaattcaaacggctcaattggctttggttcgaacagttcaaaatgaataatgaaattgacagaagaattggtggcacggagaaatgcctaaaacaatttcataaaattaggcatcgacccaatccccttggtgttttttaaaagtgtttaaattttttgctaacataagacaaaaaatttcttaaaaaatcaaaaaagcacgtaatttgttgcttcgtctcattaataaaatttttaaaaaattaatgtcgaaagaaaattgtggcgaccttcttgaaaaggttgaccaattttccttttcgcaa

SEQ ID NO: 36684 - DNA, 1060 bp, Heterodera glycines
aaatttgaaaatattccaaaaatccctattcttttttctatcctttggactgagtcggccctgaaatatatagcagtgaccaatactttccttgaattttccagtacgggtttgtccgtgaaaatttgaaaaatatttccaaaaatcccattttcttttttctatccttgtggactgagtcggcccttgaaattatatatcagggaacccaatactttcttggaattttccagaacgggtttgtccgtgaaaatttgaaaaatatttacaaaatccctatttcttttttctatccttgtggactgagtcggcccttgaaattatatatcagggaacccaatacttcattggaattttccagtacgggtttgtccgtgaaaatttgaaaaatatttccaaaaatccctatttcttttttctatccttgtggactgagtcggcccttgaaattatatatcagggaacccaatacttccttggaattttccagtacgggtttgtccgtgaaaatttgaaaaatatttccaaaatccctatttcttttttctatccttgtggactgagtcggcccttgaaattatatatcagggaacccaacactttcttggaattttccagtacgggtttgtccgtgaaaatttgaaaaatatttccaaaaatccctatttattttttctatccttgtggactgagtcggcccttgaaattatatagcagtgaacccaatactttcttggaattttccagtacgggtttgtccgtgaaaatttgaaaaatatttccaaaaatccctatttcttttttctatccttgtggactgagtcggcccttgaaattatatatcagggaacccaatactttcttggaattttccagtacgggtttgtccgtgaaaatttgaaaaatatttccaaaaatcccattttcttttttctatccttgtggactgagtcggcccttgaaattatatatcagtgaacccaatactttcttgtaattttccagtacgggtttgtcctgaaaattgaaaaatatttcaaaatccctatttcttttttct

SEQ ID NO: 36685 - DNA, 866 bp, Heterodera glycines
  misc_feature (848)..(848): n is a, c, g, or t
ggttttgcatatcatgaaaaatttttttggtcggaaattagccaaaattcatatttatggcataaaccccgccccccccccgcccttcaaaattttgaaaaataaataaaataataggagactcagaattttgaaaattttttataaaaactgatgacaagctaatgtgataaaacaggttaattcttttcctttcagtatccctgcaaagtttggggcgcttctgataagtttctgaaaaaaaagataagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaaacaaataaaaacgaaagactcagattttcgaaaatttttttaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaangtactcactcggcctctt

SEQ ID NO: 36686 - DNA, 486 bp, Heterodera glycines
  misc_feature (11)..(11): n is a, c, g, or t
  misc_feature (29)..(29): n is a, c, g, or t
cataatttttntgaatgaaaataaatttntggaattttaccgtctaagaacaactcaggagctttcgtatgatataataagacttaatatgaagtgttgaagcaatcgtgcatttttgttgtcgatcaaactgctctggagttaattccccaataaactgcattttaaatagttattcaaatatatttcatcaattaaaattagtaaatccttccttctcaatcatttaattacttacctacagtaagtcaacggcaaaaaagtggcgtggaaaattgcaaaaaatagaaataaattcataataatggtaaagtcagcttcgtgaccggaaaatcggtcagtggaaaatgcgtcagtggaaaatgcgtcagcaaaaaatgcatcattataaaatgcgtcacaagaaaatgtgccagagatgaacatattctaaaataatgttctatggacttagtattgcaatatacaaataaccttccataagaa

SEQ ID NO: 36687 - DNA, 799 bp, Heterodera glycines
  misc_feature (55)..(55): n is a, c, g, or t
  misc_feature (57)..(57): n is a, c, g, or t
  misc_feature (76)..(76): n is a, c, g, or t
  misc_feature (106)..(106): n is a, c, g, or t
  misc_feature (113)..(113): n is a, c, g, or t
  misc_feature (177)..(177): n is a, c, g, or t
  misc_feature (209)..(209): n is a, c, g, or t
  misc_feature (212)..(212): n is a, c, g, or t
cgcaacaacatctcatattctcaagcttaacaatgacctctacatgtaacaacangnatggaacaacccaacaccncgccctcttccgcacaccagaacgaggccnccaaaanccaaccacagggggccgcaaacacagccgccgagcggcaccccgagcaaaaagggcaggacagncgcgcacaggccagaaccgcgcccaccgaganagncaacgccaccagccaccgcgcgagcaccgaggcacccaaacacagcaccgagcacggaccgacacagcagcaacaagacaaccaacagcaacacgcacaacacgaaagccaaggccggccgacagggcgaaaagaaacgaacgaaaagcgcaggcgcgaacgaaaaagggaagacacaaagggggccggcacaaaaccgacaggcacagccgaaaaacacaggacaacacggaccaacccacggcgcggaggggcaacacaaagaagcgcaccccccggaaacatgaggaaagcgccagccaaaaagacgaggactcccccgccgaccagaacaaaggcgctgcgccccccgccgaaatgcttccccgcgcaccgacagacggcactgagcaacaaccgctgcttcgtcaggcggcgggttccacactttccattgagtcgacttctgaccaccgcacttctccccaccactcgaacaacggacttcagcaaaatgggccatcggtggtgaaactgtcaccggaagaggaaaaagcgatggtctttttgcttgaattgatggggcgtttcacactttattttttact

SEQ ID NO: 36688 - DNA, 163 bp, Heterodera glycines
tttcctctcttttcccgttatctcctctcttttctgcttcctcctcacttttctcctcatttccccctcaatttcactttttgttttcaactttttcaacaataaattgacctgattatccctaaaggacaacgaatctgacaaatccaaccgattcgccgat

SEQ ID NO: 36689 - DNA, 1193 bp, Heterodera glycines
  misc_feature (161)..(161): n is a, c, g, or t
ccctcccctccctttctcctcccctcgcttctctcactcctttcttccccttctcctccctctcttcctcctcctttccttttttctgtccctctttctccatcactttctctcctttccttgtccaagttttgatgagtccatgtgagccgcgcgcctcncatgcgggcgaccgcacgcgtcgctccccccaattttcccttaagggcacaaattgaggatgaatgaggtgtggggagtttatgggctgtttttctactacgctggcggcttttgggtcggttagcgccatgggcgtgcgttccgcattctctcgccatctgtttttccctcttccttcattgtctatcactgtctcttctctccccactctcttttcgagcattttcgcttcttttccccattagcccttcacttgctcacttatcgaagtgtgtgctgcgggcgactctcccccccccctcgccctctctcccctcgctctctctcccccctctctcccctcgctctctctctctccccctctctctttcctccgctcctccgctttctttacgcccattccatttgattttattaattcccccccccccctctctcccctcgctctctctctctccccctctctctttttcctccgcactctcttctcccgctcgcccaccatttgctagtgatggctgactctctcctccctccctccccccaggcgacaattgcctcctttttccgtccgtcgttgtcacgaaccacacaacatttgcctcttcctccaattcgcttaattaaactcttcttcctctttccattcattatcatcatccatctaattccattatcacccccgaggcgacttttcacacaaatggcgttaaatgaggccaaacaatgccaataaaacttttgtcccaaaaacaatgcaaataaaattgattaattaatgtcagcaataaactgattaattaaagggtcattaaaaagcgacaattaaaacctcattaatatttaaatcccattagttgtaaacccaattatgctcaatttaatttaatgattaattacataattagttataattaattttaaaatgttaattaattaatttttgaatatttacctatctattaaattcaaaatataattgatttttccaaattgacccctccccccactggattattctttcccccata

SEQ ID NO: 36690 - DNA, 1303 bp, Heterodera glycines
tttgttgtgatgttgtgattgtattcaatgtttaccgtcatagatccggaaagtcagaaactttgtctttaaatctcggctcgagaaacatggcaatttgatgatccctaagaaaaaaattaactaagaattccgttaactatttagacctttcatctttacagccaaaaatttttgtcttcaatccatcgacaatttgatcctcccgtatttcgcttacgtcgtggttttcaaactccatttgttccagatttttaattgttaattttgtgaacgggtacttaacggaaattgaagacgttcctaggcagaataatctgcttaattgctccattggatccaaaactttcagaagttcattcaaacggaaaaagaaattttttcgtttgaaaaattccatatcttcagtaaatcccttaatttctctgcaattctttcaccagtatgagtgccttcgaattcagaaacagacagtacaaatgattttctgacaaatattttgctgattccgtgtgccgtaagactaaattgtttgacgacaaaaattgaaagaaattgaaaacacaaccttatgaatgcgtttgaagtgtcagaccaaatatccgacgtaaaagcaatttttgagcattcgtccaattcactttggacctttgatttgaccattctgtagaccattggaagaatttttttacgatccaagcgaaagagattggttctgaagaagaaagtaaacacggcggcgccgcctatgtggacggaagaagtggagaaagtgctgcaaaacgttttggcggccccggggggttcgactacaacgggtgtggcacaaactcttctgaacgaaattagggagaaaaagagtatgatttgtgcctgggcctggttctttaaattaaaaagttttaattattcagctgcagcagcagccaaagcactggttggaggggcgccgcggggttttgcccttctaacggatggacctcgtcttgatgacaaccgagaagagattgcagctgacgatggtatgctgacttattttttaaagaaatccatacatttatatggttggacccctcttttaagccgagctcagtcatatcgctttgcgcggtggtgaactgggcttgccgccgcctctgcgcgtgaatcagactgcagccggtaagaaaatagaaatctttatgcccttaccaataactgcccatccctttcccattaactaatggggatggtagccatcccctcaacaatgtctatgtggacggtctatttttatcaaaattttccagaggccaatcgtgtt

SEQ ID NO: 36691 - DNA, 1276 bp, Heterodera glycines
aattgaatttaatattcatttaggcatatcattcttttacttgctcataaaagttttttaaatacatcaatttataggttttgggtgccttagatcatggaaatatcatcatttaaaataggtcaattttttaacccctaacaatgaatccctaaactttatgaatcaggatcaataatatagggtttgggtgagtaagaaagaattatgacctgaaaacctagggtgatcgttttatagaacgcctaaaaaattttgatagggcatatattttggtttatttttttgaaaaatctacggaaataaagtttaagctgaaacagacgacgccaaatcaattatttttggcttttttgtgctctcaaaaatgtgatttagacaaaaaatcaaatcttttctttttaattttgaatgttttgggatttttaatataaatatatatttctaaaaaaaaacgaaagaaaaaaaaaagaataaaaattaattgcaatttaatctaagaagaatagtgtctataattgctgataaatcataaactaagtatgcagtttttcaaatatcaaaatattttcgtttagttcaacctattaccttcaatccttgtaattaactagtagaagatactgtacttagatatataaagttaattatttgataaaaaaatataaaaatataaaacccctcatctaatgtgttaatagacttttaagctctaaaaaaaattattctctaatatttcgtttttcaccggtttattaatccatagtcacaaatacaatatatatatatataatatatacacatatagatatatacataaaaaatgttttttttttttgttattttgtagttttttttattacaaagtatgattattaggattgcgcatagtatggaaaaggtaaggtctcaaatatttactaaaaaaacctactatgtagtaaaaataaaaaatttcaaatatgaacaaaaatataaagtaaaaatcagaaaacaaaaacgtgtgaaaatcaaaaataagccaaaaacaaaatttttagcaaattcatttaatttacagtctatggttttttgataaagaaatttaaaatttttacaggttaaaatttcaaaaaaaaatattattgaaaatttatcaaaaaaattttttttgcaatttcaaaaaataaaaaaatattttattaacgatttttaagcagaaaaaaatccacaagtttattaaattctacatttttattttttttatttttttggaaaatactaattcgaaaaaaga

SEQ ID NO: 36692 - DNA, 952 bp, Heterodera glycines
tggcctatgaaaaaatggagttttatggatgtcaaattctgggacttttcttcgacgtggccatcagcgggttgtttcgtgacaaaaacaaaccagtttgatgttattcgaatgagctagacgcgctctacattttcaaatgtatcaacaaagggtctaccgccactccctggcgagatatggcctgtcaaagcagaacggggccaaaaaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcagtaaaaaaaacacgttttctgaatattaacaacaaaaatttttagacactttctaaagaggaaggaaaaaaatttttcatttgcctaatatttatttatactgttgaactgttggaaatgcagctgatgccgtcggaaaagctccgattttttggggaagtttttttctttcagtttcaccactgattgttgaggcaatttttttcgccaatttcttttgtctacaaacattatttattgcgtttcatcctgtagtgtgtaaaaaattttcagtaaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcacgaaaagatttcccagaaaatgcatgggacaaataaaaattaaacttctattatgatcaatttaaatttcctattcagtttcgggtttgctttaaacacgctggcctatga

SEQ ID NO: 36693 - DNA, 1185 bp, Heterodera glycines
  misc_feature (36)..(36): n is a, c, g, or t
taaaagcttaagaatgcttttctgtgtgcgataaantcagacaaattttttaagttaaatttttaagtgatttaatattttctctatttcagaaaaagaaaatccattaattgttaacttttaaaggcccacagcatttttgcatacaaagaacaaaaaccttcttacctaaagcaacatcagcgctatttgctgctgaaaagcatagcatcattttacaaaattggcacatcggtgagtgatggatgattggcatgttatgggcatattatgggttatggattttaaattagtcaaaatcttatcattgattagggttactcctaatcaaattcgaatgctctttaaaaaatcgaggtcccggtcccagcttttcaggtcccggctagtcccggtcccgattttgcccaaaattcccggcccgctcaactctactaaaaatgctcgataagattcgtataatgggtcaaatttcgttcaaatcttgggttaagctttgttcttgattctcgatataaggcttcgttccagaatctctgggtcaattctatttccttgttcctgctgtaccacaaaattttcggagggcggaatccaaagagaccattttccctttggtacattacaagagtatcatgaaaagccctccttaaaagttaagcagttgtcactttgtttcctcatgcaacgcgccccacatgttggagcagtaattgtggaagaaacggatgatttgtttctcacaaaaaatggccgtccacggcgtgtgatgtcatgtcagcagctcaggaaactgctgaacggcttggtggccagcgtgtgcaacaacagcgaccaccttgatgagcactacgattttgacgacattccgccaaaatcccaacaacatcagcagttgaaggtaagcattgctttgaaaagggtgccaaattatagaatagattttaggaaatgcacagcacgaaaattttgaattcatgattcggaataaaaaaaaagaaataaaatattggcaagattttggtgccgttaatttggcttttattaaattctcaaacagttggtcaacccccctttagttgttgcgcgatgagcacatgagcgcgatgcaacggatggacttgggcaaattaggcggaggccgatttacggactgtgaacagtggaaagtgatgtgaaatgatg

SEQ ID NO: 36694 - DNA, 1138 bp, Heterodera glycines
ttcagttgaagacgaaatttgtcccatggggtagccgtttgtttttccggaataaccgacccatacttcctgaaggatatacggcaaaaatatattaaaatttttataatattatgattagaaacattaattataggggcattaaaaattgaaaaaatatttcgtgaattaaaattaatttaatgaaatcaattactaaataaaaaaaagaagaaattgcgaaattaaagaaaaaaaaaattaaagtaaacattctatttcaaccaaattttcgattttatatttaattttcaaaagatttaaatattgtgtctcggttttaaatttaaaacaataacaaaccaataaaacatattattgtattagccatgccaatcatgaaaaataagaattaatttaaacaacataaaaattaccaaagcaccctgaccctgaacatcctgcagcttccaaaaggcccaatatatgaataaaattcaagaaaaatagcaaaaaggttttcatttttattattgaatattaaaattaatatttgtcaagaaaaaattatgatttgcgaagtctttttttttgttatttattatgtctaatgaattgataaattgatttcaaccattttaggcgtcataaatttgctttgtatttcctggcattaacgtaataggcatgcatattttcctgtgctatgcatattatattatattatttgggttggagaatatgtattatgtaaatatgggttttggtgaatgaaaaattttagcaacgccaaaaatgatgaaaaataatgttaaataatattattaacacacagtttttcgtctgggaatttcgaaaaaaaaccgatgtaagttaaaaacaatttttcgaaaaattgatgatcgaaaaaggttttggcaatttaacattaattgatgccattaattttataggcgtgtatatttttctgtgtattgaaaaaaaaacattttacataaaattacatacattttttagaaattaaaaaaaaacttaaggtagcaccaagatatgtctgctggaagttgtaaaaaattactttttattttattttatttcttatatttacaaatataatatcgtgagagaattttttcatttatttctttaaaaattaaaa

SEQ ID NO: 36695 - DNA, 1373 bp, Heterodera glycines
  misc_feature (156)..(156): n is a, c, g, or t
  misc_feature (1258)..(1258): n is a, c, g, or t
attaaaagaaatcattatttatttattcagcaaaattattacataaaaatattttattcattttaggctaatgcatatcatgatgaattacttaattttattctcattgcctccaacggagatggccaaatacagtttgctacacgtggcattagnccattgttcaagtctaaaatttatggcatcagcccgtctaagcattggccaattggctgcttcgtccgacaaggacggcactttttcgcccaaaattgctgttaatttgtctgaatgcaaaaagaatttagaaatttattttcttcatttaagatatttataaagatttcttttaaagattaaacgaaattgggtttaaaccttttttctttttgcgattttttttaaattttagaccatcagcaaatgtttgaatatttttttctgcggcagctttattttgatgggaaatgcacgaaaaacatcatttttatccaaatttctccttttaacgtccatatgaagaaataaaaaaatatttggctttcataaataaaatactttttacaatattttgaattatttttgctttcaaaaataaaaaagattatgaatatttttaaaaatttttaacaaaattttcgcatttttttgttaaatttcttcacaaaaattcagtaaaaatgaaaaattatccactaagaaatagcttttgaaaaaaaaaatcaaaactggttccaaattgcacccaaatgtcacttttttttttacaaatatgcctctcttcttgcaaggttgtgcgatcatattctgataccaaaatatttttgctgaaaatcctatgtgctttacctaattgtaccattattttctgaaaatttgatccaaaaatggcaacaaaaaaatgtcattctttggcgttaaacctctacgaattcctgatttttcgcaccggcgctgaagattttaaaaagtaagactggcaacaatgttttggccgaagagtaaaaaaaaaatttcggcttcccccctccgaaattttctgactacgggcctgactgcaacagcgaattaatatttgtattttttggtatttttcaactagaagagaatttttcaattttttgatcaaatatttccgttaatagggttcggaattataagtatattatttatttcctcaactgtgtaatgactgaaatttgggcattttttcaaaaatccctattaaaactgcccctctattaaagcagcccttttaaaccttttttctcttttctanataaaatttctcaagtaatttgtaaaaatcttaataaatttaaagaatattttagttattgaaatttttttcttatgaagtttttcaaaaacattaattggtttgctatcgaatt

SEQ ID NO: 36696 - DNA, 823 bp, Heterodera glycines
gctttctaattcctaattccactctccacttctctcttccacttccacttcctcttcctctttatctttctcttccgctttctgttcctcttccactttctgtttctcttccactttctgtttctcttgcgctttctgtttctcttgctctttctcttccactttctgttcctcttccactttctcttccactttctgttcctctcacactttctcttccactttctgttcctcttttctcttccgctttctgttcctattccacttccactttctcttccacttccacttcctcttcctctttatctttctcttccactttctcttccgctttctgttcctcttccactttctcttccgctttctgttcctcttccactttctcttccgcttacagttcctcttccactttctgttcctcttacactttctcttccgctttctgttcctattccacttccactttctcttccactttcacttcctcttcctcttcatctttctcttccactttctcttccgctttctgttcctcttccactttctcttccactttctgctcctcttccactttctgtttctcttccactttatgatcctcttgcgctttctgttccactttctgttcctcttccactttctcttccactttctgttcctctcacactttctcttccactttctgttcctcttcttctcttccgctttctgttcctctttctcttccacttccactttctcttccgctttctgttcctcttccactttctcttccgctttctgttcctcttccactttctcttccactttctgttcctcttcc

SEQ ID NO: 36697 - DNA, 611 bp, Heterodera glycines
agtgattatatgaagtgagtgtatgtggggggagccccaggcttaagtaaacagacagagggggcgggcgacagaagtaccataggaaaaatggaagaaacgatttgcagatgtgaacaaaaattggccaaagggagacaaagaagaaagaagaagggggaggaaaaaagctgagaaaagcgacggcacatttgaataaaaggagagaggcgaaaaacgcaggagaaggacggggagagacaaagagaaaaagtgttaaaaaagggggtgtttggacaacttgcccccgggggggggggggggggttaaagtccaattacaaaaacatgaggcagagtgaaaagtgacaaaataaaaaagggaaaaagggggaacaaaggatcggttaacaaaatgtggaaggagaaggagaaaaggagagaaataagaaacaaagggggggggggaacgcaaaaggaaaatgcccaatttgatctctttcgaatttgatcattcccctcgtcgcattcgcgacactggccggcgcgcgccccctcagttcttcggcagctgattgcagacctcgggcgggggcggaagcgaaaacagagcgccagtcaagcgcagcaact

SEQ ID NO: 36698 - DNA, 636 bp, Heterodera glycines
  misc_feature (28)..(28): n is a, c, g, or t
  misc_feature (56)..(56): n is a, c, g, or t
  misc_feature (79)..(79): n is a, c, g, or t
  misc_feature (125)..(125): n is a, c, g, or t
ttcgaggccgagtacttttggcgcaganaatgttgtttcccgtacgaggccgcgancatcccaagtcacacaaaaaganaaggagatttgagtcccagagattggaatgccggagaattgagtcncagagattggaatgccggagaattgagtttcagtgattggaaagcttgagaattgagtcccagtgattggaaagcctgagaattgagtcccagagattgaaatgctggtgggttaagtttcagtgattggaatgtcattgaaagttggtgagttgagtcccaatgtttagaatgccggagatttgagtccagtgtttggaatgccggatttgagtcccagtgtttgaaatgccgaagagttgagtcccagagattggaaagccggagaattgagtctcagagattgaaatgctggtgggttgattttcagtgattggaatgtcattgaaagttagtgggttgagtcccagtgtttagaatgccggagctttgagtccattgtttggaatgctggtgggttgagttccagcgattgaaatgctggtgggttgagctccagcgattggaaagcctgagaattgagtttcagagattgaaatgctgatgggttgattttcagtgattggaatgt

SEQ ID NO: 36699 - DNA, 1092 bp, Heterodera glycines
aaagacataatttgccggcactcggcccaattggccctctttgactgcgatggcatcgtcaaccattcggtcaaggtcgaccttttccaacgcatcctcactgatcccgatcgcttggcctgaacatttgtgatggaatagcaaaaaattccattttaattttgcataccgacggcatccaaaaggtcgcgaacggagatgcttaacatggaacttcaatctttagcattgatatgccaaattttgcttcgaaattcccttttttcttttgtttgactttttttattccattttgtttgattcgtttcggtttgatttgattcaaattgaatttggttcgttcgtcctccccccacccctcaactgttttccgccatagaaaaagctggcatgcgcaatggaagttgctcgtttgcccaaataatacaattttttcacgtaatttgatccaatgtctgaaaagaataatgcgaattttcaattagaaatattttaaatgtcaaaacccaaagcgatggtcgaaattgccaggccaacgcacatgtaaaggagaacgaagggaatgaacgcatcgctgaaaattaaattcagcaaattaactattaatgatacacggcaatacagtgagggattaattaattagggtgattggaaactactgtatgtatatgcattactgtaactggttctttctcacttttctgggatcaaatggccatattcaatggcggtgaagcacaaatacgagtagaaaaggccgttgacaaagtcaaattggcctttgaacagaggcaacagaatggcaccgagggccttcaatttgaatttcttttttagataaagtcaaaatgacatccgacaccaaataggccaacacaacgccggccatggtcagcggcgagatttgcttggccgcgtccgcgtcctccgcctcttcatcctcgtaaaaccacgggttgatggagacggtctcctcactgttccactgcccaccgtattcgtcccgtctgaacggcataccgtactttacaaatgtttggggatgtacagtcgggatcccattcccaattggaccaagggcgtaggcagggg

SEQ ID NO: 36700 - DNA, 763 bp, Heterodera glycines
gattcgcctatttgcgatcgaatttcgtcggaggaaaatgcaaagtgttggaaatggtcgaacaaaaggaggcggccactttaataatatgacaatttgttcacaaattaaaaactaatataaagaattaattattgagtggactgggaactgttgaaaagcatgaaaacaatgtttttagcttagttagttattgaagctaataaaagccattcatttgcatatttgaccatttttggtgtctaggggtagcggggtctggcggtgccgttaggcgcctcaggaaatttttttttatgaatttcgctaggaaatttctcaataaaaaatttttcccccttcgttacgactcccccgcccccacgacgacccacacttattaaccaattaaactcgcggcggtaaatgtgtctcatagctagggacgtgaattttaggtttaacttttttttttttgctcaattgatttgaagaaaggagctcaaaaaacgcatttccgcattaaaaattttcgattctgatgtcattatcggtcactagaaatcactattttgggattttgtcactaatagtgaaaattcactattttggagttttgtcactattttttcaatatttcgacattttttgaaaattccttaacaaaaatgcagcaataaaaccaaaaatacacccctaagaatcgaactaaaaaattttcaaaatatactcctatgaaatgaaaaaaattttctcaaaaatttactttcttggcaaaaatttt

SEQ ID NO: 36701 - DNA, 1125 bp, Heterodera glycines
taagccatatccctttctcataatttagggcaattcatgcagacggtcaccaagttggtaccgatcgctcggtcacagataccatctcccatttcggccaccgagcgtccagatgcgccagaatgtcccaggaaccctgagttgattcatcaaatatcagcacggaagtgccagtccacgccgtccgcaatgcattctcagccatagatgccgtagcgaaaacaattctcaagttcgccgcttggcgcatacaacgatgccatttttctctcttgtgtcagcctaggcctgagttcataattttggcgatactctctcacatctctcttatcatgattctcttcacttctctcttccaacttgctctgaatttcctcacttgttagctttgacaccaaaatgtgacgcttcaacttctcaaccatctctctatatttttctttcgcgtaacccgagaagaacgcaatcgatcccgactcttccatttcatcactacctaacacttcgtctaattcttgggctaattttgcaagaggaagattcgctgatgtgacaatggcaattttaacattttcatttatcgacaagagaatcgccgccacaattgatgcaacataagtcttaccaactcctggtggcgcattttgatagatcaaacaacactcattccctaacaacagtttggccgacactttttgcctctcatttaactttctcatcaacgggtgaaactcttgaactgccgacgcatgacccaaaatctcttcctgttcaccaaccagctgttctcgtggacgacccattactgccctcatcagctttccttgatttgtgtccagcttggcaactcgagatggaagatttgacgcaaaacatgcccttctcaactccaaaccctgcggaatcatcggatgtgctacaaagctacctccttcctcagctctctccaactcttcatgaacatccctgttttttctttcttgcacttgtgtcactttcaccgcaatccacaaaataaattttggtctccctaaggatttcattgactctacattcgtttctttgacaacccccgaagcaaaataatgtgatccatcgaaggcttaagcattacctgcgcatcaa

SEQ ID NO: 36702 - DNA, 1023 bp, Heterodera glycines
  misc_feature (106)..(106): n is a, c, g, or t
tggaagcgctaaatttgttgagaagcttttgagcgtattacgattttacttacaccattttttctaggcttagatcacatgcgattttcggcactctgataatttnagcgctcataatgggatgtataaaggcgattgtagaaggaattggaagcgctaaaattgtttgagaagctttttgagcgtaattacgatttttacttagaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgttcataatgggatgtataaaggcgattgtagaaggaattggaagcgctaaaattgtttgaaaagctttttgagcgtaattacgatttttacttacaccattttttctaggcttagatcacatgcgattttcggcactctgataattttagcgttcataatgggatgtataaaggcgattgtagaaggaattggaagcgctaaaattggttgaaaagctttttgagcgtagttacgatttttacttacaccattttttgctaggcgtagatcacatgcgattttcggcactctgataattttagcgctcataatgggatgtataaaggcgattgtagaaggaattggaagcgctaaaattgtttgagaagctttttgagcgtaattacgatttttacttactccatttttttctaggcttagatcacatgcgattttcggcactctgataattttagcgctcataatgggatgtataaaggcgattgtagaaggaattggaagcgctaaaattgtttgagaagctttttgagcgtaattacgatatttacttagaccattttttgctaggcttagatgacatgcgattttccgcactctgataatttt

SEQ ID NO: 36703 - DNA, 1352 bp, Heterodera glycines
ctgtttgtaatttttttttctcgtgggggaaagatccgaagaacggcggggggggggggatgaactgctcccgtcattttttgccccatcgggacacaacccaaccaaccgttccgttgttttgaacgggctcagcagtccgttggcacgataaaattcgtccagcaccgagaagcggtacagcgttgtgggcgggggcaacgcgtgacggaagaaggcgagtgcgttgtcgctgagtgtgccgttgaaatgaattgtgccacgaaagccgagcacatatgatggctgagcaaccgtgggcacgggaacttcctggaaacaaaaaaataaatgcgaggaaaaatttacaaaaattttttagaaaaacacccaaatactttttaaaatgtcaaatgctaataaatgtatttatattgtgcctgttacgtgaattaaaactcaggaattttcggacttccatttcaaccaatttcgaagccgggacccgaattcgaacgttaagtcaaatcttcaagttttcgagttgcactttttttaattttcgattttttgttggaattcgggcggaattttgcaattttaattctctttcgcttgggttgaaaaaataatataaaaatttgaataattttgccgagtccctatttatacgcacctcaaatcccccgttgtttcccctggggatgatcattcgcgtggtggtcgcattggcaatgaacacgcagtcgccctccacccaatgtgcgttggcgtcgtgcattctccgttgggcaagcgaattgaaatggtgactcacctgatttaaaaggaaaattttcaaatgcaattattatgttgaacaatgttggattggattgacatttgaaatgaaggcgctttttgaattttattaaagataaaccaaaggggaacgaaatggcgtatttgaaagccatttttatggcctctgatcatgaaaatatgatattcatttcaattagttccgaattcctaacccgaattccaactgttgaaaatgaaacgttggtctttccgtgttttgctacccccccccccccccctcccgaaaattttaaattcatattttgggtttaaaagtcactgatacataacgaatatggtgtcatcaaatgtcgaaacaaacaccatcttcgtgatcagttacctctaaaaaccaaaatatgaatttaaaatttttcgcggggtggggttaacaaaacacggcagtacgttttcgaatttgcagtccgaatcggggtagagattcgaaatcggtcgaaatgtatgcctgattcatgctctacgaccttattcccgactttttgtgacaaaaaaaaatatggaaaccaaaa

SEQ ID NO: 36704 - DNA, 635 bp, Heterodera glycines
ggtgaagcgttccgacactctttcaggttaaacaattcaaaaattgaactgacttcataatgttttcagaaatgtcctatctttgccattgttgccaccaacttacgtcagacgagcattcagcgtcattgtcggcaccgcccctatggagatggaacagtttctcctctactttgcgaggacatacatcggaatgacgcagcaacagctgcttgacggtgacaatgcgtttggagttcgtcctggtggtctttctccattttcgtgtccgttttttcattttgttttatttttctttaacttgcttttaagcgtttgctgggacatcattttgttctgttgaatccgaccacgcatactcacggcagcccttacaatttggcatcgactcgcccgccccctcaacactatcatggccgtcaacagtggagcaaaactcgccgttggtgcagtactcattgagttcatcgtcaacgacgacactgctgccaggcatacccaaatttattaaacttttcatttttataattttagtccgtccctgggaagaacccgtcgtccgtcgcgcactgttcccaattccatattggaacgtgcactcacatgcggcttctgccctcgcgagaaccaacaat

SEQ ID NO: 36705 - DNA, 1277 bp, Heterodera glycines
aaaaaatttgtgactaaagtgaggggattatcgggcgattttatgaaaggccacagcataaattttgaaagtgccattaccggctgtacaattgcttttgaagcaatagttgacccctacagggcattctttgacttcgaatgtttcgaccacaactccggttgatccatgtgcgcatttcaatgcttttcgttaaaaataattattatttaaaattaaaaaaataccaccgccacaaaagttggggagaaaagcgaacgaaataaaaattgcggcaaccgttggaagaggggcgaacaaagtcattttgagaatatttattgccaaaatattgtttaaaaatacaaaataataataatgataattaagactattattttaagcaataattaattaataaaaatgaattcgtttgaaaatcagcgcatccgaaattcattttaatgaatattggaaaatgaaaaatgtgaatgattggagcgaattgcgagctgtgattcactggaaaagggctgatcagatgcctcggaataataatacaatttatttgaatatttatttcagatttttatggttaaccttcgtaaaatatacaaatccatgtatgtacaccaactccgtaaaaaacaccaaaatacgctccaatacctcaaaatagttttgagaaaattataggaaattgaaaaactaaaaatccaaaattttattccaaaaattccactcatgtaaattctctcaattagaaaaattagagccaaataatttttaaagttttgataattaaaatttggtgcttttttccattgaattatcaaaatattaatttcttattaaattttaagtcaaatgcgcacaattttattcaacctttgaagtgaccgaagcaataaattattaaaaagcaatatttgttaaatggaatcgcccattcttccccaactccgccgtttccgcatcgcttctcctccgcctcgtctctcactgcgctgtccgcctcgtcctcgtccctctcactccggtgttcgcttccgcctcgtcctcgtctctctcattccggtgtccgcttccgcctcgtcctcgtccctccgcctcgtccctctccccctacgcctcctcacgctccgtctcgtctccctcgcccgtgccgcactcccctggcgttgtgccctcctgctgctgtttgcgtctgtgtgcagaacgggaggacacaacttggagttcatagaggaattcggagaagggcacatctgtagaagacacgctgttgaggctggtgg

SEQ ID NO: 36706 - DNA, 1081 bp, Heterodera glycines
agttgtacatttggctgcaaatggaagaaaaaaaagttaaaaattagaggcaatgaaaaaataaatgaaaagattaaagctaattataagtgtgagcaatcggtaattaacacactaaaatgagagacacgacttaaaactgtaaaatctaaattttatttccgactttaacccaccgataagccattttgacggcataaatttgcacatttggtcgcgtcgtcataatcctgtcaaaagtttatgtaaatgcgtatgaaatatcgaaaaggaactcactcgatcagaatatgctctttggtgccaagtccctaaaatgagaaaacgattgccagaggcatcaaacggagtgaatgaacagagcaaaaagaaaaatgaaggggtaattaagcccgattaattggcatcgaacccaaattagagcaacaatttttcttttcacaaccattacacgcaaaacgcacctccatcgaacggcgcaattgtgcggcgtcgtacactgccggcagttccataagtgcaataattaagtgttcgaagtcgcctgttagttcgcttttcaactccgggatcagttccttgccatacatttgcttgaacgtgcggatgacctgaaacgaaaaccacaaaatttaaaacagtcagtcagaactttcgaaagttaagacggtcccggggttttgaaaatctcaggtcccggtcacggtcccggtagggcaaccgggaaccgggaaaaacaagcactggtaagaatggggtctgagtgaaaaattagtgaagaaaattggagtcaaagagaaaaataaaaaataataattaatatattctttaaaagtaacactgcgcaagtgtgcaaatggcctaatggctagtctccttgactttcccttcttctttcccctggttcaatccctctacagaaattagattattttcaattttttttttgtatactcgtgggtttcctataaagaaaatatgattcctcatagttttttttttaaattgatacatattttatcattttttaaatgaaaatcatagcgaattgagcttaataatcgcaaaaaccaaccttttt

SEQ ID NO: 36707 - DNA, 1090 bp, Heterodera glycines
  misc_feature (46)..(46): n is a, c, g, or t
atttttgaccattttttgacccttttcattcaatgagtcgaccaancgtcggattaatggctgaatgatgttgggaaatttttcttccagtaaaaaatcgtgaaggcgcttgatggtcggcaatatcacagaagccgttgatttttcgtgggataacttaaaactaataagtttattgagcaaaaagaaattttttactttttgggtttccacgtcaaaaattttaagaattgggcaaatttggcgcaaaagttcgaagtctttgaatgaaatggacggcaatgatgaaattatttccatctcggccatccgaggtttttttggtgcagacaaaattccggcatttctttggtctctttcaaattgcattgccagcaaaacttttttctgctctttgaaagctgccaacattcggtaggtcgaattccatctcgtcggaactgacttaaaattggccgaatttgaattagaatggaaagaaattaccaaaacaagttgctttttcggcatattcaattgctcttggtgtcgctccatacatttcttaatttagggttttcggcattctttagtccactcttttgccttcaagataatttcagaaaggcattgatttttgagcgcatcttgaataaccaaatttaaaaaatggcaacaacactggaaacttaaaagggaacacggaaccattcaaaaacaaatgaaaaaaattgcctgtccttatccaattggcgtgtggccgactgcatattacgagcgttaccacgcacacaacacgcaatataaaaaaccatcaaatggaaattttcaacaaaaaactgctcaaaacttttgtcaatgtcaaccaaattagacattcttggtatcattcgatagccctaacatttctctacaagtcatttaaatttcaaaaaatttggtcaagtttgagcaaagctatggccaaaagtacgcaaggtaacatgttttcacagatttttggccataactttttttaaactctataaaattttttgaaaatttgcaagctaatagaggacacgtagggctatcggataataggaagctctattaattttgctggatctga

SEQ ID NO: 36708 - DNA, 858 bp, Heterodera glycines
cattggtaacgtataaatttttcaaaaataagagatagccatttttctgggatataagataaaattataaattttctgaggaaattaaatggccgattgcgcaccgccctccctatcatgctcgagcggcttttgtaacgtataaaatttctcaaaataagagatagtcatttttcttggatataagataaaattgaaaaattctccgagaaattaaatggcgattgcgcaccgcccttcctatcaagctcgagagctttggtaacgtataaaatttctcaaaataagagatagtcaatttcttggatataagataaatttaaaaattctctgagaaattaaatggcgattgcgcaccgcccctcctatcatgctcgagagcatttgtaacgtataaaatttctcaaaataagagatagtcatttttcttggatataagataaatttaaaaattctctgagaaattaaatggcgattgcgcaccgcccttcctatcatgctcgagagcatttgtaacgtataaaatttctcaaaataagagatagtcatttttcttggatataagataaattttaaaaattctctgagaaattaaatggcgattgcgcaccgccctccctctcacgctcgagcgcttttgtaacggaaaaaatttttcaaaataagagatggccattttttgggatataagataaattaaaaaattttcggagaaattaaatggcgattgcgccccgcccttcctatcaagctggagagcattggtaacgtataaaatttcacaaaataagagatagtcaatttcttggatataagataaaatgaaaattctctgagaaattaaatggcgattgcgca

SEQ ID NO: 36709 - DNA, 811 bp, Heterodera glycines
acatatagaggactgaatgatgtcgaaaaagattgtgtatttacatttaaattcttctgggtacgaataacaaaatactttttgtgggtacgaatttttgtttattgatataattgatgtgtgtatgagtaaatgtgatatatactatacacttaatgttaccgttgccaagtcaaactaatattaaaaaatcattttttgctataaaaagcatagtgaattatagctaagtaaattatgtcacgtgctgatgaaataaaaaaaaatgccgagagcttcaccgttttcgtcttgtgggtacgcagcgtgctggatgttggcactgcggggatgaccatttgtgttaagaaaaataagtttaaatttattttcttagagggttcgaaagcatgctggaattgcggcaagaaaggccacctagaaactagctgtcaccacacgccgtttcggtttaatagaatattaaaccaaatcatattgtttgtttagttatgtccctgtgggttcgtatccaaaatggcaggtccaggacggctgccaaactttctggtaataagacaattgctcgaaacaattcagtttgtttaggtacgacccgaagaacctaaaaggatacattcattcatgcccagttaatccgttttctattcaaaaaggtaaaaatagttatttggatatttatttattcataatatatttaagggggtccgcaacgctgtcatggaaaatgggttaagaaatcgaaatcgaaggggtcgactgaaacgtgtgtctctgaaaaagaaggcacaaattccgagggttcggcgaa

SEQ ID NO: 36710 - DNA, 985 bp, Heterodera glycines
tctaatcaccattgtacctcttctaatcactgttgtacctcttataatcacttttgtacctcttctaatcaccattgtacctcttttaatcacttttgtacctcttctaatcacttttttacctcttctaatcacttttatacttcttttatcactgttgtacctctttaaatcacatttgtacctcttcatcaaatttgtacctcttctaatctctgttgtacctcttctaatcacttttgtacctcttctaatcacttttgtacctcttttatcacttttgtacctctttaaatcacttttgtacctctttaaatcacatttgtacctcttcatcaaatgtgtacctcttctaatcacttttgcaatcccaaattgctttggatcgaacaattactccacaacccataaatatcgggcgcgaagcgcccgtccgactcaacacaatttaaaaaacggccgcgaagcggccgaaaagcacaacaaaaattagaaacgggcgcgaagcgcccgttcgaggacgcgaagggcgcgaagcgcccgtcttgagcctcgatgttgactaaaaacccctaataattttttaaaaattcaaaaaaatctctccaaccaattcgatcaatttgaatcgcttcacagcctaggtagcgaagctcccaaagcgcgaagcgctttttcccagctaaatagccgacggttcacgcacccgctagttaatatatacgttatattgacaaggagtttcgtttgcaaaaacaaaatctcccggccgaaggccgggagcgccctgaaaatagtggaagggtctacaacttttgaggcgcatctgggaaactatagaaaaaattcagcgcggacgactgaatcccggggaccgatttctcatttttctttgcgttgaaggccctaactttttttttaaaaccgaatcaaaaaagtctgctgggagggggtaagttgaagggttttctaaaaagaaaaaaaa

SEQ ID NO: 36711 - DNA, 1298 bp, Heterodera glycines
gtaaaaaatttaatcacaatgggtcaagagtatttttttacaagaaagtcgagagtctcgatagctttttaattggccctagttaaccgtcgagacctttcacttttaattttttgttcagaaaggtacaatcatccgtaacggttctgttcatgtgctgcacccgattcctgcccatcacatttcccgtggtaagtgtagacattttcacagtagtcttgcaactacatactgcgcgaaacccaagattttttcgtctaaatttactataaagtcccaaaaatttcacggctttgccaattagctcgatcaccccactgatccgagacattaattcaacccaatttcggctgatcactgatcagcgatgaccatatattcaaatagctatcattgcggttttccaatcattttgatcaccgagaacagtaatttccaatcacgccactgatcactcaatcaccgctgatcagcgaccgatcaattttgtttcaattaaagttcgccgatcgacgtccgatggtgccaccgcaacggcactgcacgtattgtaccgacgtgatgccgtggcaacggccaaaaacggcactggcgaagatttttgcggcattgaaaatacaatcaacagtgatgagatggcggagaatgaggcgggcatccacgaggacgcttttgtggtgggacaacgtctgatgcgcgagggtgaattgacggtaaaaatgtttggcactggctttaggggaaaaaattcggcactgtcgagagtctcgaccatcaattacaccgataaatattttctattttgagttaaactgacccattatatccagccagaaaacgaatggattttttttgttgctaaatttcgttttaacataaatttaactttttttttaatttggcacaagcaaaggaaaaaacccctaaaatttttcggtctatagcatagatttccaaaaaaagaaaaggttcatttttacagagagaattaaaaaaaattttttaaggcctcggatctgctaaatttcattatgaaatgcctaaaagcaaatatttccacactttagcattaacaaaaacgaaaactcaattaaaaaaaaatttaaagcttctgatttcaacttggcacaccaaaatcagcatttttctccactttagccattaataccaaaaattaagttttctctaatatctaagctagagaaatcgctgaatttagagctctcaagactctcgagtggcacatttttgaaagtgttgccacccatatgtttttaggtggagttggccgtgttcgt

SEQ ID NO: 36712 - DNA, 1381 bp, Heterodera glycines
  misc_feature (392)..(392): n is a, c, g, or t
  misc_feature (1373)..(1373): n is a, c, g, or t
tgccgtcaattttttgtcaccactgattttgatgtcattgtgacaagcattcgaatcccaacaattttgatgtttttgggttgaaattttctaaaatttgaataatttattttaattttaaatattaaagtttacaattaataaattaacccttttaatatttcacctatcttcaccactttctgctgtgtctccagttcactgatcctttccaaaattgccttctgatcattttgcaactttgttgagtgctgatcaacagaaacttaaattcgggaagaaaatttatttcaaatttaaaaataaaataaattatgcttaattattaaaaaaacagcaaataattttctgtaccgtattgttgggctaactctgcttgaagtaccctctanaaattttttttaaaaattatggcaaatttaaaaaatgtttaaataaaaactcgctttttcgagtcgaagacccttaattaagcacaattgtttcgtttcgcacaattccatttccgttttggcaaagtttagacgaatttcctataatattaataattaaaatttatttccatttttattgtttctgttgcgttcgtccacctcgatctgttgttgatcactgattgattctgggttgtccaatctttgacaaatttgaaaacaatcataacaattctcctctaaaatttcgatttttttttattatgaaatgaaataaattctccaattttgcattcggacattttaataaaaatcgcagcaaaaagccagaatttatattcaaaattagcttcaaagtgaaaagaaattacaattttggtacatttttcagtaaaatataacacaaccaaaatatgtacaaataaaattaaatggccttaaaatgactttaaaatattttacactttgtttgaaagcttcttaaatgcattattattttaattggttttttttactttttggaatttttatgttttttttattataaaagacttcaactgtctaagcccgaacccatggtcggtagtttcgaaattctgatccccagatttttttgttactttttggctatttttccatgacttttttggattttctcgtgactctcattcctaattattattataaacaccatctgaaaaaaggaataatgaactaaaaaaacagagaaagaaaaattgcatctatcataattctcaaaaattattttcttccaactcgtgaatttttgtaactaataaatacgtatcataattataatttttatttttgttcacccatttctttgccaattaacttttctcacgccgttctgctggtgcgaaaatgctgctgtctgacaaagggagagaacttgacatttatttattttttcaaaanattttctg

SEQ ID NO: 36713 - DNA, 1224 bp, Heterodera glycines
ggcggtcttggcctgcattccggcactgggaagcagagtttgtagatggggtcgatgttgtacgcaacagtcaattggcccatcactgaaaaaatatttgggggctaaaattttcaaaaaatcaatctccatataaattatttttaattgtttgtcggggcaaatgacgtctgaaagtgtcccctaactcccaatagcaacaaaaagcccaaccttgcgtgaagtagccgatctctcccgaccgaaccgtctgctgttgttgcaccaaaaatgacaaattttttgcgacctgtgccgcctgctgttgtttctgaagctgcaacagttgcagttgtcgcagttgcaatgcgttggagaagtgcgccatgtcagtggccgtgccgaaaggcggctgctgagacgtgccaggaactgcggcagtgccatccatggtcaaaggggatggccttggcagcggcaaaagttgacggggcagtctttcgctctcgtaacgctgagaaaaaggacgaaaaagcaaagcacaacacggtcaatggcaaccattgtgatgcgaaaatgaagtccggccatgtaaatttttttagttcaaacctacgaaacccgaaaataagaagtttcgactttgtatgtctaacaacgaagtggatgggtgaattaaagtttattttgcgctttcaattatccgatcacaaataacaattggggggatgactgatcaatgccatttttagggaaattccgtgctcagttctttggttgcgtacggtccaccgtttcttgtgtgttgtcacattttgggtcctaaaaattggccaaattatatccaaagtttactattactcattcttccgacttacattcctcggcaggcggatgattgttaggcggatggttgtgcggattcgttgccgtacaattccgttcaccacctgtgccttgcctttgcacgcgcccaacctctgcggaaaacggacgcagttccagtacacctgcccattggctccttcaaattttttgtagtaatcgtgcccttggtagcgcattttcagtcggccttgttgggttggaagaaattgcgggggcggtggtgttggaatttcgtgaaaccaccacattaagacaatattgtagaactaaaaaatgaacctaacaaagatacagactgttcataaacagagctagagagagtaaaattgaagaatatctacacctcacaggggtggg

SEQ ID NO: 36714 - DNA, 601 bp, Heterodera glycines
ttcgaataactattataaaacatttaataatcatttaaatgacaaaaattaagttttttgaataagttttacgtgttttgctccctaaaaatccttaataaaaaaaattttaaatgccttttttatgcctttttcggggttttcgtgccttttcatgcctttttttcaatttttggtgcctattatagttcctttttcgcgatttttgatgcttttttttgcggtctctagtcataacatccaccgttcattacgagctataaattattaatttaaaaaaatttatttgtcatcctgtaaaatttcattaccaatttgggcaaaaatatttttgtccaattcaggccattcatagcaatgggattccagccttttgcaaaaaacttcagcccaaaaagtgatgatctgttcctgttcattgctgagcagatccgatgtgttaatccacttgttaaatgcgtccatggcaatgtcaatttgagtgaatttggacgcattttctttgactttaggccaaaaggcacaaaatttttcgggttcattagacttctgtaatttaattttaatgattatggaaccgaggctttaacataatacaaaa

SEQ ID NO: 36715 - DNA, 834 bp, Heterodera glycines
attgacgataaatagtaaaaaattttgtcattgcattttagatttaaaatgccaaaccaaaaggacggagtgacaggaggcaaacgaattgagcaggaacttgccgtgtttgaccttcccttttacatcgtcgcattggcctttttcctaaaggcgttcttccgtctgtatgacttgctcgtcttcgtcccattcaaattatttgctgaccctgagctggaaaaggaacgctctcgtgagcgaaaggttttgcgctttcaaaagtaaaaaaagcaaataaaacggagggtttgctttaggccatgcccatcgatgggaagccgacttcgtcctggagacacgtcgataccattggcactgctctgtacaccgaactgtttgagggctgtccgacgcttggcaaaatttgggacaaagcggcacagttagtaattggctttatttatttatacatgcgtttatgtttgaattgaggttacaccgtggacacaattgcatgggcacgcgcgacattctcaatgtcgtcgaagaacagcagccggacgggaaagccttccaaaaattggcacttggcaaatgcaattggatgaactacgaacatgttgatgaagtgatcgtggaagtcgcttctggactcagcaatttgggcattgtccaaggacaaaaagtggtcattttctctgagaccaggaaggagtggatgatctcggccatcgcctgcttcaaattgggccttccaagtgcgctttactacaaatgatctattacttttctaaatcgcccttttcagttgtcactgtttatcccacgcttggtgacgaggcaattgctttt

SEQ ID NO: 36716 - DNA, 845 bp, Heterodera glycines
gagtcccagtgattgaaatgttgatgggttgtcccagtgattgaaatgtaggagaattgagtgccagtgattggaatgctggtgagttgagtcccagtgattagaatgctgttgggttgagtcccagtgattgaaatgttgatggattgtcccagtgattgaaatgtaggagaattgagtgccagtgattggaatgctggtggattgagtcccagtgattgaaatactggtgggttgagtcccggcgattgaagaaaaagccaagaaaaggatgcgaggccgcgaagcggccgagccagtcgattttatcattcataatcctataatacaatcgtactacctagcggtggatgcgccgaaggcgctgaccccgctagttaagataaattgtcgaacaaacgcctttttttatttattttaaaataaaattattaaaatggcaacttttgtcgtttcccaaaattaaggcatttaaaaatgaactaattagaatttatttatttttaaaaatattgttggtcttttgtccgtgggtcttctgtcagtgtgggtctttcgtctgtgggtcttttgagagttggccttttgtctgttgtgggtcttctgagttgacacccaattacttcaccgattttcgattttttttgtgttcattttcccaagggcagttcagcagcagcttttattcaattggtggcaatgcccacccattctccattttcattttcattctattcatcagatttaaatgggcttttgtgcacaatttacggccagtcaccacacacgaccacactcatcacattactaattgttagtaaaagacaaaaattttacatttaatt

SEQ ID NO: 36717 - DNA, 1093 bp, Heterodera glycines
aatgagacatttcaattgcatttttaatgaatggcacgacaattttttttgttagtgttaaaattgacgaaatttgccgacggaaaatggctgaaagtgccattattaatggtgcatggaatttgccttgtgggcacaaaaaataatagttgaaaagtgccgagacaaatggggagaaaaatagtgccaaaacaggaaacgcaatattaaaaaatagaaaaatggattcccgggggattttcgggattactgatcacaaattttactctgtttcttcaaccaaatcagaacccttaaatgagaaaattgtgttttaaaaatttaaattttcgactttttgttcgatgtcgggttagagatttgggaattggtgaaaatcaaaacaaaccactcatgatacagtctttgaagaaactcacaattttatggttaaaatcaaaaacttaattttcttatataggccaaaaaaatgttgccacaataaattgagaggaagcaaaaaaaaggcatttctgcgaaaaaaccccaagggaattggcggcggcgaatgccggcgcacttttcacgcttctcttttaattatttataaattagcggaaagggacaaaaaagaaaagaaaagcagcacccaatgtctgggcaatacaaagataaataaaataaataaaagataaaatttaaatttaaaaaaaaaacatattcttataggggagttctatcatgaattacatcacgaaaaatgaacgggcgaagtgaaaacaaataattaaaaagaagggcgggggactttagaagcgtgtaatctttgctttcaaatatattaaaacttttttttgcagaatatttggccaaaaagggaaacagcaaattaatgttgaaagtgccaatggcactctccgtttttcagagggtttatgccttttaaaatccggcacattaatccgttgtccatcacgtgcgatgtctagaccatcttaacatttcattttctaaagcacaaagttcgattccgttactgctgtttgtcagagtaaaaaaaatcagacaaattaaaaaatcaaatttaaaaaaaggaataaaaattgaaagacca

SEQ ID NO: 36718 - DNA, 823 bp, Heterodera glycines
tccgattgctcatttttaggaatgcttttcccctcctcttctttgtgtgttgacatttaacataaggatgtgttgtaattgagcctataaaatcgtttttattctctttgttttgccatattccatccaattaaattaaaattttatcattttttcaaaaataattttattttatttccaaatttcaatttggcactttcattgtttctaattttaattacggtcttttaatgcatttaataatggcataatattaattaatttatttaaattaaatattaaattccctttttccccatttttccaacttttttttcttatgtaaatttttctctctttttccccattttttctcctcaagtgccttttatttttctcgagaatggtttcgttttgtcctaaccattctcgagcatttttccacgtaaaactctcgaaaatccgtctcaaactgcgggaagggcaaacaaagcgaaatttttgggttttttaacgttttttagggggcaaaaggcaccattcattcattctgctcaaagcgttcaacctcagtacatttacaataattatattcagtgtttgtattgtgtggtgtgtcatatgtataattttgggtcccttttcgaaattttaattttattaatttttaattttttgaattttaatttggttaattagcattttgccttaaataatgaataaaaaatagatattttgctatttttaaagctacaattagtgtgtaaagtgttttaatattggaaccttaatttttattttttccattttcattttcccccgataaaaaatgccttggcttaaa

SEQ ID NO: 36719 - DNA, 962 bp, Heterodera glycines
aaaaatcctattctctgaaagtcactattaaatccctaccccttccttggataccaacttttgtcttctgttgtagcgtgaacaaagcactaatagtgtgtttgaaaacgcacgaaaaatagttcttgacaaaaaatggctatctctgaaagtcactattaaatccctaccgggaattggacaccaacttttgtcttctattgtagcggtgaataaagcactaatagtgtgtttgaaaacgcacgaaaaatagttattgacaaaaaatcgctatctctgaaagtcactattaaatccctaccgggaattggacaccaacttttgtcttctattgtagcggtgaataaagcactaatagtgtgtttgaaaacgcacgaaaaatagttctagacaaaaaatggctatctctgaaagtcactattaaatccctaccgggaattggacaccaacttttgtcttctattgtagcggtgaataaagcactaatagtgtgtttgaaaacgcacgaaaaatagttattgacaaaaaatggctatctctgaaagtcactattaaatccctaccgggaattggacaccaacttttgtcttctattgtagcggtgaataaagcactaatagtgtgtttgaaaacgcacgaaaaatagttattgacaaaaaatcctatctctgaaagtcactattaaatccctaccgggaattggacaccaacttttgtcttctattgtagcggtgaataaagcactaatagtgtgtttgaaaacgcacgaaaaatagttcttgacaaaaaatggctatctctgaaagtcactattaaatccctaccgggaattggacaccaacttttgtcttctattgtagcggtgaataaagcactaatagtgtgtttgagaaacgcacgaaaatagttattgacaaaaaatcctatctctgaaagtcactatttaaatccctaccgggaat

SEQ ID NO: 36720 - DNA, 988 bp, Heterodera glycines
  misc_feature (850)..(850): n is a, c, g, or t
tggaatatctattaaatttaaaaattatttgaaaaataaaatggccacggcgcaccgcacttcgtttcatgttcgagagcgtttgttgcatagaaaatttctcaaaaaaatagatagccatttttctggaatatctattaaatttaaaaattatttgaaaaataaaatggccacggcgcaccgcacttcgtttcatgttcgagagcgtttgttgcatagaaaatttctcaaaaaaagagagccatttttctggaatatgtattaaatttaaaaattatttgaaaaataaaatggccacggcgcaccgcacttcgtttcatgttcgagagcgtttgttgcatagaaaatttctcaaaaaaatagatagccatttttctggaatatctattaaatttaaaaattatttgaaaaataaaatggccacggcgcaccgcacttcgtttcatgttcgagagcgtttgttgcatagaaaatttctcaaaaaaagagatagccatttttctggaatatctattaaatttaaaaattatttgaaaaataaaatggccacggcgcaccgcacttcgtttcatgttcgagagcgtttgttgcatagaaaatttctcaaaaaaagagatagccatttttctggaatatgtattaaatttaaaaattatttgaaaaataaaatggccacggcgcaccgcacttcgtttcatgttcgagagcgtttgttgcatagaaaatttctcaaaaaaagagatagccatttttctggaatatatattaaatttaaaaattatttgaaaaataaaatggccacggcgcaccgcacttcgtttcatgttcgagagcgtttgttgcatagaanatttctcaaaaaaatagatagccatttttctggaatatctattaaatttaaaaattatgtgaaaaataaaatggccacggcgcaccgcacttcgtctcatgttcgagagcgtttgttgcatagaaaatttctcaaaaa

SEQ ID NO: 36721 - DNA, 514 bp, Heterodera glycines
aaaattgccgaaattctgtcttaataatttacctccactaatgtcagacattcaaaaagaatcagaggaaaaaatggcaaaagcaatttttaaatttaatttttttttccttttttcagtttcatttccggcgacggttggctggcggtgttcgatttgctcccgccttctcaacttggccttggattttttttattggcctattttaatggcaaatcgaccttgtgttttcaaaactttcccacggttcctatcggcgtgccggacctctcaaatttttcacaaatattcttaaagccaattagggtttaagaaaatcactaaatttatcctaaaggcatacatataatacaacacaaaagttgatcaccgcaacaaaaaataacaattttataaacgtcaaattaattctccaatatcgcaattcaaattgatcggtctcttctcaacaattcattcattcacttttgttgctgatcacttgggccgggagcgtcgagaaggctaaaaatcg

SEQ ID NO: 36722 - DNA, 878 bp, Heterodera glycines
ctaaagaacttattaaataattgaaaaattattcttaagctagaaatatgaattttagcaaaaaaattaatatgaggcatttattaattcattaattcaaggaaaacacgtgcaaaagaataaaaaatacaaaaaaatctctataaattaaaaaagaactataaaatatttaatatataataaaaaaatttaaatagtcaatttaaaaaatttgttaaaatatacattttagtaagcaggatattgattgttttagtaaattaaaaaactaataattatttaaataaaaggttaaaaaatattttattcaaatcaattaatcatttaatcacatataaatatgaaattaaaattatataataaaatatagtaaaaatattcgtacaaagaaaataccctttaaaactaatcataaatttaaataaaaataattttattttaaatataaattaataactaaatataatatttatttttaaaatttcgtaaaatataaaaattaattattcttataatttaaaaatgagcaatatttattttaaaaacatgagagaaaaaaagagaaacaaatctaaattaaaataataaaagcttcaaaaaaatgtgataaaaaaggaaacgcaacatgatattaaatgaaaaaaatgaataaaaaatatattataaatccattttgatatttttagtgtttatagtctttaaggaaatattaaatacgacggattttgaaaggatatattacagttttagtcaatatttttgtcaatatttgttcatattgagttaaaattttgcattaaaatctcttattataagggctatctgtctgcaatataaggaaatattttataccgtttttttctacagaaaaagtgcag

SEQ ID NO: 36723 - DNA, 982 bp, Heterodera glycines
tgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattctgaagggcggggggggggggcggtgttagaagtgtaccttcctatagaacttgtcagaaagagaaaaagaagaaggggaatatgaatacggacaattcatgcattcattgatttgcagagcccatttgttacctctgcgaggcgcacctattcttttccgttcttaaattgtaaatattctgtccatttcccaccacttacgtttcttaaaaatgaaaatgtcgctggaaaaccgatagaatctcttttttctcttcttttatttaagtaactttacaagtcttttattctaattagcaccacattcgatcaaaaaatgaattgtgagaaatcccaattgctcaaattaatccagtgatgttttgatatgttttttcatagaaaatttacaggagttgtcgagggttttcaattttaagggaaacgctttttgatgaatttattctctcgaaaattcccgtcaagcgaatcctaaacttttgctgagcgagtgttgtaaaatggcagtttaaaaggaaaaaaattgtatccatttttggcaaaatgttaaaattattacactgccattaggtattattatattagttaattaaataatttgaatggcttctctttacgctttggagaagtgggttttcccccattcatatttttggcattatgccactaatgaggaaattaaataaattctctttg

SEQ ID NO: 36724 - DNA, 910 bp, Heterodera glycines
tatggatggattttttgtgggtgcgaaatttaaattgaatttttagactgaatttgtttgaaatttagaggctaaaaattttttggatagccatggtttttcaattttttcgatatttaacagcgcaaaattttcgtggcatattttagttttttttttctttcagtttttcattttctgtgattaaaatgggtttttctaacccaacaaattttgattgattttcaatttttagacaaaaaaaaaattgcgttttccaatttttcaaagcacaaggcatttaaatttaattttgattttcaacggcagaaaaacagtgacatattatcaatttttcagcttttaggccttccaggttgcaattttcagcattttttgttgtaacctaaattaggaaaatgaaaaccctatttagtaatatttccaattagccgtgccgtccgtgtgctgtgccgttgttgtaaccccccgttttgccgccgttggcactattcactcattgctaatttgtttatgtttttgtcccctgcacccggcttctcccccgccgcccacctgcgattggtttgcccggcggcgcaacgcggccgatgtgacaaaagtgcttcgggcattattcggctggcgctgtgccgtgccgacagccgccgcttctcgttgtgcaaaaggctaatatgtatatgtaaatatgtttttgtagggaggacggaatgccaaagggacaaaaggccgccgccgtcaaagggcgcagctaattagggcagctaatcagtgaggtgtgaagctaatgccctcagggcaaaattaattgagtgaaattccaactagccgaaaaagccaattttgggcgagaaaattaagaaaaaacagaatttttaaacatcttagatgtttgtttttatcgattaaa

SEQ ID NO: 36725 - DNA, 793 bp, Heterodera glycines
gggggtagtggccgaattttgttctgattttgatattttaaaaaaattttgcttttttttcaaatacaaaataatgttcttgttgtgttgatttatttatttcttctaaattttaaaaataggtgaaaaaataatatttatcggccccatgggcaatccaccaatttgatcagtaggatttctaattttatgtgtcaaaaattgcaaacaatgcacataaaaaagtgtaaaatatgtccataaatctaatcaaactgatgaacgaatttgtcaaatttcttctaataagctaaaagtaaaaaataaaataaaataacgattaaaaataatttattaaatatttaaaagaaaaatacgaataaagctcaaatttattaatttgaaaaaattaagtaaaagtcaaaagggcccgttttaataataggggctgttataatagaggttttcttaaaaaaatgcctaaacattcaaataatcgagaaatattcacggatatgcatatttaaatgggcaatttttggattttaaaatagggaaaactttaatgaagaaattggaaatacgaaattggataatttgcggaggagagaaaggaaagggaacaaaacagaaaaaaagaataaaaaagggaggggggggagcaccagagcagaaactattaattaattaattgagcgtaatctattatgtatattgccattaattgctcagatttcggtttttaattttaaacattgctaatataagtgtttagtttctgctctgtgctcccccccccctttaatttcttttt

SEQ ID NO: 36726 - DNA, 947 bp, Heterodera glycines
ttgtttgtccgtcgtctcgtaaaggagcacaactccgccctggttatccttgctgctcaacaccattttccaacgtccatcaggccccataaaaactgtgacaaatcattatttgtatttttaaattgcaaaaatgccatattttaccgctagggtcccgaaaatccggcattaggccaacaccgggcggcacatccgggatcagcgtggtggccgcacgatctggcatgatgccattcgttgtggtcactgctctttggaattgccatggcacacgatctaatgatttataaaagatccctttatcaaacaaataaaaaatttccaaaaagaaaagtttttattattattttatattattttacgggtaaagaaaattttaaaaaatattattttttgtaggggtagcttactcaataattgttgaatgcacttttatttatttgtcaataaagaaaaagtccacaaaagggaaaaatccgcttacattgaggacaaaacattaattaaaatgtcctcaagaaagcgcataaacaattaaaaacgagatcgccgccaaaaaataaaatataatgtgagatcaataaaaaataaaaataatgaccaaataactttttgtttaatgaattaataattcgacttttatttttccggtcaatcttacagaaatgaaatagttttaattttatttttaaattgatttaatgagtttatttcaataagctttttatcgagttggttccaaatttttgttacccgccccgcaaaaggtataaattttttgcctaatttatatttcgagttaagtctataaaagggaatgttaaagaaggtttaagtatttcaaagggattcagatctgttcggccataaattattttatgagccatgaacagatcagacagctttcgcctgcttttcagtgttggcagttgaaggtattctaa

SEQ ID NO: 36727 - DNA, 858 bp, Heterodera glycines
cctttattgcctatctccaagatgtcgaagaaccattcgatgtcgagtaacatccggtgctaccagtgagtggcggcgtgctgggcccgtaccaaaagaaggaggtaactttacctgggtaaagttacccgtgtaacttaacccggttaagttacctccatctgtgggttaactcgtacaaaatgaacgttaccgggttctcgctgggcttacccacatctgcgggtaaggttacccgttacccagttcttttagtgagggtaacgttaaaaattattttttaaatttaaattttaattgaaaataaatttttattttttgctcaatatatatgatcaaaaaaaactttcaaagtttgattgcttaagtaaatcgattctgtgtaatctctcctctttttttaatgccggacaatttcctttgtctctcattcataagtgctctatcggtgagcaccgccggttcaacagtactatcaccaacaacatttccgttcccttcatcaattaaattctcgggctcaatttctgtctcgggctgatcttcaatttacatattatatttcattggatagaggagaatttgaagaacaaaataccaagaggaattagttaggaaaaatatttaagtatttttaaaatttttttgaaaaattgagctcatattgttaccctggtatgggtcagggtagaaaagttacccgcagctgagggtagggttaccagttactcgattcttttagtgcgggttaaaaagttacccgcagctgagggtaagttaaccgggttaagttaccctcaactaatgctagttcttttagtgcggagctggtgttcaatgaggcgatcgtcagtcatg

SEQ ID NO: 36728 - DNA, 1370 bp, Heterodera glycines
agtaatggccataccttttggttagaaaaaattttttcaaaaaaaacgccagaaaaaaatgcgggaaaatttcccgcgccagccccggacaaacaccgggtttgggacaaacaccgggggcgacccttgttttcacacaccctcccaaaggtgtgaaaacacatgttttcacacctgggacggttgggacgctccccgtgggataactactgtcatttatctacgttaatcttactggttttgatcacgatttttgaaaaatcttgatcattgcaagaaacatgaatttttttttctaatatcgatcaaaatttcgtttctgaaccaaagtgatttaaattcaatgttttcaaaaagtttctgcataatttttttttattttatagccaaatgaacgtgaaattgagtgatggtaaaggcagctttgcggaccgtgttttgttgatggaacggtaaatttgaaatttaattgaaaatgccaaaaagaatatttacttaattgaatcacatttatttcaaatatttgccaatttttatttcttaatatttgttttttcagtctttgtccaatggtcaacaaaatgggagtagctgcaaacaaaagcaacctgatcatgcagccacttgagtaagttttattgaaaattcaaatccttcaatatttcttataaaattatttgagcataattagtgtggggtttaaaacgattttgtgtttttaatattttggcaaaagatattcaatagccaataaattttctcgaagcctttatatttataaaattctgtacatttttacaaaattggcaaaaaaaaaaaatttttttttgacaataatataaatggcaattaacgaacttagttaaatttttatttcatttgtttttaaaaaataatttaatttattactaaaatttactgctcaactcattaattttttttaatttaatgcaatattataagttttgcaagttaattagggggcaatttcaattatttctgcaattaatattatttttaaatgacatatgtttgtttgttttttttcatttagatacaaatacgagaatgtgcgcatggaaatcatgcacagctgcgccggaggagaaccaaaaaaagtgcattttttggataattatacaaatatttgtttttccctgaaacataatatttcaaaaaataaaattgtaccctttttagggatcaaatcattgatatatttttttagcaattctttaattaatttcctgaaattataaatttttactctttttttctttattttcctgtgactgtttttcgagttttttggcacttattttcggcattatggctcttaattaaaaaatttcaatcaaaattttattgtt

SEQ ID NO: 36729 - DNA, 1039 bp, Heterodera glycines
  misc_feature (775)..(776): n is a, c, g, or t
ttttgagcccgggcaatttaggctaatttttgaaaattcataactcgcttcagggttggacaatgttagtggataaagcttaaaaaataaagaaaaatcaggagaatttatttgttttatttgggttttctaattaaataggaaaaaaattttccagaaattctggaaattttcaatttttcagaaaaaattcaacactcgattctgaaaaggagttttcataaattaaaaaaactaaaaaaccgcaattttttgcattaaaagcagggttcgtatctgtccttatttataagatttgtccttatttggagggtccaaatcttacaaaataaaaatgtccttatttgtaagcttatttcgggctattgttcttattttgttcttatttcttaaatatattcataatttggaaatttatggccaaatgttcttattttacctataaattttaaaaaaattttccccggcggcgcctatcggcaccgtcggacgctaaaaatactttattttctttaaaattggctcaaaaatcaccaaaatttatgcaatttttagacaaaatctgttaacaaatcgcattaaaaatcataaaaaaatttcccaacggcgcctatcggcgccaccggacgcccctgtccaacctccaaaattttttttaaaaatgtcgcaaaaaaagccttttgaatgtaaaaatggtcgccaattgtctcaaaatcgcaaaaattgataatttttgatgaaaatctgttaacaaatcaaagaaataacaaaattnntttccggcggcgcctatcggcaccgccggacccactcccctcccccgttctccaaaatttcttggaaaaatgcgccgtaaaaaatttgttaaaaatttaattttttttagataaaaattgcactaaatttgctatttttctccccaaaattgttaaaaataatcatgggaggtgaaaaatataatatttgatacatttttgatcgaataaattgtaaaaatatctgatttgaagcaattttgcgaaatgttcttatttttgac

SEQ ID NO: 36730 - DNA, 909 bp, Heterodera glycines
ggacgaacaggtcaaatcagacgaacaatgaaagaaggcatggcaaaagagcagacgaaaccaatcaaaacacagaagaagtggtgaaacatgggttttaaaaatgattcattcgggggcatcatcatgtagtgttgggaatttccaatcattggcattttttccgacttttccattcccgttacaatactccaaccatttccttcatcatcttttacagtactccgtcgcgaccgtctcttttccgtgtccaattccatcagcagcacaatttgctgccgctgccccaccaccagcaagacgcactcgcaggaacatctgtcgctgaacaacttcaacttcataaacaatcgccacagaaactgtataataagaagcattctctacccgcgctgcacccatcgaacagtttgacaatggcacagcaccaacagaagcagcaaacaatgccgaatccattgacaaagggtaaaagggggaagactataattagaagacacaactgatcagtgttaaaagtgatcaatcatttaaaatcattattattaaatggaaagggattaaaaagtgaaattgagctaaaattaaaaataaatttcttagatttttttgattaagctaattgcctcattacttttcgccctcagagtttgtgcagcgcaaagtgcaccaatgggacttggaggaggaatttgaggaatgttttgtggccgaagaggtggacgaactcactttcgcaagtcttcgcgaatcggaggtgcaccaaaacagtttttaatattaatctgttaattaattatgtatttcaatgttttcaattcaaaagcacagattcgggaagtgttggcccggcacggccgtgccaatgatttggctgtccaccaacgctttttggaattagtcgcggac

SEQ ID NO: 36731 - DNA, 626 bp, Heterodera glycines
aatttttcagaaatttccctcttttggatgaaaatacgcccccaaatcagaacatttcttagaaacaagaacataaagaaaccctgtactaatcagaaaaaaaaataaattcaaatgaaaacgtcaaccggtgtcgaactcataacaaaaaacactgttagttgtgaagcactaaccactaaaccaaaatatattggaacttcatagcaagatttactttatttcataaaaatttgtcaaagatggtaaaaaattaaaagttttatgaattttttgctttatatcccacgaatatgccattcttaggggtgtattttcacccccgcgcccccgcgggggtgaaggtcgcgggggcgggggttgcgggggtctgagtcgcgggggcgggggtgaggccaaaaaacctgtcccgcccccggcgggggcgggggtgacgggggcggggctcgaaccctagaaacaatacatattttcatataactttttctaaagtcaaagcgatggcaaaatttgattttcatagtaatcagtagggatgggaactaaatgaaaatatgttaacaaatcagaaagaaattacaaacatttttccggcggcgcctatcggcaccgccggaccccgtccc

SEQ ID NO: 36732 - DNA, 984 bp, Heterodera glycines
  misc_feature (970)..(970): n is a, c, g, or t
ttcgtttaaaaattggttccgaaattttttgactctaagaaattaaattgtaaaaattcaaaacttaaaattctcctctgaagtttcgaacttggcttaaccatgtttttaagtcccaccgtgaggagggacagttccaaaatttgtaccacattttactgtggaaagtccaagtaccttaattggacaattacttgtcaacgaacacagtcgcctctggcctcttatggaacagaaaaggggaattatcagatggggtgcgtcccttcctaaaaattactctcgtcttctaccctccctctctttttgtgcactgtttcgtttaaaaaattggttccgaaattttttgactctaagaaattaaattgtaaaaattcaaaacttaaattctcctctgaagttttgaacttggctctatcctgcttttaagtcccaccgtgaggcgggacagttccaaaatttgtaccacattttactgtggaaagtacaagtaccttaattggacaattacttgtcaacgaacacagtcgcctctggcctcttatggaacagaaaagggtgaatatcagatggggtgcgtcccttcctaaaaatttctctcgtcttctaccctccctctctttttgtgcactgtttcgtttaaaaaattggttccgaaattttttgactctaagaaattaaattgtaaaaattcaaaacttaaaattctcctctgaagtttcgaacttggcttaaccatgtttttaagtcccaccgtgaggagggacagttccaaaatttgtaccacattttactgtggaaagtccaagtaccttaattggacaattacttgtcaacgaacacagtcgcctctggcctcttatggaacagaaaaggggattatcagatggggtgcgtcccttcctaaaaattactctcgtcttctaccctccctctctttttgtgcactgttttcgtttaaaaaaattgnttcccgaatttttt

SEQ ID NO: 36733 - DNA, 982 bp, Heterodera glycines
agtcgacgatcacgacgacagaaatacagcaacaaccgttcgtccttcgctattggtcattattcaaagtgctgaactgatggaaaatggcaaaaggcaaagcgaacagagtcagaggatggaagccacaaaaacggaggagaagaagccattgaagcaaataatgtttctggacgattatgaacaagttcaaggagaggaagagggaaacgaaatggcaaatggaagggaagggcagcggagagaagggggaaaagagggggaggaggaggaaaaggaggaagaggcatttgaggaggaagagaatgaggaggaggaggaaatgttcttcttcaaaccgagcggtgggcacgccctaagtaaggacaaacggacgaggaaatgggccatcccaaaaggacactccgttttaagggtgccgcaaggatatttcccaaacccgccaaattggcgcttattgacaaaaaaagcattgttttaaattttaagcaacctaattaagcaaattttataccatttaatagctcttattcaatactctctgtataggctataaatttctattcactcatcaaaaattttaaaattgctggccaatagaaaataccgaaagcttggatttaaaatttttgattttgagaaaaataaggacgtcgaatttatgaaatgctaatggtggcggaataaaggaaatggccaaacacgctttttaaggaggggaacgtcgaacagaagaacggaacggaagagcaggaagcagagacccatttcgaattgtggtccatgaaacgagcaaaaagttatgaaatgagagacaaatgacgaaaatatttgagccattcattttcaaattaaaattattttatcgaaaattattttattttttacaaatcggtcgataccgtatatgctctaattatagcccagtctctattaatcccgcagtctccaatatcccccagtctaagaggtgttttgaaaa

SEQ ID NO: 36734 - DNA, 723 bp, Heterodera glycines
agtaccccaaacggacacttgaaaaaatcgatttattctttttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttatttcataaatattttatcagaaaatgctctgaaacgcaccaaattttatttacatgttagtttaggcactctgatgctttttctatcgaaaagggagatgaataaaatttttaaaaaatttttaaattcctttttaaacaagccaaaaagtttaggcttaacttttttttcagaaactgatcagaagcgcaccaaactttgcagggatactgaaaggaagagaaatctcctattttaaatattatctagtcagttcatttaaataatttttatccaaaaaatttttttttgggttttcggggcagtccccctgaaccgatgcgcccagatttatggggagacggaatccttcgg

SEQ ID NO: 36735 - DNA, 1197 bp, Heterodera glycines
taaaaaataaatctaaaaagaataaacattaatgtatttgaaaacataaatctatttgtaataataattgtattctaaaaaatattaaaagtaagcgttagttaattataacgtagaaaagaattatcatttgagttataaaattcattttatttaaatgttaattaattacttttaagattttattttgtattaattataatttgtttatgaattttatgccgttatttgtatgatttgttgttttttttattttacaataaaaatacatttaaaattgaacatgttaaaaaacagtaaagaacaataaaacatcacgactttttgccccatcatacatgcgatgtgctaaggccttaataagaaagtgagaaatgaatttaaaaataattttttagcttaaattttttagcttaattattctataatttatttacgactttattgtaatattttcactataagaatttaatgttcgaaatttttattttaaatattttattaaaatttcgaattttaaaactttgttttatttttataaaataaatacttttatagagcttgttaaaaaggttttatttttcaattttcttatttatatattaaaattcagaaatgaatattttttctaaaatttttattaagtaaattcaagtttaaaatacattgtttttataaataaaaatgagattttaattttaagcattaaaaattatattgtctaattctttatatatatatattaacacgtcaatattcgttttttggatttgctttaatatattaaattatttatttttgaaaaattttttatgtttttgtagtgctcatcttctatggcaataattttttcctttactgcgatgaaccgaataatatgtactaattgttatttcttcaattttattcaaattaaaaagtaaacaacagatgtgcagatttaagataacgatcctttagctgaaaattaaaatttactggccaatttgcactcttatttgatcatattttccatcgcatgtaacaaagaattaaaaaaaatatattaaaaaaaataataacagaatttattttcaatataattatctatttaataaacagttccaaataaaaaatattttatttaatgaaaataatttactaaatgacattttgccaacattttaaaaaaattatttctcagtgacgaaacgatca

SEQ ID NO: 36736 - DNA, 690 bp, Heterodera glycines
ccatgtggctgttcatgggcgaaaagtgcgcactctctttggttggcattctgttcaatgccattttggtggcctctactgtaaaatcgaagtaagacagtacggtattgaatattgggttgtcatcattaagttagtttggtttttctccatcctgaccagggcctaggaatgtgaatgttgtaaggtttgttcaggaaagctaatttgtgcaaaaattgttctcgcaattgcacattatagatttgttgtaaattcaaatggaaattttagaaaaccaggaccgaatcaatgagaaatgtgcttttctaattttgacaatctaaaagaaaaaaagaaaaatttagaatttagaattttttttataaaaaagtccaagtggtatgttttgatattttaaaaaatttaaattaaaaataattaagaaatttacaaataatttaattataagaactaaaaaacaaatttaaacgaatagaaggatttgtaattttcgattttgaggcatttttgtatattctttcatattttatgaggcttagttagaagaagtgatcagtcactctaagtattgatttatgaattaattttattttatggcacaggaagtaacccaaaaactgaacttttatgttcacttaaaatcgtctcattttaattcagaaaccttaaaagcatgtgcaatttgct

SEQ ID NO: 36737 - DNA, 371 bp, Heterodera glycines
aaattttaaggtctgacgcaaaatttttttgatcccgaatgtaccgaaattataattttgcattttcctccccaaattatcaaaattgataatatgagactaaaaaatataaatttgatacctttttgatcgaataaattgtaaaaataactgatttgaaaaaggttgcaaatgttcacatttttgatactaaaatcttattttttgggcttggtgttcatggtggaagccctggtttaaaaatacctggaggggggagggggtttaaccgaaatattgcgaacccgtctcaacatcgaatttgaccaccattttttttgcggcgctctttttcaaaaaaacttttggggaacagaaggggggatgggcgg

SEQ ID NO: 36738 - DNA, 1067 bp, Heterodera glycines
tgcagaaggttcatcttaaactttttgtgcatttttttgcttttttttgcgattttggtgccttattccgggcacgtaattttcgtgcctttttgacgtatggtgcttttttaatgcctttttcggtattttttaaaaaaattgtaaatttttgaaacttttgcaactttttctatcacattttattacaatttccaaaaattttccggcaaatttaaacactcaaatttgaaataagataatgattagggtcgcgacttttagtgacgaaacatgttgaaatagttaactaaaaaagtgccaaaatagtgaaaaaaagtccgaaatagtgacgttatagtgatataattttcagccaaaaatttagcaaaaattttttttacttcactgaatgcagtgcaatgaggtgtcggcaatttcgttgccgacgagagggccatatgctttttcttttctttttttacctgaagctttgagatgtaccacaattccaagacaaacataaattatgaaagacattgaaataagcataaaacttattgtatttaaaattgatttattctaaaaatatataatatttaaattagtaataaaaaagcaataaacaacacctttaaaaaatcgccatatgatccggtggtcaactcatcaccttccataattgcattttggtacaccgaagcagagaagcagacaccatagaccacagaaagaattgttaacagtgccaaatacagtcgttttttaaggttatcgtaactgaaaattactgtaattaacaatttgataatattgtattttttcatacaattccaaaaaagcaattccaatcagtcgatcaatgccagtgaaaaccattgccggaaaaattgcccctgaatttaaatgtatttaaaatatttatttaataattttctacatgcaaataccaagtccaatcacaggaatgaataaaatttttgctgctaaatgattcgcaatgaaattctggccagaaaatgcggtgtacacaaacagaaatgggccaagttgataaagcaattcataaaatgagcaaagtgccaaaa

SEQ ID NO: 36739 - DNA, 809 bp, Heterodera glycines
ctggcatatgatttgctcattctttttctttgtgtctccgcttttctcttcactctctccttttctcttcattttttttttgaatattgtttggcattttgtatacaaaaataagaaactacccaaaatgatttcttttttaactttcttacttgagcagactttgttcgggaccggcttttggaaatttcggaaccagtaatcccgcttctaggccgggaaaaatcgctcaaaaatgggaaaaagattgggaaatcttggtataaatacagagcccggaactagtcctggacccgaattcgatgccatagaatttttttttttgatttttttcatccttattaattttttagccatttatttgacttccagttcagcaattacattctttgttcttcttcaattttcgcaatggccaaatattgtttaagtaagaaaaaaagtcaatcaaaaaaacagtaaaattttccattttcagaaaaacaaagcaaacggttgacctgcaagaagaagttcaaaattcagcgcaaagttcgggaacactcgcgaaaacttaagaaaatgtccaaaggtaaaaaattaaaacgaaaaccccttggatttttcggaaatttcattgccctaaccctaataaaaattttaaactttagaatccgagcggaaaaagaagacggaaaagcaaatttccgtgcccagcaaatgtccattcaaagaggaaattttgatggaggcggaacagaaacggacggaggcaaaggtttccccaaaaaaacattagtgccgtaaattgtgtaaaatttttggttttt

SEQ ID NO: 36740 - DNA, 759 bp, Heterodera glycines
aaaaaaatccaggaaataaaatgataaccgcttttttcaaattttggagttttttttcatatatgcctatttagtttcaatatttctgttttggcttcgtcctccttccgtcagttttgtccgctttttcagcccgaaggtgaaggcgctttcactgtgccccagcgtggtcatccgccgcccttccactggtccagcacttcccgtttggttgctgatcacgtggcggcgggcgcgttcgactcagccgctcgtttgctggaacaacagctgggcattgtgcggttgaaaccgttcaagccgcacttcctcgccctctacgccaagttggtcgttcgcgtttagtctcgctcttacaattagcactatcaaaagtgcagaaatgcaagaggaaaaatttcgcatcggaaaattcacatttattgttagcacctaaccatgttttaaattatcttttttcgtgatacttcgttttctggggagcagcatcgccctgctaaatgctcatttatcgtaggtcccgtgttgcgtacacagccttcccactttccccgtccaattttgtgtacccggcccgaaattggcaagaagcgacgccgaagacgtcgctgccctcctctgcgctcaaggcatgtttttcatagaaaaatttagttttttggaaatttcttccttttttcagttgaccgagttggcccaacgtctccaggtgtgctaccagttgactacggccggtaaattcagcgacgccaccctacg

SEQ ID NO: 36741 - DNA, 939 bp, Heterodera glycines
ggagaagggagtggaaacatgattcaaaatttcaatttttctagtttatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaaaggggtttgaaaagtttattttgaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttaca

SEQ ID NO: 36742 - DNA, 893 bp, Heterodera glycines
  misc_feature (824)..(824): n is a, c, g, or t
  misc_feature (875)..(875): n is a, c, g, or t
ccccccccccccccccaccccacccctcactccagggaggggatacgtgtggtataatgccctttccccaggaaggaaaatccgccgtacggtcatcgcaaatacattaatatcatagtaacgaaaaaagacaaaccaaacagattccgacgtgtcgtcaaatgcgaagaacaccaggaaaactttttgaaaaacaaaaaacaatttctgtttgtgaacgataaaatctaaaattacaaagaaatgagagattacaggaattaacaaaattagaattgagtcagagaaaacatttggttagccacccttcctgtgaaaataatagtgcgtgaactggactggacacacggcagtcttacgtcaagaatcctgatttttttaggactgaccaccgatttttccgaaccattgatgcagtttacgcatccactttacttttacgcgtccaatcagtgaccatccttagtttatttggccacaaacttttttctattagttaaatcttacattcttggtatcaaacaaatagaaaaataaaacttctgtatgctttaagcattcgattgataccaagaaggatcttgatcaaatataaaaaagatagcctaagaaagtaagcgtggtcattgattggacgcgttaaaagtcgtatggacgtgtaaaatgcagtagtgcaataatgctcctttaaaggaattgaaaaatagtctcctggtcttattttggaaacacgcctctttttccaaattcttgacagtagcagagaatgttcttcatttttagttgaatggaatcacaaaaataatgttgtagaaattaagaancaatagcaattaattttctgtttcattcaacttgatctctcattttttggntgactaagatacatacct

SEQ ID NO: 36743 - DNA, 1396 bp, Heterodera glycines
aaatgacattaccggggagattttgacagcggaggaattctcagtgagaatcccctaggacaggtgggatcagctgtgttctcggagggaaatcccctccaaaatggaagtggaggacttgaagggggggaaccggtggattaaatttcccaccccccccgctcaattaccctcaatttgtatttattaggccacaaatctcacgagcaaaaatgcgttttctatgttggcctggcgatttaacaatcagaagttcacactcggtctactacggcttctaattggacgctttgaccgttgtccccgtacagctccatcagtcgacctctgtgacaataataacattcccttgctgaatagcctaaagtttcggtttctcgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcgaaggcccaccacgaggccgcgaagaggccgagagagtacctccggtgcaggaaaattattaaattttaaaattttttaattgctttttgaatatgccaaaaaatgatatgcttatctttttgttaacgaacatatcgatcattttaattgctttttatttttgtcaaaaaggttaggcttaacttattattgcaacgtagttccctcacatatttctttattcacatgtctcctctcactaccaacgatatcttgtaaaaattctgttaaacgtggcaataaccgtcgcaaatttttcctacgggattttccgaaacttttcttaataatacccttggaaaaggcgacgaacatttgcgactccattttactccttaattactccatttaaattatcaaaacgggtcaaaattcgataaaaataacattcacggtgcgaaaaatggggtatgaaaagtttattggggaaaaaaagactttacaaaataatacccctgggagaagggagtgggaaacatgatttcaaattttcaattttttctagtctaatctactcgaaccggctcagaatacaataaaaataacattcacggtgggaaaaatggggtttgacaagattattgcggaaaaaaaaactttacaaaataatacacctgggagaaaggagtgggaaaacatgagatcaaaattttcaaatttttctaggacaatctactcaaaaaccgttcaaaattcgaaaaaaataaccttccccgcgcgaaaaatgggttttgaaaagttattggggaaaaaaaacctttacaaaaaatacccctggga

SEQ ID NO: 36744 - DNA, 1066 bp, Heterodera glycines
  misc_feature (33)..(33): n is a, c, g, or t
aattcagtaagtacggtaatttataacctttanaatttcataaattagcacagtacagtttaggtgtccgtgtctgtgttttcctgttttttttgtagcgaaaaacagacagtgcggtcggtggtaggtacaagcttttcaaactgtacgagtactcaaatttttttttgttattctgtaatcaacacccgatttatttggtaaaatgaaatttttaaatttgatttttaattttcaattaccaattttgttagcattttcgatcgttttctcaattcagttacgagtagcatttctttgccgttcgctttcttcgacttttttctcagttttgctttcattgtgtggcactttgccaatggtattgccttggacagttcccaaaatcaattctgctggcagtgccacccttttttggcatttgttcattgcctttgaaaagatagaaaatttttctaaaagaattacatatgtataatattttttggaaataggaaataataagcattattttattactagggatgcgatttttaggctttaactattatttttttttgctcaattgttttgaagaaaaaagctcaaaaaacacattttaaaatttttcgattctgatgtcattatcagggctgcaaaaaatatgcacgaaaagtgaccagaatatgcacataaatatgcaaataaaatagccaaatatgcatcaaatatgcacaaaaatcgcaaaatatgcaccaaatatgcacaaaaaaacttgaaaattaggggtctaaatttattaaaaaattttattcctcataaattatatcggttgtttttgtaattgtaaatcaaaaatttctcaaggttttcgacagtgaaactcactgttgactcactcgcgcatccattcacatttagatttaattttaggcattttcaaaattttttcctaagagataatcaaatcggaaaatatttgacgaaaaatggcaaaatatgcaaaaaaaaaaaatctgaaaatatgtacaaaaaatggcaaaatattcaaaaaatctgaaaatatgtaaaaaaaatggcaaaatat

SEQ ID NO: 36745 - DNA, 1131 bp, Heterodera glycines
ttgattaaaattaatcactaaatttaaaagattttgacgattttccccaaaaggctcaaaatttctcatagccataaaaatcctcattaaaaaagaatcctcactgacctatcaaaaccacaaaatgaggataaattctcaggtctgggagccttggttaaatggctataaaaattataaaacaaatttgggtcgaatggtattttgggttttaatattgttgacgaaatgtccatttggaaacgtcattgaaccaattgaactgttaattgggagtaaacacgtgcgaattggcaagaagtgatgagagaaatgatatatcacacaaatatatgtaggcaaatttatcaattggttgccaaaaaatatatatgaaagtgttctttggaggaacaaattgatgggaacggctgtaccttcacccctttccccaaatttgcggcagacaaattcacttaacgggaaatcgtaaaatagcaagtaagtatatgcagtacttttatgttaatgtgtattcacatagtatggttaattcatccctcaccgtaaaataaagcattaaatgatttacaactacaattaggcaaaataatcaattatttaagctttaaaattcttctctgggtgaaggatcgacttactttactccggaggatgggaaaggataatatttgtcagaggacacgaagagaggatgagaagaaagggacgggcagaacagcggaagaatgcgacatgggaattgggcgagaacaaaacaaatgaacaaatgatcatcgagtgaaagtcaattcggagcttttgtctatctctcaataagttgtcattgtcctcactgatgccacccaacccactcggtcaccttcccaatccattgaactgaatttccacggtaagaagacattaagcctttttgctttctccttcaacccacgacatccttttttcacttttttattacaaataatggagaggtttagtcagagaatggtagagtacaaagcaaacagaggcctaaagatgagttgggagagaagtgcagcagcagcagttgttcggttagaaaaaggacaaccaaagcaaagcaaagttaggacaaagcgaggcgagcgaggggggccactgctgaga

SEQ ID NO: 36746 - DNA, 1338 bp, Heterodera glycines
aaacatggatttcaaaattttcaattttttctagtctaatctactcaaaccggttcagaattcaataaaaataacattcacggtgcgaaaaatggggtatgaaaagtttattaggggaaaaaaagactttacaaaataatacccctgggagaagggagtgggaaacatgatttcaaaattttcaattttttctagtctaatctacttaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaatttttttctagtctaatctactcaaaacggttcagaattcaataaaaataacattcacggtgcgaaaaatggggtttgaaaagtttatttggggaaaaaaaaactttacaaaaaaaaacccctgggagaaaggagggggaaaactggattcaaaaattttcaatttttctaagctaaaccacctcaaaggggtcaaaaattgaaaaaaaaaaaattttcccgggggaaaaaagggggttttaaaattttttggggaaaaaaaaatttttaaaaaaaaaacccccggggaaaagggggggggaaaaaaattttttaaaatttttaatttttttttaggaaaaaaaccacaaaagggttaaaaattaaaaaaaaaaaaaactccccgggggaaaaaaagggggggtgtaaaaattttttttgggggaaaaaaaaaaatttttaaaaaaaaaaaatccccgggggggggggggggggggggaaaaagggttttaaaaaatttttttttttttttttttt

SEQ ID NO: 36747 - DNA, 686 bp, Heterodera glycines
agcagcagacgaacagagaaaaaatagtgaaaaaaagggaaaggaggagagacagtcagcggagggaatggaacagtgaaaggaaaggcgaagtgatcactgatcagcaacagcagttaaattaaattactattcatcctgttttggatacgtcagcataaattatcggatattttatataaatttaccataatatctctttcccgtttactgactgttttgaaataagttatgtttcgtgacatttaatatcatgctgagacgaaatatgaaaagtgcaagtgacccaattaaaagcacaataatttttaaatttattattattaataatactaatacctaaaatattttagtaacatttaaattaattaaaaataatctatataaacagaaaagtaaattaattagttgtgcctaatgaaaatgtcccacaattacaataatttttgaccgtttactgggctagaaggattaagtaaattgcgcttcctccccgcttatcccttcactcatttgacgcgttcatttaaatgtttgcacacatccgcaaagatatcgtcaacagagccttcagcagcgagctgattggaaatcacttggttatggatacaaatttaatatgaatatatatatttcttacatattttggactttttagcaccttttcctacatttttttgtatttt

SEQ ID NO: 36748 - DNA, 1199 bp, Heterodera glycines
aaaaatgcaaaaatatgcacataaaaaggggaaaaatattgacattaatttttttcaaaattgagcgttataatttttcaaaaatttctttaaatttcgctaaacgcaaagtaaaactttcaaatatgactaaaaatatggtattaaaatcattttagaacaaaaaaccacgatacaacttaaattttacgaaaaatcaacctgaaaagcaaaatttcgctttttgcttattttgggcataaattaatcaatttttaagaaaattttaatttagtcgatattttcgacaaaattttgctaaaaagtcttttttggaaattttttggtctttaggggtcaaaaaggccaatttacttgataggttttaataggggtattttgaaaaaatgcccaaatatgcacataaaatatgcacgaaatacccaaatatgcacataaaatcatgtttttcgtgcgtttcaggcctcccacagtccaggaaaaaaatatgcatataattttatgccctactgtgcaatgtttattattcatttttatcacactgctttcttcccgaagaataatgcatattttggggattttcaagaataaatgcatatttcaccatttttgcgtttttagaaaatagttcagccatttttagaaattttcacagaagaaatgcaaaaaaagcgaagaatacataaaccctctgagaatcgacgattttaaaagtttcaattcaaaaaaaattcacactttatttgggttcaaaaagccaaaattatttttcgggatcccgactgaatcccgatcactcccgaacattttggaaaaacgatcgggacggatcccgggtcgggatcccgaccgaatcccgatcccgatcaatcccgaagatttttttcgggatcccgcgggattatcgggatttgctcaaacccatttttttttacattttgtgccaagttttgttcaaatatttatctaatatttataattgatcaatacgattgaagaaaaaaagggatgtgaattatatcagatttttatagaaatttttcaagattggaatatcatgcccaaaaaatcagattttcaaaaatgagaacatttaacaacatagccttaaataatttttttacaatttaataaattaatatcaatttttgtattttcgcctcagatgatcatttttaataattttgagaaacggaatc

SEQ ID NO: 36749 - DNA, 816 bp, Heterodera glycines
ttctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggagtagcttccctatagcctgtactttaattctgcgttggatttttgctccccataaatgtttgagtaccccaaatggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggatatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtgcgttagcgttcgattgctctagacaatttttaaaaatttttgttgaaatatttgtcg

SEQ ID NO: 36750 - DNA, 1457 bp, Heterodera glycines
  misc_feature (625)..(625): n is a, c, g, or t
tgctccccaatggatttatcgaaactccacagatcaacagtgacactgttcaaattggcactcggatttacgctgtcttcccatttaattgctggcaccatcgccgtctccccaattgggcaccgttgcaacagccaattatacgcatttaagtcgaattcgtcgatctcctgtttcagtgtcagcttttctttcgtccgttcattcaccaattcaaatggttcaattggcattggttccacaagaaaataaagttgaattgtgtaactgacagaagtggtggcacggcgaaatgtctaaaaaaatttttgaaaatctgcccacagataacacacaagtacccgaaaaaatttctaagaattttcaattaaaatttagaatttttagataaaaaatcttaatggattttctagcctagaaaaactttttaaaacacttaaattttcaaaaaatttaagaaactttaaaaaatcagctgtaagaattagtaaaaaaacatagagaatttttttaaagtttttctaggctagaaaatccattttagatttttttatctaaaaatactaagttttagttgaaaattcttagaaaaatttttttttgtacgagttgccattgatccaancaaagagattaataaaaaaatatggcgggccacctctttgaagttgttgacccattcgagattctgtggaccaaaataattatagcgatacaatcgcttcggttgcccattttttgtcggagtgtgaagccatttggtcaacgcttgatcagcaattccatttggcccatcgtcagcaattccatcggggcacagataaccgcaatcgattgaaatcaattgatcaagatcagtgagaagtgtcggcgaagtgcgacgaagcaaattgtccaaatgattgccatcttcgaagcccaactggcgaatgtttgtcgcaaaaatgggccaaatttgacggacaaaaacatcccaaattggctggacatcagttgggttgtctgaaggcacatccaaatccaatttggtgcctcttctgtcccaaattggcttgtttgaacggataaatgtgagcacagaatggtcaatgtagctgaaaagggggaacaatgaagacgacgaccaaccatattaattggtttctgtatagtttttgatttacttaatccgaagctccttaaagcgaattttgctgggcagcgaatggtccggcagaggaaaatccacaaatttgtcatcgatctgtacagacagtttcggttttggtcctttgtccttgcgaattgcgattgctttccaaattgtcaattcgctttttccatcaaaatgcgtgtcaaccaaaacatcgaaacggtcggaaagcaatgccattttgagtccgagttgggcatggtcaaaagatgggaaaatgtccatccacacgacggtacaaatccaactgaaacatggaaaaaat

SEQ ID NO: 36751 - DNA, 1262 bp, Heterodera glycines
  misc_feature (1117)..(1117): n is a, c, g, or t
  misc_feature (1153)..(1153): n is a, c, g, or t
ttgtctaatctcgaagcaatagtttaagaagcagcttctacacatgttaagcttccgaatgataccaagattttttggcaataaaaaattataattcaaaaattttggctggcgccgaaacgagccctacacttttgagcagatgctcaccaaaccccattaaataagtaatgcgtttcattcttcttttatagaaccctctattaactgtttcatcattttatgcgtaggttttgtcccaatcacaaggtgaacaaacaaattaaagctttcgttaatgaatttgttttatgatttcataattgttgggctttttggttggcaaatttcatttcattgcttcaaatgtgaaaaaacaaaacccttcaaaattaggaacggctctgaatgtgtttcagctataatttgaatgggtcttgctgctcgagagtctcgctagcttaactcctgactcgagaaaagtgtctgtttcagggtctctagcagcgtgaaaaatgctgggaaaattgtaaaatttgtgaatgtttttatatttaaagtatcgattttgtaggccataatttttttaaatataaagaaattttttgtagtttgacaataaaacaataaacatattatagagttatcggaagataaaaaaatacgtaaataaaatattatcgctaatctattacttattaatatcactaaatttcagcgaactttttgtaaatttataaaggcgaaaaagcggcgcctgcggcgcgaaaagtgaatgaatttctcggcgcggatgtgatctctcctcgtcaagcgcaaaaatggttccaacaattccgggcggggagaaacagcaccaaacgcaaacttgggtctggaaggccgtcgacagtggacaaaaacgttttggcacaacggttgcgacgacacccggaaagttcctgcgcagaattgtcggtggggcattgccataaaacaacaacatggcgctggcttcggaaatctggtcgtcggccgatgatgagcaaatgggtggcacaccgtctgactgatcagcagaaatgtctttcaaacatcgcaagacacccggagaggttatatgctgaaccggctggtgacatgcgacgaaagctacatnctgttacgatggcacagcacagaaaaatttgtttgnagaaagaaggaggaagacccaattttggtcccccgacccaacctgcacaaaaaaaccgcatggtgtgtatctttttggtcagtacatggcccactgtactgggaactgc

SEQ ID NO: 36752 - DNA, 954 bp, Heterodera glycines
tttgaaacgaaacactgggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaattttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaacagtaaaaacgctcctattcatgcactaggcgctg

SEQ ID NO: 36753 - DNA, 730 bp, Heterodera glycines
ttcctggatttttgtccaggaaatccaggtccaggcattctttaaatgtcgagctctagtttttagtagtatattcgcttgaaaaaattatgcaattattttatcaaaatctctttttgtcatttttcattattttagaacattttgggaaaaggagtgactatttacacgttttttacagcgcgattttttcaaaaactttttgggaacttggaggagggtacggcggtgccgataggcgccgccgggaaaatttcacaaattttgaatgaaatttgcgatgaaaaatgagttaactttaattcaatttattatttaatttatttaaaaatatttggcattctgtcttagaaaaattttcaaaaaaatcaataaaatcccgcataatcccgcacaaaaaatcaaatttgcggatcccgctgcgggattggaactcaaaattctttgcgggacgggatcccgcgggattaatcccgcaaatcccgcaatcccgcaaatcccgcattttccaaaaaatgcgggattgcggactgggatcccgcaaaatcccgcgcgggatcccgacccgcgccgggctctattcggaggtgtagaaaggcctctccgagcaatcatcatacatttgaaagtaataaaaacatttactttattagttgatttttgtttttaattttcggtcttttcttaatgatttttattcgtataattgatcaattataattatttttaa

SEQ ID NO: 36754 - DNA, 929 bp, Heterodera glycines
  misc_feature (850)..(850): n is a, c, g, or t
  misc_feature (865)..(865): n is a, c, g, or t
tgggtttaactccgcttggagatgcgttagaaaagaaagaaaaatatgttcggacagcttttgaagagctgcattgaatgctgcagtcgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaaagtgatcggggtacaaaaatacgggtccaaaagtgggtttaactccgcttggagatgcgttagaaaagaaagaaaaatatgttcggacagcttttgaagagctgcattgaatgctgcagtcgccgctgctgtacgcccacgcgttgctgagttagggtcgagagcggcatgaaaaaagacaaaaaggaggaaaatgaaacaaattcgcggctttgctctcgcgttggagaaagcaatgcgcagaataactggggagacttagggttagcgcatcaattatttttttcagaatgtgatcggggtacaaaaaatacgggtccaaaagtgggtgtaactccgcttggagatgcgttagaaaagaaagaaaaatatgttcggacagcttttgaagagctgcattgaatgctgcagtcgccgctgctgtacgcccacgcgttgctgagttagggtcgagagcggcatgaaaaaagacaaaaaggaggaaaatgaaacaaattcgcggctttgctctcgcgttggagaaagcaatgcgcagaataactggggagacttaaggttagcgcatcaattattttttcagaatgtgatcggngtacaaaaatacggntcaaaaatgggtgtaatccgcttggagatgcgtagaaaagaagaaaaatatgttcgacagcttt

SEQ ID NO: 36755 - DNA, 1150 bp, Heterodera glycines
tcttacctaataaattggtacactgacccaaaagtcctttttttacctatcatgtaatttataacattttcgagcaaatgtcttttattattattattattattattattagtccactgatcagcttcacaaaaccttgagttcagtatgaaaggagtaatagagagtaaaatttctcgaaaattcttcaaattctttaaatttaagataaaaagctctaaaatagctaaatatgatatgaaaaaaattacagtagaaaaaaatacaaataaagctaaaatttattaatttttaagaaaagtgagtaaaaatcttaaattagatagtcaatctctgttgacgtgtttcggcatttttttgttcagaccagtaaaaagtatgccttttgctatattactcaaattatacatgccttaaaatttgattgtaaaagttagtctttgactagcccgatggagaaaatgagttaggtattccatttcggttccttccccaccccactgcccccccccctccctctacgctcatcatcacttcagtcccatcccttcttcatcaatcattcttccatccctttccttcccttcccttcttccaaggccttccctcatcctcctccgttcatcccttcgtcctctaagggtctttcttcaggtaattgccctgtggggcttccgactttgcctcaagccattttcccttttccattacaatcaccgcgaaattgctgccacaacaaaataacgaagttcgttcgttcgttcgttcgttcgttcgtttattctttcgtcgcgcctttccccgtctctttcttttctctttttcattgtcaatgtttgttctaaaatatatgcagcagcacatttttacctcattttctgctccttcatttttcaatttgccgtttttagtcgtcgtttaaagtgacaaagtgtgttaattaaagggttaaagaatgtgcactaacaaatgggacttataaatgagcgtttgtacatttcacatttactggactgatggtttactgtaaaataaactatatatttattaattagggaaatgactcaaatttctttggcaattaatacgcaaaataaaaaagggtattaagtattaagaagaaacaaaaacacaggatggatatgttgtt

SEQ ID NO: 36756 - DNA, 1155 bp, Heterodera glycines
ttgggaaaaaaatggcacaaataaatatgtaaaaaaaaacattgaattttagttggtgttaccgagaaattttttgctacgatggggaaaatggagatagtaaaaattttatcgaaagaaattcttttgaaggaattttattttattttttccgctaggaaaagctctacttccaactgtaagaaaacattcaaaaaaaaattgtttcattgattttttttagtaaaattttttcgaattaggctaggtgactaaaattttttgatttatttgttaccgttttataatggaaggaccaaaagtcggacggagtgatcagtttggaggccaccaaatgcttgtacatgtccaacaaatgcgcattttgttgcagaatttgctgcttggcctcccgctcgcgctccgagccgcccttggccgactgttgggccatcttcaaaaaaaaaatttttttttaatccatgaaaaaatccattaatttgtcatgggttcactgctggaaattcttagtttttctttgttattgccattccctttcgtaatttttaaactccgaaaaaaaatttggaaaaataattttcataaataacagattgcgtaaggattaaattttatttattttaggttcatctactatttttcggtaaatttcctatttgaatcccaagaaaaccagacaaaatcgaaataatgaaccgagtcacacttttctggtccatggaatttagttggattttggattttttttaggtctcttccccagtcaatggaatttatattttcgtgatttttcctttaagatgactatcaaatttttagtggatttctccatggatcactcggttgatttaccaatttttcagcgaattctcaaattatgaatacaaaatgcggtataaaaaattttcagacataccagtccaaaaatttacaaattttgctgtccatggctccgacaattcccccccccccaaaaaaaaatataaaaatgaatgaatatgcctggttgacaagctgacgatgtcgaaccaacgcctgctgcagcatttccttgaccaggtcccgctcggccaccaactgctcctgactgtgtgccgggttcatgaacacaaatgttgcctggtcatcgttgaacatgcacagctgcagttgcac

SEQ ID NO: 36757 - DNA, 299 bp, Heterodera glycines
  misc_feature (163)..(163): n is a, c, g, or t
  misc_feature (181)..(181): n is a, c, g, or t
aaaaagaaaaaaaaaacaccaatgggagggaaaagcaattaaaataaaaaaaaccatttcaaaataattgaatataagttttatattaacgtatttgctgtattagaaccccccttttgaggggggttgaaaaatagggtactaatgtggtttgggtcccggnttttggtcaaatttttcnaaagcgtagccagacagtcagacagtgcactatttccttctttatttttctcacctcttcccttttcccacacacaatgctgccaggcagcccatggctgcttactgtctacccttcc

SEQ ID NO: 36758 - DNA, 932 bp, Heterodera glycines
atcataggtaaattaacatggtcttcgaacgcgccagcttttgcgggctaggcgagtgagccttggccaaatttctgccggagatgtcgtcgttgacccgcttgaccgaagcctccagcggcgtcgtaccaggctttccggttttgttgacgccatgcgctttcgctcctccttcaccgccttcgcattgttgatgcgcattgccatttcggtggcttttgcctgaagttcgttgcgagcagaagacattatgaagaaaaaatttgctaaatttgtttggtaaattagaaaaaaaatttcaaaaaaatattaaagcaaaattgataaacaaataagtgttaactgaaaagcaaaatgagaatttgtcacatttttggtactatttatatttaattagtccctcctccccttttcattggatgctccttttttgcctacggcaattgatccttgccgctcagctaattttgccgaccaaatttaaaaattttttttaattaatacttttttgccttttttgattttttttgttagttttagaattaaaatagtttgttgctttttgtaaaagtttgaaaacataaaaatatatttaaatataattttattaaatcattcgaaatctttattttttctcttataattgtacttttgcattttgttaatccccttccattttttgaattctgcaagtttcttcttatactaatcccttgccgctcagctaatttagacgaccaaattcaaaattttgttttgttaatccttaaatgattcttcattttgttggtttgccattattctgtcatttaacaattttgccgttcttcataatatatgccaatcatttttacattttgaaaatttttatttaatttttttcttttcgataattccatttattttaacttaacttgaaatgtttttcatgt

SEQ ID NO: 36759 - DNA, 1311 bp, Heterodera glycines
cattgaattgaaatgacaaaattaaaatatttacctactatgtgaagttatctttttctcgaaaagattaaattaatttttttcattggttttatattatttcggattactaaattccttaatttttacacttaattttattcgccaaacaaatttaggaaaatagattattatttttaatactttcgtacacattatttaagacaaaaagatttttaatttaagcatttataatttgtttttttatcggatcaccatactattaatatgctaaaaatgaataaaaactaagtattgtttcaatacccgtaaaatgaatatttttgaaatctctttagtggaataaatatgagtttccaatataaaaaattatttttattcaaattttaccaaataattcgagaatttattaacaatataaatttcactttgataatatagacaaataaaggtaaatatttgctataaaagaggattttttattttatcaattacttatttatttaataatagtttatttaggtaaaatacaacaaactattatataatttaatgcgaatcctaagctttaaatttattaattgagtttttaacttgtaagttaaatttaaataaattatttttttatataaatttatgcgtagaattttttatatttattaatatgtttgggttactttttttatctttaatattattaacaataaattttttaataattaaaattaataactttcaaaattagcacaatataaataatatcattattaattctttaaagtaaatgtttattttccattttttacagttttgtctcaaaagtttctatagcatcgaacagcgcatttttttgttcaagcagttttacaatataacgaaattttctcccgacatccatttgtcattatttttttggcaaaatgagcctcaatttttcaattacttaaatcttttgattttaaaaataatattccaaattgcaattgtcgtttttaaaatcattgatttaacaagattttattgattgattgggatttaattaggcaattaaaccaataacacagcagaatatttgagttagatgcaatcaaattgtaaactcattaactgatcattttccgacaattactacagtgacatttgtcatcattacttttttcttttattctaattggtcgattatctaatcttatattaatttattcaattatcaaaatttttataatattaggaatattaacaaattaattaattaaaattcaaatgaattattaaaggttcaaaatcccatttggggggaatttttaaaaa

SEQ ID NO: 36760 - DNA, 884 bp, Heterodera glycines
gatttttgctccccataattgtttgagtaccccaaacggacactagaaaaaaatcgatttttttgttttcggggcagtccccccgcaccgatgcgcccagattttatggggagaccgaattccttcgggaatagcttccctatagcctgtactttaattctgcgttggatttttgctccccataaatgattgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatgatgtaaataaaatttggtgcgtttcagaaccctttctgaaaaaatatttaagaattaattttgcaaaaaataaataaaaacgaaagactcagattttcgaaaaattttttagagcaagctagctcggcgctcatttcagtgtaagttagtcctttaccggggagtatccctgcaaagtttggtatgcttctgctcaattagcaaaaaatatgagtgatcaaactttcactaaaaagttaagcctaaattttttggcatatttaaaaagcaattaaaaactttttaaaattttattcacctcccattattgatagaaaaatcagctgtagaacctcattaactggt

SEQ ID NO: 36761 - DNA, 1589 bp, Heterodera glycines
ataaataatttatgtaataaaataaaaatggtgaaaataccaaatattcaaagcacttttggcgttgactacggaaacactcgaattggtaggaaacaggaccaattggagtccgcttcacattggcaaataggcagactaatggcacaaaattgatcagctcgctgttcaattcagccggcaggcgtcgacgaagtttgggctttttctcactcattggaaggttcaaaggattagggcgtttcattttaaagaatttgaataaagaatgatttcgatttcttgctgggaatcatttggtggtgcgcaagtgggcgtggcctaagtgtgcatatcgtacacccggtcattttctagattcattttaaaaattttcatcttttttttgcacatctggtgtttctctctcctcccctcacttgtcttgtgctttatggggaccgtatcatttaattgtgattttggggacggtataattaaattaatatttttgctgttaaccagggcggttgctttaattacaaaaagctccgtttatcctggcagcaatttgccttttagggcttgaggtctttcgcttgacttgactaatttcccgagtcgtttaggtgccctgtcgtcttgtgcttcatgggtggcggtgtgctgctcttcaggccatagtttgtttatgtttttttttttgactattttccatgcccaaatatttattattcattcaccatttcacgccatttccatgccggcgatcgcatataaataccgagattttactcattcctcctcactccactctcagattaaaaaatggaaccccgaaaacgatcctctaacttttccattgatcatattctctccgcgcccaaaaagccccgtcaaggcttcctgatcaatgaactcttgggtgtcgtacacttccttggatcggtgcagcaaggcgaaggaacatcaaaagaggcaaaggactacgttaaaaaattggacaacagcatcgagcacatggccaaattccactacgtcaaagtcaagtcaaagttcaccattacggatttgccgagcacacctgaggcactgttggctgggattttccaacactgcatcgacgaagcaattgttgaaagccgtgagcgcaacatcgaacctacacacctcggctgtatgatcagcagtcctatgttggaaggcggagatatcccaatcccgatacgacaaatgacaaacaacactctcgacaccattctcaaccagttcaaaaaagtggcgcagtccaaacaacagaaaaatgtatcgttatggggtgagccgtttaccgtcaccatcacgactctcgaccgtaatggactaccatccaaacgtcgtgtcaaagggggagctcgtcgccctgtcaaaacggccgttcaccaccgaattaatgaccaatgcctgattaaaattcgtaataacgacaaccacttctgccttttctacgcgctgcaggcaacaatggtcgacaaaacatgcaattggacacgatggaagtttttggactacttgcacgacagacacgaaaagcagggacaactccatcatgatactgttaagctccatgc

SEQ ID NO: 36762 - DNA, 1634 bp, Heterodera glycines
tagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaatattgaaaattttgaaatcatgtttcccactcccttctcccaggggtattattttgtaaagtctttttttcaaaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgttttccactcccttctcccaggggtattattttgtaaagtctttttttccccaataaacttgtcaaaccccatttttcgcaccgggaatgttatttttattgaattctgaaccgttttgagtagattagactaaaaaaatatgagtgatcaaactttcactaaaaagttaagcctaaactttttcccaaagttaaaaagcaattaaaattttattcacctccattattgatagaaaaagcatcagagtgcctaaactaacatgtaaataaaatttggtgcgtttcagaaccctttctgaaaaaatatttatgaattaattttgcaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttaataattttcctgcaccgaaggtactcactcggcctcttcgcggcctcgtggtgggccttcgcccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagt

SEQ ID NO: 36763 - DNA, 1581 bp, Heterodera glycines
  misc_feature (1536)..(1536): n is a, c, g, or t
tttcctttttattagcactttggcttgccgaagcaatattttcatttatatttttatttgtttcactgtttcctgccccgtttccttccataagacccgtgcattccccttctattttgcttgccgaagcaactgattttacaccgaattcattagtacaagtttccctagaaagattcctagtttgatcttcgttttggcttgccgaagcaattattcttccctggcttgcctcctcctcttcctcctcaaatgtcagcatttcgagcagatgtaattcgtttgtgtcagtcaaactcgtggtaggctgcagcggattgtttgacattcctgaaattgattttgtgttattaatgatgatttttatgtgcatttattttaattaaatattaataattaaaatgataaagtattatttataattttcactaggaccctattcccttttatttctgagaatgatattctgagaactctatcccttacaaacttataaatttttactaatttacatatataagcagagaagaaaaaacaaaacaaaatatagataacatggaagaaatgagaaaaaaaatgcaaaataaggccgaaatatggacaaaatagttgaaattcacaaaaaaaaaagaaaatatgtaaaaaaaaaaaaattttttttttttaattttcggaaggaaaaaaaaaattcaaagaccaaaaaaaaaaattttcaatgaagatgcttatttaatacatgaattatagaatgacataattttaatctataattattgtgtttaaagatgaaaagaaaaaaaaatatatttacataaatttaaaacttttgttaaaaattcattttttaaaggaattttgaagtgaaagagaaaacattttttacatttaatatggttttccaaaattttcaattaaggtcgtattttacaaaaacaaacaacaaaaattcttgagcggtgtctttttgagattttgtgaaaatgccttaaaatgaatatacaatatggaaatagtgacaaaaatctaaaacatggaaaggaaaaaaaaattcatgaataaagctcaaaatattattttgtgtttaggtcaaagtgtttaaaaaaaataggagtcaaaataaatccgatgcctaatcatagaattcattgttttgcctaagattttggttagcgacatttactgctcgccaagcttttctaaccgaagtactattttttttagcctaatatttctcatcattaaaattcattaactttttttggatataaggtggtcaatgaggaagatttgatatttagcgcattttggaaagccatatttgataggacaaaggtgtaccgaagtaaaaaaaaagattgaaaaaaacttggaaactaaatccatataaactatttctcagataagcattaaaaattatggaatatcctaatgatctctacggtacagtattgccttaactccattgtggaacacaatcttgtttaagtggaatattaaaaaaaacggcaaaatgccaaaaaaggtatttaatgcatngaaatcccgaaaaaggcaaaaaaaaaaaaagacataataaagtca

SEQ ID NO: 36764 - DNA, 1066 bp, Heterodera glycines
  misc_feature (1041)..(1041): n is a, c, g, or t
tagcaatgatgcacgtggtcctgggaaattcctcaggaattaaatccctgaatttcttctattttcttatcactcacaaatcactgtggggaaaattaagatgattctgatgattagcgttcttgttcgattttggcgctaatgcgatatttattctcatggttcttggaaagtaatcaggaagtatttcgatttttgtaaataaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaatgccattaaggcaccgttgtagcaatgatgcacgtggtccttgtaaattcctcaggaattaatccctgaatttcttctattttcttatcactcacaaatcactgggggaaaattaagatgattctgatgattagcgttcttgttcgattttggcgctagtgcgatatttattctcatggttcttggaaagtaatcaggaagtatttcgatttttgtaaataaaccatcagctgatataaagaaaagcattgttgtctgtccttttccaattatattgccatttcggcatcggtctaacaaagctgcgcatggctttgggaaattcctcaagaattaattttcgttgtctaaagaaatgcactagtgtcgggcattttgacattaaaatgccattaaggcaccgttgtagcaatgatgcacgtggtccttggaaattcctctggaattaatccctgaatttcttctattttcttatcactcacaaatcactgggggaaaattaagatgatactgatgattagcgttcttgttcgattttggcgctagtgcgatatttattctcatggttcttggaaagtactaaggaagtatttcgatttttgtaaataaaccatcagctgatataaagcaaagcattgttgtctgtccttttccattatattgccatttcngcatcggtctaacaagctgcgcatg

SEQ ID NO: 36765 - DNA, 932 bp, Heterodera glycines
aaaatattttcccattgaaaatttttaatacttaaattaggggaccgaaaattaattaaatttttcaaaaattttttttttacgaattttgcgcctccgccctttgccggcacacttcgttcagtgcccgcatttttgccatttcctcgtcctgctcgtcgtcgtcgttggcgcttctgctgctgcttcttcggcttatgtcgttgaaatactgtgctgggccctctagacaatcctccaattcctcatacactatgcaccgcgcgagcggtgtcggatatcgatcaccgaggtggtgtcgattttactggtgatgagcaccggcgggagcagtgatttgaggacccgcgccggcgacgacaccgccaccattggcactagcggcgagcgactgacgacgacggcacggagaggagttgccggcggaggaagaggacagtgtgccatggctggacgaacagcgcgtgtttggctgtgaatgttgttgttgctgatcggtggccattgccgatgaagacagaggcggggcaggggacggacccgcggttggacacgaagacgaagcagtgccggtagaacaaccgccggtaccggcactatttgcgccaccaccgcccattgtcgagcaggcagccaacaggtgggcgtagctgttcagcccgagcagtgcttcgttagcggatgcgcggcgctcctctgtgaagaagaaaactttttttttaaatcccaaacttagaaatttttcgaaaaaagcagaaactataagaaaatttagcgattttgtggaaaatattttaaaaaacttaagaattcttcataaaattttgaaaaatagctagaaaacatttcagaattttttttcttaaaactttcataaaaaaactgggctctcggacggatcgtaaccaagtttcgatctataacttttctct

SEQ ID NO: 36766 - DNA, 1336 bp, Heterodera glycines
gtaaattttgatggattaaaaatacagcaaaattcaattttaataatataattcaaattaagaggaaaatttaaattgattaaatcacaaaattagattggtatacaccaaaaaaatacagtattggacaaaaaaatttatattatattttttttctcaaacttcaactaagagaaaaaaagttcaaacaattttcacaattggcaaatgttttggtggaaaaaaatgaaagtggcaattacagtagtaatacgatgagatcgatcatttcttcgttgttaatgtaacccaaaaaatggataaattgaatttttttaaaacttaggaggctggataatattctggaaatttagggtttaccatattttcgagtgtaattttgaggaatttcatgaaaataaatgcaagactggcacaaatttgtcgtttataaaatttttttatctttatcttattctttttctttgacaattttgaaaattaattaaagcttatttgtatgcggggtggtatataagaggtggcatttcgaattccgaggccccgaaatttccgtaaatcgaaatccggtgacaaaaattttctataaattgatcattggaatccgaggccccaaaatttccgtaaatcgaaatcctgttccaaaaattttccataaattgtaattggaatccgaggcccccaaatttccgtaaatcgaaatcccgttccaaaaattttccataaattgtaattggaatccgaggcccccaaatttccgtaaatcgaaatctggtgccaaaaatttccataaattgttcattggaatccgaggccccaaaatttccgtaaatctaaatcctgttccaaaaattttccataaattgatcattggaatcccaggcccccaaatttccgtaaatcgaaatcctgttccaaaaattttccataaattgatcattggaatccgcggccccaaaatttccgttaatcgaaatctggtgccaaaaatttccataaattgatcattggaatccgaagtccccaaaatttccgtaaatcgaaatccggagccaaaaagtttccataaattgatcattggaatccgaggccccgaaatttccgtaaatcgaaatccggtgccaaaaagtttccataaattgatcattggaatccgaggcccccaaatttccgtatcctgagccaaaaattttccataatttgatcattggaatcccgaggccccgaaatttccgaaaatcgaaaaccgatgccacaaattttcccataaattgtaaatggaatccgaaggtcccaaaaattcccgaaatccgaaatccgatgcccaaaatttttc

SEQ ID NO: 36767 - DNA, 1300 bp, Heterodera glycines
  misc_feature (1184)..(1184): n is a, c, g, or t
atgaaaaattttctcaaaaattcatctccaaaatttatttatttattgacaagaatttgtgattatttatctcaatactggtttgacttaattttgtacccttttttgataaaattttacgatattataccccaaaatttgaatgtttttagcaactattttcccatttttagcatctattttggggttattttttgaaactaaaaattaactaagtattttggcagtttttagcaactataaatcgtagcacttgttatggcactgcttaaggttgttcagacgcagttggccatactcattaggcccgctttgcgcatcactccctttttatttataaatatattttatttttgaaagtttaccgtcgttactctgctgatcagaaacttcattactactgctactgctgctactttcttcctcttcttcttcttcctcttcttcttcgttttctttatggctttttgttttcttttcttttttcaaaatcattttttttccaactttctttaagccttcttcaattttcttcgtcttttcgtccgttttttctcttgaagtcgtcgacttttgtttatttaaagaagtcaacttttttgatgagttttttgctggcggatcggacaagtccaactggcaattaggtgccattaattttaattgatagtaacaactatctccagagtttacacacatttaaaaaaaagaaatggaatacgttggatttatagaaaaatggaaacccaaaattaacaaatttttactggaaattttgatttttatttcttttttattcttaataaatatttataaatgtatttttttttattataacataaagaaaacatatcaattacaaaaccaattcgctgagcgccttactttttctccattaaatatgtgttgtttaacgttgattaattgtgcttttgctttttcatccgtgttgtttttagcataaattgacacccattggctgacctatgaaaaaagtttataattttattttattaaaagtttttacgtatgaaacaataaatattgacaaatttattttctattatattagcctttatttacgaaatgattaattaattatttatgcatatctaattaataaatatgcttaaaatggaatttttttaaaatttatcccgaaaacagaaaaattttaaaaattncatctcccgttgtttttggcgaaattttgatttttgaaaattttacacatttctaataaaaaaaatttacaatttttattagtaaatttaaaatttgtttgtttataaaaaccttc

SEQ ID NO: 36768 - DNA, 971 bp, Heterodera glycines
aattaatcggaggaatgtttgctttcgcattttgttcaccaatggcgttactgactgtctccagttggcgctgatgctcatatttgccatactcaatctgatcaccaatcacatcccaatttggttccaaatggtattgcctctcaaatttatttgaattgtttaaaaatgaattaaataaataagaataagattaatgataatttgtgcggtattggcaagtggaattttcagttttttgcttcaatttcggtgtgtgtttggcctcttttttaaaatgtatttaatcatgataaaaattcaattattaaacatttaaaatttcaaaaaataaattttaagaaaatttttaattttttaatttaaaaaataaagcaaaatattttttaaaaatgtccctaataaaaaatatctttccactataaattatttatttttatatttttttaataaagttttgtggtagcattgtgatcaatgcctggaatttactggtcatgcaacatttattattggcaattaaccgcctaattgtaattatgcgagcgcgatttcttggctcatccttttttaagcttgaggaggaaacggaggcgaaactgttcaatgttggcactattttaataacaaaataatataaataaaattataagttttgtttttagatatttgccaaataattttcgtgattttcattgactttattaagtaaaattcataaaatattttgtttaattttacatcatttcgatcatctttttttgttaaaaattaaattaaagaaaaataataattaaaagaaaaaaaattaaaaaattttttttctttaaaaaaaagaaaagaaaaaattttaaccaaaaagttaaaaaaggaaaaaagaaatcaaataaatttttggaaagaataaaaaataaaaaaatcactttcttaaaaaataaaccagaaaaatttaaaccttccaaggaaataat

SEQ ID NO: 36769 - DNA, 396 bp, Heterodera glycines
atgctggtgggttgagtgccagtgattgaaatgaattgagtgccagtgattgaaatgctggtgggttgagtgccagtgattgaaatgcagaattgagtcccagtgattagaatgctggtgggttgagtgccagtgattgaaatgcagaattgagtcccagtgattgaaatgctggtgggttgactcccggcgattggagaaaaagccaagaaaaggatgcgaggccgcgaagcggccgagccagtcgattttatcattcataatcctataatacaatcgtactacctagcgggggatgcgccgaatgcactgaccccaatagtaaaacatatgtgcctatgaatggatttatacaataattaaattaatttagaataatgctttttttttcaattg

SEQ ID NO: 36770 - DNA, 1130 bp, Heterodera glycines
acagggaatttttacatttattctctatgacagaaatatggctatctctttttgcgagaattttgtaccatacagatgttcacagcatgggcagaggggcgcggagagcaatggacattctattctacagggaatttataaatatattctctatgccagaaatatggctctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggctattctattctacagggaatttttaaatttattctctatgccagaaaaatggctactcttttttgcgagaaattaaatgttcccagcatgggcagaggggcgcggagagcaatgtccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctctcttttttgcgagaaattttgtaccatacaaatgttcccagcgtgggcagaggggcgcggagagcaatggccattctattctacagggaatttttaaatttattctctatgccagaaaaatggctatctcttttttgcgagaaattttgtaccatacaaatgttcccagcatgagcagaggggcgcggagagcaatggccattctattctacagggaatttttaaatttattctctatgccagaaaaatggctatctcttttttgcgagaaatttttcccagcatgagcagaggggcgcggagagcagtggccattctattctacagggaattt

SEQ ID NO: 36771 - DNA, 786 bp, Heterodera glycines
cgttcatcccgggtgcatatgctgtacattcggatgaagattaccacccaccttgtgatcgctttgtgactcggtaaaagaaaaagcaaatttctgtccggaatgaaaagttcgaactcggcggcgctgctgtcgacaccatgaccactaactttctcattgtccttcaaactcttgactcaaaatcttcaaataaaggtgcccagacatcaattctgtccgagagttgtgctcgacgctgtgacattttgaaatacgtggaccgccgttaccgagtgcaggcccatgggattggcgggtcgcaaaagatggtagggaggtatgttaacggtccctgaacatcccaaagggagtaagaatattaatggttgggtagttttccagaatcttcgcctgtcaagtgcaggtcgatgacaatgtttttgcgtgtccctttgaagtgatgagcgacagagacgtcgacattttgtgagacgacaataattaaatctttttgctctttcccctgaaattccattatcgaaaggttcggcctgaacgcaatgcttcgccaccgttgcaacatcgacctcaagaaaatggtccttcgctttggggacggcacggagacgcctttcctcagtgagcaggaagtcgagcgggagaaagaagcgattgcaatggcccaagtgatggacgaagaattcgcgaagtgatgaaaagggtgatgatcgcatactgttgactagagcccggtcgggaccgggattttgccgggactcccggtcccggttttttggacaaaca

SEQ ID NO: 36772 - DNA, 921 bp, Heterodera glycines
aattacagagaatacatgaaaagattaaacataattaaattattattatgtaaattagctatgctgttgaaaaaaaagtgtgcgaaaaattaacgtgtaaataccggggcgcaaatgtgggagacgcaaaagtggaggcgctaatgtggggggcgcaaatgtgggaggcgcaaaagtggaggcgctaatgtggggggcgcaaatgtgggaggcgcaaaagtggaggcgctaatgtggggggcgcaatgttggaagcgcaaaagtggaggcgctaatgtggggggcgcaaatgttggaagcgcaaatgtggaggcgcaaatgggggagttccaatttttcaattttttaaaataaatttaacaatataataacaaatgtttattaattttttttaatttacaaatatttttgtaaaattaataaaaaataatagcaaaaatttttgcatcaaatgaaaaaaaccgggaattggagacaaataattagtcctaatagtactgtaaggcatcattggctcagccaatcagagggagggaccgagggaccaccccttcccatctctcccaatgcaaataaaagtaaataaataaatttaagagaacatgtgttgaagataaaactaaaagctaatgaaaataaaattattattggaaaagaactcaaaatattaaaaaaatggttgttgaaattaacattaatttaatcttacaaattttaataggctgaaaaggtcatttacatgagtgataagataaacaacaaaaaataaaaataaagaaataaaaaagtaaaataacaaatagaacaaatagaacaagaatagctaaaaagatattaattaataaatagaataaaatttatacactgcaaaaactttcaaaatgataaacttttttaattcttttaaaataaaatattact

SEQ ID NO: 36773 - DNA, 1008 bp, Heterodera glycines
cagtgcacagcaaagcagtgtctgaagtgacgaatttggttagccaatcattaggcaatggcagtcacggcattagtgtcagcccccttcgggaataaaattttcacgttctctctccgatcactctcttcccccttaccccttgcctctctgaccgatcacttttttccccacattactacaccctcagattaatccattaccccctctaccccattcgcgcctatccgatcacccgctcactctctttcctttccctctatctccgatcattattttaccgcgttacttccctttcctctctcattccttaccccttctacaccattctcgcccattcgatcactctcttccctttctaccctctcccatccgatcagtctctcccccttccctctctctctccgatcactctcttccccttaccccttccctctctccccgaccaccgattacttcttcccttgtgtccacctttgcttcatcttcgcacggatatctgctcagcttttcctgtgaggttgaaataggctctgatgcattgcgcagtccctcaacaatatttctgattgtgatcaattgaaatgagtttcggcgcggaatttgcggcggatggcactgactcgccaacggagtctgacccgccggtgccgtggcggagggactttggggaagaagcaattgcgaagggggagaaaaagacggtggcggaggaagctctgcttaatgatccggtcaattgggaaggaaaattgagtaatatgaatccaattaaggcaaaaacaggtctatgtttttggagccgtaataatcgacgaattgtacctgacatgccttgcaggttttgtgcgtggatgcaattcccaggacgaactagacttctaatggtgcgtaaagaatttgtaccaacagaacaccgaatggctgagagaacaatttgcgcttcccccactacggcagttcgttcagtacgcttagacatttgctgccgcacggtaatgacgacgg

SEQ ID NO: 36774 - DNA, 657 bp, Heterodera glycines
gggattcgtccgatgttttggagattgcaagtcaggtagaaaccagcttgcagagactccaacacaagcaattagcctgatcggtttatggtcagcgacaaatcggaaatccgtagaccgacaaatgaaatcgatagagaaaggagccactgagacaagaggggaagcgggaagcaagagaagcgcaatgtccgagaaagcaaataggagaaggaaacgagacaacgacgccctccccactcgccccccccccccctctccctcattttcggcgagtaattcaccgccccgtgaaaaaagttttattataacatttaattagttagttctttgcccagccgcgcctcgtcccattgattttctccacattttccactttttaaatataatttttattcccaatttcgccaattccccacccaaaaaccattccccccccctccacacacaaacactttcatttctttcccaatttaattttatttatttattatttatgtattttgttaatttttttattaaacaatttttccttttccatcgatttgaattttcattaaagtaaacgcaaaattatttgtttaattatgtattaggtgtttacaaaaatcataaattaccgtttgcttttagcaaaagaaagaattgataatgatg

SEQ ID NO: 36775 - DNA, 1104 bp, Heterodera glycines
aaaggggggataattagagactgggggattatgatagagggattattttttaaaacacctcgtagactgggggataattagagactgcgggattaatagagacttatacggtatacggcggcttttttcaacaaacaaaaaataaatgttggacaaaaagtgccgccgggaaaattttgtaattttcaatgcgattgttagatttaaaaaggtaattttgagtgattttggaaaaagttcgcgaaatttttagggaattttggtgaggtaggtaggtctcttggaggggataccagaaaatccaagaattttcagcgcaaaaaaaaaacaacaactatggtttcctttaatttcggctgtggatggcgttttggacctgctccgcgctacgcccttgcgcctgcccatgcccacttcagcactcacttcaaataggcccacacatggccaaccccgggcaccacatgcacttgcgcgtcgccgttccacaacgcccgggcattcggcacgtgcgcgttgtgcggcacgtactcgtcatgttccgccacaacaaagcgcattgcgcccgcaccggtaggcggtgtcgggtaatggcacagattggtgaactcatccatcagaatccacatcagccgatgggcacgcgagtcggggaacagcttggcggtcacgtggttggcatcgtcctggaatttttaagaattttttaaaatttgaaggggtcaacgaggcctggattgtttgggtttggtagcgtcaacaaatttccaggggaaagaaaggaattcccacccattaaaatgaaaaagttttttaaggaaaaactaagcatttttttgttgttgaaaatttggcatcaattttctaaaaattcgtaaattttcctaaagttaaccaaaatgcacaaaattggtcgaaacaattttttccggccatattgccgttaattcactgttttccaaaaaaatttcggaaattcagtctctttttgttttttggtcgtttagcttctttgaggtgatcagttttttttaatttacaggctaatagtcaaatagttggggagctatcggatgaaaccccaagtggttcaattctgacact

SEQ ID NO: 36776 - DNA, 1053 bp, Heterodera glycines
  misc_feature (1033)..(1033): n is a, c, g, or t
  misc_feature (1041)..(1041): n is a, c, g, or t
ttattttttgctattttatgccttctggcactttaatttcaatcaatcaaattcattcatattgttgtttggcaaacctgcgaatttgccaaacactcactcattcattcatgcgcaaatatgggccaaatttgggcggcgtcaccgtcttggccaatggtttggcataaaagtgcgtctagaaatctaatggaatacgcaaacaaaaacgtgccgaatacaaattcaaaagtgcattaattgtccatgccacacttaaaaatgggtaaatttctctaattttcatgacattttttaaatattttttattcgaaaaaaagaaattagtttaatttttattggtttttgaagatggcacgaaagtgccattgctcttttcaaagttaaactaataccgctctaattagccaattcagtctcattttatgctaattggccaaattctttccaacaaataccttttattaaatatttatttaagaaattaattaatattttttcgcaacatcaccaaacagcagataaaggtgatcaaataaagtgtaatccgtttactcgacaactaaattttgtgctattattatcttgtcattttggccgtgattttttttcaaaaatttaattttaaatttaaattttaaagattcatttttgcatttaaaattttatgcccaaccaaatttggtattcattaaatttttttttttactctttttcgaaagtgtaaaatgcaatttgaaatgaagcatattcccaaagggtcgccacgtccatttttggcacaaaatttggcccttttttcattttaggaaaattaaaacaaaaatttgcattcctctaaacgcttagcatcattgaaatttcaaaaaaaaagcattaccaaaatgacaaaaacaaatttaaacgtaattttttccaaattggcattaagcctaagccgagaaggcgatgatcacattctttttcaattaaattgtttttttgtgacgtgattcgtcctgccattataaaagtaaatttttttccccctctnaatctcantataaaaattct

SEQ ID NO: 36777 - DNA, 1062 bp, Heterodera glycines
agagtgggggctgaacagaaatgcttttactcgggaattggggtgtgaaaaaggaaatcggcattcagcgtcagcaagcgaaaaaccatggaaatttcccaaatcgtaccaatcctggcacaatcctacttactgcactgagatatttaaagtaagcatattcataaatccatatttgggcagccatgcataggcatatttcgcgattgcaataaaaaattaatgacattgtatatggcagtgggcaaaaagcgtggcattgcatatgacagtaggcggggagaggtcggtggaggcagcacaaaatggcaatgaaatgaaatttattcattcatttattgaattaaaatataatttttattaaacaagcataatttatataataattttctaaaaaatatatagaatataatttttattagtataatgatataatacatagataacttttttttaatctgtatgttaaaacttaagatgaattatcatcaatttcttatccaccgctttcccttactgtttctgcttctttttatctgctgcaacaatggggtaaatggtactggtggtgacaaaaagactcgtcgacgtactgttcttcctggtccagcagatcacccaaattttcaaccgaatctggcagcgtcgcagggtcttaaaaaattaaaaatttcaattttcttttttcgtagaaaggttgtgaggcgggccattccatcaggcgtttcgcctggttaaattcttatagatttagttcaaatttgttacagttttaccttaaatttcacagtttgaaaattgattatttaactttgttcattgtagttcctttgcataattactaaagatattgaaaaaaagttaacacaaaaacttaattctaaataaaattatataaaaaaaacagtttaagcttgtttttttaaaggaagtgccaattaattatttttacatggaaatctcggatttttaaagatattttaatttgccaaattcaaacaatttcttagaccaaaaaaagaagtttcgtttgcactcattttggcaatcctaaagaatggg

SEQ ID NO: 36778 - DNA, 901 bp, Heterodera glycines
ccagaaaaaatcactatctctttttttggaatattttactctttagagggagagcatttaagcgactcgctgtgcttgcccactgcatttcaaatagctggtaatatttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctcttttttttggaatattttacgtgtcaaagggtgtgcatttaagcgactcgctgtgcttgcccactgcatttcaaatagctggtaatatttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaatagctggtaatttttatttctccgggctaatccaaaaaaatcaatatctcttttttt

SEQ ID NO: 36779 - DNA, 287 bp, Heterodera glycines
tttattaatgcatgttagatgaaaataaagcatatgacatttaacgcagtaactaagaatacgaaatgaatacgagaaattttttcgagtttttaaaaaattttagtcatttatttaaaagaccaaaataccctctgctacaaaaaaaatgctttaggaaatggctatccaagcacctccgctaaggcgcgtttgtttttaatgagacctttccaaaaatttagtgatcaaggggcagggcgtatctagaaaattttttcgggggggcagggacggtcccagggggg

SEQ ID NO: 36780 - DNA, 950 bp, Heterodera glycines
ctctagagtctcagagacatgttttatggtacctgtaaaaagtgatatataatttaattgaatttccttggtggacccttcaaattttaggggtatgaattgtcttgaaggcactggcaaattagaaattgttgccaaagtttagatcaatttttaaagcatttgttagactttcgaacattttttaaatttccccttataaatcccacccatttccctccacctggtcaatgccgaaaatgaatgtgtcattgtgcgcgaagatagcttcaaaaaacggagaaattagcgaaaaatcgaaaaaagtcgaaaattcactaccaccaccaccaccaacggcaggtccatcgcatggcaaacgaagggcgaccaaaattgccgcatcgccagccttgctcatgatgaggccctggaactgttcggcgatggccaaaagccggatgttgggctgaaaatggaaaaaattatgacagacatttttaaggcgcgagcaaaattaatcaaatcaaatggttttggaacaaaatctgaaaatcagaggtcggtctaaaaactagatccaatcaaaagccgagagtgtcaaacaaaacgaaaccgaaaaacgggattatataattaaagggacgaaaacaacttgaaccctttttacattaactaatccgagggtcacaaaaattgttgaattaataggaatatttttaaatgcatttttaacttgcaaaaacgaaaaaaaaatttttgtttgaagggaaggaatgaaataaaactgaatttatttttttgcaaaataaatacccacccgaatggagagcaccgcgtggtccgccgtccgtgccgttttcaccccgtaaaatttgtgtttgccgtccgccgtgccgaaaacgaagccaaaggcgcgcgcatccgtcgaagtgtcgcgggcaatgaacgaaattttggcgaccggaaaa

SEQ ID NO: 36781 - DNA, 1030 bp, Heterodera glycines
acccaacagcattccaatcactggggactaaacccaacaccattccaatcactgaggactcaattctcctgcatttcaatcactagtgactcaattcatttcaatcactggcactcaacccaccagcatttcaatcactggcactcaacccaccagcatttcaatcactgggactcaacccaccaacatttcaatcactggtactcaacccaacagcattccaatcactgggactaaacccaccagcatttcaatcactggcactcaacccaccagcatttcaatcactgggactcaattctgcatttcaatcactgggactcaacccacctgcatttcaatcactgggactcaacccaccagcatttcaatcactgggactcaatccaccaacatttcaatcactggtactcaacccaacagcattccaatcactgggactaaacccaacagcattccaatcactgggactcaattctcctgcatttcaatcactggaacccaaatcattccaatcactggcactcaacccaccagcatttcaatcactgggactcaacccaccaacatttcaatcactgggactcaacccaacagcatttcaatcactgggactaaacccaacagcattccaatcactgggactcaacccacctgcatttcaatcactgggactcaacccaccagcatttcaatcactggcactcaacccaccagcatttcaatcactggcactcaacccaccagcattccaatcactgggactaaacccactagcatttcaatcactgggactcaacccaccagcatttcaatcactgggactcaacccaccagcatttcaatcactgtgactcaacccacagcatatcaatcactgagactccattctcctgcatatcaatcactgggactcaatccacccacatttcaatcactgggactcaacccaccagcatttcaatcactgggactcaaccccaccacatttcaatcactgggactcaacccaccagcatttcaatcactg

SEQ ID NO: 36782 - DNA, 854 bp, Heterodera glycines
cagagacaaaatgataggataattaatggggaatggatctttcgttaatttaggacatttcgaagtgcggacacttccggttaatgttttgacgagaaaaaagtgatggcttttctttctcgagtctttgagactaaatctagagacagactcctaaattacgtggcatttctggattttagtttcgagattttgggctatttaaatagtcatgcatattttttttaattaaaaaattatttcatgtaatttattaattgtaacaattaatttgtcacattttcctcgacagaaaatacgacgaggcggtcaattgtattcacgaaaaagtgctgtgtttgagctccaacgtttttgaagtgattaccagcggagtggaacatttgtgcaaagggccaaaaaagcaatttgtgaaaaagcataagacatgcttggaaaagaatttggacaaagtgtcgcagggtaatcaattagctaataagaggtcaattagctaatgagggccaaaaagtgagacaattaaatgcagttaatacaacgaaaattaatagacagaaaaacaactaatggaacaaaatagttattatttttaaatatttctattacaaaaatattattaattagcatagcgtatccatattattcaactaggtcatactgtaggttgatggtatttatggtgtcgactgggctggtgttcgtacctttttagattgccattgtgcgttcacattggaatttgaatttaattcctgaaatggccatgatcgattgatcagtttgtcccccccccctcattaaggctgtgatcagaagtgccatttggcgcgttcactcgcccaattctcgcgtcg

SEQ ID NO: 36783 - DNA, 457 bp, Heterodera glycines
aattgttgagatcattcaaattgccagcaacgcaatccgatgggcttttgtacgggatgggaggggccgaatggggaggggggggggggcgttaaattgccttcgggcactactgacagctgcgcgaaaattcgctcaacaattcgattttttttttgctcgatttagctttgctgaggtgtgtttaaacctgttcattcacaccgaattcaactggaattacaggtgttggaacgaacattgaaagcacagagttatttaatttgaaagcacaaagttttttaattgtgggaacaaaacatttttagcattgacaaattgagagaataattgaattataattaaaaagttttaaataaatggcaagcaaaaaaataagtatgtgaaagaagaaaatatggagaaaattgtggcgaaatcttttggatgacagtttaaatgtgaggggagggggaat

SEQ ID NO: 36784 - DNA, 1208 bp, Heterodera glycines
atgggacagcagtaccattcagtggacgggcactggcttcccctttttagcataacagtgcgaggaccgaccgatttcagcgacttggtggtgccgaaaagggaaacgcaacagcaaaagacaaacggggcaatgccatcgacagaaaaagaggacgacggatgggtggaggtgaagaagcggccaaagctggaggcgaagaagcggggacgaaccaccaataaatgagtagagggatattatgcggagattccaatgaaacggagtgtggtactgtgcaagacgtaaacacccggcccactttttccggggggggggggggaccctcgaagtcgagactttagaaatcggagaattttctggagtatacatttttaaaagccatgttttcgtcttgcacaacactgtaaaaggtagttgttttacatgataacttatctttgtccaatttggcaattgaaataatgcatttttgtgtgaaaatcatgtgtgtaccattgaataagccagtttttgattgtaataaattggtgatgatctctttttgtgtgtaaattgttataaaaacaaatgaccaaaagataacagtaacaacattttttcgcaaggtggacggaccattttaatgtaattaacggttaaaaagtgccaattcttgaaactggctctaaaatgatcgcatcttcggccttttcttcgccccggcaacgcccgcggccattgccattctgtcctgcgttcgctgtcgcttctcctccgcgctttcttcgctcggtttggcccactccaacaccaaccgtcgaccgtacaaatgcgtggaatgcaccagcgcgtccatggcgcggtgcgcgtcgctcacggagagaaattcggcgaaacaaaagccgcggtggccttcggagccaggctgaataaaaataatattgtaaaatatttagatttaaaaatatccaagtgtatgccttggatattccaaaatatttggtttctagccaattgtgccacagtccaaaaaggcacataataattctccgaaaccaaaaattctcacttttgccttcccttttattttgctgaatttaccttttttggtaatcggatgaagttgagttcaccaaatgcggaaaacagctgcgtaagctccttgagattcgcctgaagtttttaaaaaatgtttttttgcattttctaccacaggaattaatggg

SEQ ID NO: 36785 - DNA, 903 bp, Heterodera glycines
  misc_feature (689)..(689): n is a, c, g, or t
ttacatattaattcaatgcttccgtccgcgttaaacatgaggaaataaattttgttttaatcgatgaaattttatttcccaatttattgaaattttcatattatttgtcctggtaattttattttcatggcaaaacagaattgacgctttggaaaatgtgtggtcatacaaaaagacgtccgccgatttgaccgtcaaatttgccccattttgcgacaaacattcgtcagttgagctgtgccgatgttttttttaaattttatctattttctccgtttaataaagaaatgggcaaaatgttaagcttatgtgaaatccagtcctttactgcacggccatttcgttccaaggcaatccccgcctcttatcaaccgccactttccgcgttttaacgtcaatgtcccatcgctgccctggctaaaaagttatgaactcggcacaattcaaaagatttcttagacgccaatgaaaaaatattaaaaatgaattcattcagcggttcctaattttgaaagaatttcttacggaaataaggaaaacgaaagtatgttttattaattagggggcaccataaaatgtcggcaccgcaaatattattttgaccaggcgccgcaaatgccggcaatcatttggacaatttgcgtcgccgcatttcaccgacaattctcatcgatctcaacattaattcnattcaatccggtcgtcttctacccaagaaccagattcagctcccatccctgctgataaatgaaacactggctgggaagactgacaaatgtttgaaatgatttttattttgtcatgtttaaattctttttaccaaccaaaaaaaattattcttcattttatttttggcaatacaatttttgtttacatattaataccatgtgcttccttccgcgt

SEQ ID NO: 36786 - DNA, 1716 bp, Heterodera glycines
aaaaaaagggggggttaaaaaattttttggggaaaaaaaaaattttaaaaaaaaaaattcccccggggggaggggggggggaaaaacttttttaaaattttttttttttttttttttttttttcaacaaagggttcaaaaaaaaaaaaaaaaccctccgggggaaaaaaagggggttaaaattttttgtgaaaaaaaattttaaaaaaaaaccccggggggggggggggggaaacatttttaaaattttcttttttttttttttattttctcaaaggtgttcaaaattcaaaaaaaaacacccttcgcggggaaaaaaaaagggggtttaaaaagttttttgtgaaaaaaaaactttacaaaataatacccctgggagaagggagtgggaaacatgatttcaaaattttcaatttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaatttttaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactacaaaataatacccctgggagaagggagtgggaaacatgatttcaaaattttcaattttttctagtctaatctactcaaaacggttcagaattcgataaaaataacattcacggtgcgaaaaatggggtttgaaaagtttattgtggaaaaaaagactttacaaaataatacccctgggagaagggagggggaaaaatgatttcaaaattttcaattttttctagtctaatctactcaaaacggttcaaaattctaaaaaaaaaacatttcccggggcgaaaaaaggggggttgaaaaatttatttgggaaaaaaaaaaattttaaaaaaataatacccccggggaaaaggggggggggaaaaaattatttaaaatttttttatttttttttatgtttttatccactcaaaaagggttaaaaaatttaaaaaaaaaaaaattatccggtggaaaaaaaagggggttttaaaaatttttttgggaaaaaaaaaattttaaaaaaaaaaccccccggggaaaggggggggggaaaaaattttttaaaatttttttttttttttttttt

SEQ ID NO: 36787 - DNA, 659 bp, Heterodera glycines
ttttttcaagtgtccgttttggggtactcaaacatatatgggggagcaaatatcccaacgcagaattaaagtacaggctatagtgaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatgaggagcaaaaatccaacgcagaattaaagtacaggctatagggaagctattccggaaggattcggtctccccataaatctgggcgcatcggctcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaa

SEQ ID NO: 36788 - DNA, 943 bp, Heterodera glycines
  misc_feature (802)..(802): n is a, c, g, or t
  misc_feature (875)..(875): n is a, c, g, or t
  misc_feature (921)..(921): n is a, c, g, or t
cattttacatagctcctggacaaaatgcgtcagtgatagaatttaagtttgaaattattaagttcttaggagttaagctttggaaattttgtaaaaacaagcaaattcgaaaaacccgaacatttctgatgggaatacagtaggtttccatcgaccaattaccgtataaagttttagtcactctactaccgtttctcacattttaaaaacacaaactattcactgaagcatttcccactgacagaaataatttttccaattcgcatttccaaatttatacgaacaaaatttggtaaaaataaacaatagtataacaaacagctgcataaaaaatttggtaatcagaaatgagttggcccaacatattgtagtttggtaaaactcattgaaaaacaaaaagcgaactgaaaaacgcaaaaaatccaaaaaaatttttcttggttataaataaatagcggatttttaggttaacttatttttctgtggcgttaattcaatgagaaaagcacaaaaaacacatttttaacgcgaaaattcacttggaatccctattttggactttttgcctctatttgggcatttttgaaaatccttacagctgcaaaaaaacgcacccattaggaccgacctcccgaccccttgaaaattaatttttcaaaaagttagaaatgaagaaattatttacatccatttttattttcattaaaattttccccattatttcgcgattttttgggtccctatttagccccctaaatttgatttttcgccctaaaatccactcctagtcataaaattgccnaaagtggtccattctctgttcctcttcccgttgtctctgtttgtttaacatttccctctgggctttctttcantagcaccgagtgagcttggcgttcccgttgcaatgtttcgaatggntgtggcgtcccgtcaaaaccta

SEQ ID NO: 36789 - DNA, 333 bp, Heterodera glycines
cggctacaacccccacttgcattattcgagtgcggcacgcagtgcccttttcatggttgttgccgtcggctctcttctcaccgttttccctctcaccattttgctgaaccaatttgggtcaaggcaagcattgactgctcctaatgaactgccatgaccaatgctttttacaatcaaaggctcgtctttggctgtttgggctttgtcagtgcgttggccactttattggtacattttacgtgccattggatcaaacaaataatatcaattaattaattttttgggttccctgaaagggaatctcggctttccctttatgctgttaatgcgcct

SEQ ID NO: 36790 - DNA, 1270 bp, Heterodera glycines
gattgttcggtcttagtcatggcattttttgattgttcggtcttagtcgtggcattttttgattgttcggtcttagtcgtgggattttttgattgttcggccttagacgtggcattttttgcattgtgcggtctgcttcatcgtggcattttttttgcgtggatgagttgggtatggatgaattgggtatatggatgttgggtttagataagttgggtttaccccatcgaataactattttttcctgggtttcaatgcaatcaataatttatttttatttttgtttttgatcagtgtttttggtttttctttaggttaactaattgttctaattaagaagatgcccccgttttactgctgctggcttgtcctggcagatgacaagtgaaacctaaaaaacaaaagataattcaataaaatgggaaaaaattatttttaaaaaatttaaaacctaccacacaaagtacaagaaagagcgatgcaaaaagcttgaaagaatgcatttttttcgtaggtttgttaatgagaattgggtaattttgtggaaaggaaattggtaatttttgagcggaatgaatgatttggtgctccaatttgtgcgctttttaaagggctgttttggcttttgctctcacacccatgccattagtaacacattaatttgtgaaataattaatatgcgtgaaaatggcaacgtaaatgtttcgacgaatgtgactgattgacaaataaaagcattgaagggccattagtaacaaaaattctgtatggaagaaaaaactgaaaaagtggaaaaatgaagaaataaatgtttttctccgatatgactgattggcaaacaaataataaaattgtatattagtcaaaaataacataaaaatgacaggccagcattttatgattaaaaaaagtctattaaatattaaaattattttaaaaagcggaaaatattaaagttttaaaatcgcttttaagtctaaattaccaaacaatatcatttttaatacatttatttagtgtttttttaatattttaattgaatttaataattttggtaagaatacttaaatcagattactgtacctaacttctaggtctcggttttttagtttcggaaaccgagaaatttttacactgttaagtacgaccattgggggggggaggtgggagaagagaaaaattattgaattttaacaaaatttcttaacaaaattcattaaaatcctaaaaattttcccaacgcggactccaaaaactcctaatttctctt

SEQ ID NO: 36791 - DNA, 55 bp, Heterodera glycines
ccgcaggcaccgcgccagccggcggcaacacctgcacgatcacgcgcgcctccgt

SEQ ID NO: 36792 - DNA, 1129 bp, Heterodera glycines
tttacaaattactgaatttatgaagaaaaaaatagaaatggtaagaagttaatttaaaatttaaattagtaaattggtttctagttgcatctgattttttgaaaaatattacctaatttagtctccagcaattaataaattgttaacaaaaattaattatatttaaaacaatttaaaacaattactttatcaaaatagggtgtaaaaataatgcataaaaaactataaaaccaataaaaaatatataaaggaaatagaagcaaaatttgctatatcaatttttttaaatttagaaatatgaattatttaaacatatatttttatttatggtttaaacatcattaacctaaaagaggaaaaattaaaaaattattaatacaattaatgaaagtgttgaatttaaatttataaataagttctcatttaagatattttaatgtataatattaaatgctgattttttttccaataagcctcggagaagtcaagataatagtaaattataaaatagttttttgtccataattaaaataaaagtattaaataattgactttgcgcgctaaaacaagagttataaaaatcaaataatttgaaatgaaaataaaaaaacacgtttatttttagtttaaaaaatttttatgagtaaaatttttaccatgaatgcttttttcactaaaatattataagaaagacgatctcactatgcaattcttaaatacatataaaataataaaaatacccaattttaagaatttatggttatttaagcatgttaatatcaacgaatattaggtaaataaattataagagaaattaacaacatgtaataatttattaactaaaagaatgtaaaaataaaattcttaaatgcccaaatggctaatcttaacgtaaaagaaatgattaagatttccataaaatttatttttaaagaaattggaaaaaatcaaattaccaaaaatagggtttttctattcaaaaagctaatttatcgaagaaagaaaattttaatcaagcccattcgattaaatttaatattgcatgaataaattgggtaatattaaaggtgaagagctttaatatgataaaaagagaatacattttgaaaaacggattaattattttaaa

SEQ ID NO: 36793 - DNA, 1216 bp, Heterodera glycines
tataacaaaaaatgcaaaaagattttcatgaaaaaaaaagattgtcaaaatgtcaaaataatggcttaattaatttagttgcgaaaaatcaaaacagcgattcctagtgacgaaaaaaatttccgggttttttttttgaaaatttaatttgtcattgatatttctttgaatttatttgtgtattaatttacatcgcaatttggtaatttctcagcacgatctttcttaaacccatcaaaacatattgggcattcagtatttgttgcttttttatttctcgttggagcagtgccaggtgtattaataaatattatgatccagagaataattaatgaatgatgacaaatggacatcccgaaaaaatttttttaaatataattaggactatcaattatgagtctttttggtagcaatttgttaaaaataatatagatttagtaataggaaatgttttaaggacttcttatgtagcgatattcaaaaatataattgtataaatgtacattttaaaaatttatattaaaaaatattaaataattcatgtaatgcgcgtcaatccatcactaaaattaataaatctataaaagcgctagcaattttattgcttaaaaaattggcacaaataataaaaaggaaaattataaataaattaataaaataacaaaatcaaaatatacaatatatcaaataatttcaaactactttatggttaaggattccattttttacgaatatacatttagtctagagatcgatgttttgaaaaaacctgtacctgcgcctgtatttcccgaatggcctgtacctgtttttctttacaaaagtacaggaaaaatacaggctcctcggtttttgtccaaaaaatcattaaaattatgtattttttgaatttttcctcctttttcagacatttcgccaaaaataatgattaaaaattaatacagtaatacaggtttaaaggcatgtacctgtcggtctaagtcagttgggcgctcacagttgggcgcacacggttgggcgccagcatgtttttccactataactttctacaacttttttctttgtcatccaaatccaacatttttggtatgatccgaaagcttaatgtatttagaaactttttctaagccattgcttcgcgattagacaagtatcaaaaaagttatacatgaaaattaagaaaaactcgaaattttgaagtttttgcttaacaaaa

SEQ ID NO: 36794 - DNA, 969 bp, Heterodera glycines
agaaatttgagacatttcgcgcgtctttggcggcgccgctgaattggccgcgttggcattttgtgccgccgcggtggactccgtttgcgagaacatttggcacctgcgcatcacttgctcaccgtgcaaccactcgtggttggcgtccaacacaaagtctacctgaattatttcatgctcctaaatccattctcggacaagtcgcttctcgtaattaaagcttagtctcgagtctcagtagcaaatcgcactatcgatttcagttctcggcctagggatttccgatttgtcggggaccaaaaaccgatcaggctaattgcttgggttggagtctcggcaaactggtttatacctgagttgtaatctcgaaaaaatcggacgaatcccattcttagtctggtgccaaattccagtttggcatcgattctcgcttttcccatgccaaatccatatctgctaattgcttgggttgaaatttcggcaatttttcaatttcagacggtgccttttttccatatctgctaattgcttgggttgaaatttcggcaatttttcaatttcagacggtgcctttttttggcccatcagtggcctccgtcattttcagcaagtataaagagcaagcagcacacaccttctccgccaggatgatgtcctgcaaatagtcatggaggttcttcgcctgcaaccgtttggcatccaacggctccaagtccaaaagttcaccgcccacgcatttgaccgtaatgcacacgcatgcgcccgccagcaacgacaaacgcatggccaacccggagccgggaagggtgcgcaacatggcatggaccaaaaattggaaaagcatgaattggaaaatatgaatttagatgtaattaattaattgttggccatgatcaaattcctctggtcagagaaggacattgatcataatcagactgcgatgaaatcttgcgcttttgatcattgatc

SEQ ID NO: 36795 - DNA, 472 bp, Heterodera glycines
tgcattttacactacgtcaaaattgaagtgcccatacctcagccggtataagtcatagagacatgcggttttttgaatattgtagagaattttgagtgttgttaaacacatgaccatgactgtatgtcttgaaataagccacctttaatatttttgaaatataaccaggattctaatcgaattttctgctgctctcctatgctttcaccagtgagactgcatgattggaatgataggatcctgaaatgtataatgattattccgtccattcattttcgacgcgcttttctggtctatgaaactgactttgactatcgcctttaaacatgcgcggcctttggacggcgtttggccttgtctttgggtacggcacattgaacaccattactatgcctatgctggatgagggggtgagttcaattaatatttttgagatgataattactataattatagctaaaattgcagcgca

SEQ ID NO: 36796 - DNA, 114 bp, Heterodera glycines
aatatcgctgggaagcaaaccatttaaggccgtttggtcattttcatgtctttttaaaattttaatacatcggaatgaatgtttttttgtgcgggggagaaaaagcgtgggaaa

SEQ ID NO: 36797 - DNA, 868 bp, Heterodera glycines
  misc_feature (825)..(825): n is a, c, g, or t
ctgtatttaatctggggactcaattctccggcagtcccattaccggtattcaattatacgacattccaatcactgtgacctaattcatctgcaacccaatcactgggactcaattcttctccgacattccaattacgggactcaatctcaaaaaattcttcgcacttaatcttgggactcaatttccaattttacggcagaaaatcacagggactcattctcccacttctttgcatcccaattattggaactcaattatcccttccatcgtgggactcatctcaccgattcttcgacatcccagtcgctgggactcaattcttctccggcatcccaatcacgggactcaatctaaaaattcttcggcacttaaccatgagacagtttcagcaaatttacggcacaaaatcacagggactcaattcttctccgacattccaattacgggactcaatctcaaaaaattcttcgtcacttaatcttgggactcaatctcaccaatttcatgcggaattctaataactgggactcattctcctacttctttgcatcccaattattggaactcaattatcccttccatcgtgggactcatctcaccgattcttcgacatcccagtcgctgggactcaattcttctccggcatcccaatcacgggactcaatctaaaaattcttcggcacttaaccatgagacagtttcagcaaatttacggcacaaaatcacagggactcaattcttctccgacattccaattacgggactcaatctcaaaaaattcttcgtcacttaatcttgggactcaatctcaccaatttcatgcngaaatctaataactgggactcattctcctacttctttgcatcc

SEQ ID NO: 36798 - DNA, 498 bp, Heterodera glycines
gttttcggggcagtccccccgaaccgatgcgcccagattaatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgattccttcgggagtagcttccctatagcctgtactttaattctgcgttggatttttgctccccataaatgtttgagtaccccaaacggacacttgaaaaaatcgatttatttttgttttttggggagtccccccgaaccgatgcgcgcacatatatgtggagaccgaaaccctcgggaatagattccctatagcctgtacttaattctgcgtggatttttgttccctaaatgtttgagtaccccaacggacacttgaaaaatagattttttggtttcggg

SEQ ID NO: 36799 - DNA, 1100 bp, Heterodera glycines
tgactatttacaataaaaatttatgcagtatttctaaaaaggatgtaaaaattattctcttgcgtaatattattttacattatagttgttgaagaatttgagtctgcttctgatgcaattggaaaatttttcagcttttctcgaaaagttttttcccagaaaacggatgggtcaaataaaaaactaaacatctcacatgaccaatttaaattcccttacattttgggtttactttattatgctggcccataaaaaatggagtttttccggtgccaaatttttgtgaattttctttcggcccgtcataagcggcattgtttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaatttttcagcttttcttgaaaagttttttcccagaatttatacagctttcccgacaaattgtttagataattattctagacgatttttttatatctcagtgcttaactattgcctttttgtatgataactggtagatattgggagtgaaaaaaagtttgtttgtgactatttacaataaaaatttatgcagcatttctaaaaaggatgtaaaaataatttcttgcgtaatattttttacattatgttgttgaagaatttgagtctgcttctgatgcaattggaaaatttttcagcttttctcgaaaagttttt

SEQ ID NO: 36800 - DNA, 846 bp, Heterodera glycines
ataacttttaacgaaattttttagcctaatagagaacacatagtgctattgaatgatgccatgatatgattaattcggttacttatgccaaaagatatgcataattttggtggtttttgagtaattagaggcggcaccatcaaaaagatgttttgtttgatacattgtaattggtcttcagagcacaagttaaaatgcttaatccacttttccgagcctaaaaagttggagaaaaattttataccttcgtgccattgataaaaaatattggcgttggcattttaggagtaaaatatgaaggaaagaaaaatgggagtgaataatataatacaatagttaggtatacatataatttaaaatttagccattttttgggtgtcatcaaaaaatgatgcgatataataacagcacgggacgtcgcgggaaatcccaacggcggatttcttccgcttcaccgcttccaccagcagcagcggagagagcgtgaaaagtgaagagagagaaaaaaggaagaaagggaagagaaagagtgagaagaggaagaaaagaaggatgaaaaggaaatatacggaagaggaagaatgggaggagagagagagagaggaagaggaaaagaagaaagagagagagtgggaagggagggagaggaaaagaagaaagggaaagaaaaggatgaaataatggagaaagaagagaggaaaaggaagaggaagaaaggaaagatgaaaagaaaaagggaaagaataagaatagaagagagaggaagcggaaaaagagaagaaagcgagagaggaaggtgaagaaagtgaagataagagagagagagagagagagaaggagaaagag

SEQ ID NO: 36801 - DNA, 521 bp, Heterodera glycines
ttaggggagtggtacggtagagaggggatttaaaattggaattggtttttgaaaatgagggcaaacatcggccaaacattattgggacgattagtgaggagagttgggaatgtgagtgcgtattgtactgtatgaatatgaccgaaagggaaagagcaaattaataattgggtgtatacggtatacggactggatactgtataacgatgctacggtatgggataattttattgataaaagtgaagtacattcgacaaacattattcgtgataaagtaaggggcagcaatgtgaataagcgataaaaaatatactgtaaaatgaaagatacggtcatgtaaatataagtttagttgaccataatgaatttgcgtatatttaatgtgcgagggttactgtacatatagacaggaaaggtatggattggagactggaacactgtaccaaagatgctacgatagaggatttatgtataaaaacaaacatataaagccagggacagtagcaccagtgcgggatact

SEQ ID NO: 36802 - DNA, 952 bp, Heterodera glycines
  misc_feature (826)..(826): n is a, c, g, or t
  misc_feature (836)..(836): n is a, c, g, or t
cgctgcccgtcaaaatgtccaagcgtcataatgtccaagcgtcataatgtccaagcgtcgaaatgtccaagcatcataatgtccaagcgtcgaaatgtcccccaagctaaaatcagtcaaaatgtcccccaataaaaatttgcgaaaaatcctaaaattacataattctaaggcttcttattatttattttgaaaaatctactcatttagactcatatggattggagaaaaggacgtggtgcttgtgtttggaagtgaacgggtaagagcatcagggatcgaaagcggagaatttaaattttaactttttagactttggacattttgagcaaaaattttgttccacatttttttgccgggtatccgtcaattcctttctcgcggcaatttcggcatttaatttgtgcgaaattttcttttttggcatttctgctgtgatttttatggcattattttctttttttgttgtagttttattgaatgcccctccacttttggttgagggtcataataatgaagggcaaaagaggggcaaatggacgcgctgctctttttttgcattaattatttgcgcaaaccaaacgccgaggatttttgaattttgtttcaaaacgaatgattggccggcattactgtaaaagtggacttgctgggaccgggaccggcacctcgatttttcttcgggaccggaaccgggaccaaccgggaaattttaaaaattcaaaaaaattttaaaaaattcaaattttaatttattccaagagaaaataataacaaaattaaattttattttttttatttaataaaatcaaaaagttaaagctanattaaattanagaaaattttcaaatcaaaatttctttcattatttcaagcaattaatcatttgggccaaatggtcgaatattttttgaaattacatttattatcacacacttttttcgtgcgtttt

SEQ ID NO: 36803 - DNA, 1048 bp, Heterodera glycines
acatgtataaaaaccccgaaatatggtatggaaaatatcgaaataaaagtcccaacttttgttcgtgtttcctactatttagaccatgtagaatccaggaaatatatgtatttacataaaattccaatccctttttatgaatcattaaataaacgggtattttgggtaattttacttgtttttttaaatgtttgcctttttctgtttttatacgtttccccacagagttcattggttggactacacacaatgcgcaacgaacactttggcatttcggtggtcgaagggatggctgccggcactttaatggtcgcacacaattcgggaggccctaaaatggacataatagcggacaacggcaattccgtcgatgagaagggcgtttatgccggagagaatggttttttggccacgtcaacggagggtaatttcggattaagaaattatcaaaagcacacttttaagactatgccgaggccattctcagaattctcgacatggacaaaattggcagagacctaataagagagagggcacgacagcgagtcgaacgcttttcggacggacaattcgaacggaatttctgcgacgcagtcgaagaattattaagggaatgaaagtttccatttgcaaactctgtctgttcctaagattctttttttcactttcatgaaacttaataaaaaattcacctttggaccaaaaatggtaatacttttgatggtgggccgcctttttgaaagaagtttttttgttctaaaaaggaaggaaattttaaatctcaggccattttgggtttgttgtaaaggttaacatggaagatgcgcagcctggccttgtgcatccggccatggtagtggtcgcatcatagaatatttgttgaaaatatgacgcgttggttcatgttttcgaaataagacaatactcccaatttcctcgggtgagtttagaccggaattgcgggtcatcaagtatctaattgtaagaatgctttcgggaacgtacttctcaaagggaactcggattttcttatgaaatcagcataatc

SEQ ID NO: 36804 - DNA, 1097 bp, Heterodera glycines
gggaatgggcccttttgggggccacctttttttaagaaaggttgtcccctttttctttgggttttcgggcctatgggcggttcagaagccatttcgcctttttttcaattttggtagtaaaaacgggtttttttttttcggaaccctttttgaaaatttttccggaagaagattttgtgacacgcaatattactaactttcgaggcttctgtcatttcctttttataatgcgtatataatttaggctatttgatttatcagcaaattccgaaattagcttgggaatgggccttttgaggccaaccttttttatgaatgttgtcccattttactttgtggtctgcggcctatggacgcttcagagccatttacgccttcttttcaataatcgtatgtaaaaacgactatctctttttttcggaacacttttttgaaaattttttccggaagagattttgtgacacgcaatataactaacattcgaggcttctgtcatttcctttttataatgcgtatataatttaggctatttgattttatcagcaaattccgaaattagcttgggaatgggcccttttgaggccaacctttttttatgaatgttgtcccattttactttgtggtctgcggcctatggacgcttcagagccatttacgccttcttttcaataatcgtatgtaaaaacgactatctctttttttcggaacacttttttgaaaattttttccggaagagattttgtgacacgcaatataactaacattcgaggcttctgtcatttcctttttataatgcgtatataatttaggctatttgattttatcagcaaattccgaaattagcttgggaatgggcccttttgaggccaacctttttttatgaatgttgtcccattttacgttgtggtctgcggcctatggacgcttcagagccatttacgccttcttttcaataatcgtatgtaaaaacgactatctctttttttcggaacacttttttgaaaattttttccggaagagattttgtgacacgccaatataactaacattcgagaattctgtcatttcctttttataatgcgtatataatttaggct

SEQ ID NO: 36805 - DNA, 632 bp, Heterodera glycines
aagcatagggttatcacatatatcttctgatggcattgaatccgttcaccgctaggctccttacgtgtgtcgcttcagccagtcgtggaccgctgccattgagtatctgccgctcgtctccgcatcccaaatgtgctgcaagatgaactcgaccaattttgacggcgcatctttcgggaagctgagcctcgttccgttgatcacctgaaaaggaaggaaaagttgaaaaaagcaagcaaaaaaaaagtgtgtttacccaccgataccgccacgtctgttccgcccgtttgtccgtacggcgcttctccgttggcgaagatctcccagcacatcactccgcaggcccacgtgtcgctcttcgcggtgaagcagcgctcggcgaacgcttcaggcgacagccatttgacggggacgcgcgcgttgggctccattttcttcactggtcttctgtgcgccatgccgaagtccgagatttttacctgtgggaacagagcgaaattagttactaaaacaacaaaagttttgactcaccacgccgttcgagtagagacagtttctggcgacgatgtcgcaatggatgatgcccttggagtgaatgtgagccagtccggtagctgctccgacgcacatga

SEQ ID NO: 36806 - DNA, 841 bp, Heterodera glycines
cagttccatttgatcattttgcaattccctcgcccgctcctcctcctcctcgatgattttaagccaactcatttgtccttcctgaaaatttattttatttttttactaatatagttttatttataaacttttttcataaaaaagtacctgtgttgctttatcttcttcttcatttcctgttgtcatcttttgttccgggtacgcattgtggagccaatcggtcgcaagaatcgcgtccatttgtttaatagttaagagattattattattattatttctgtaaagctttattgtgtatatataatattttttaaacatggataatataaggtaaaccgttttgcaaaaaaaaaaatggcagacaattttcaaaaatttgatgaaaaacacttacaactcagacacccgtttacgctgacaatctcagggagcacggggagtggaaaatcggaatgggtgctacgaatgctgaggaatgtgaatgcgctagtttcggaacccatctcggagattttctactgttatggggagttgaatccaaatataatacagcttcagaaaaatggacacatcggcgggtgtagggttatttattgtacatgctggaagcccaaccgaagagcaggttaatcggcgcgcaaaagagtgtgatggaaaactgttgatggtgttggatgatctcatggttggattgggccaacaatttcttgacactgtgttcacccggggatcgcacaattgtggggtcagcgttgtgttggtcactcaacatttgttcgcaaaagaactgcgggttgcgcgcaacaactcccactatttggtgctgatgcgtaacccggca

SEQ ID NO: 36807 - DNA, 777 bp, Heterodera glycines
  misc_feature (629)..(629): n is a, c, g, or t
ttggcaaaatgcttggtacttatgcagtttaggggaccattaaaggtacatttttctaatgcctataaaatgtattcccctttcatgcataaaaacaaaggacctaatattttttattgattttggacccaagttgcttctatttatcaaattttgtgaataaatattcaaattccgtatttacttatgtttttataatgcatgtaaaatgaatacattctataggcattataaaaatgtatatgaaatctgtcccctaaattgcataaataccaaatgcttattccctgtgcaaatattgaaattgttccgcccaacaatgcaaactgattaattccattattactagagatcgacattttgaaaaaagcctggacctggattccatgttggacctggaccttgatttcctggacaaaaatccagcaaatcaaaggcccaggaaaaatccaggcctggatccaggcccaggtcgatctctaattattaccttcgttgtcgcctcactgctatcaaccggcacttgaccaaccaactgacgaagcatttccgggtgttgcaacaaatcgccgagttggactccgccaccagccggccctttcgcattgttaccgccagcagttccctgngtttgaaaataaggggaaaggaaagggtgcaacccaaaatcacgcaggccgaaatcacgccgcttgaaatttaaaaaatttttttttcaacagaaatttttcaagacaaaaattcttagagtttttttatacgaaaaatttcaaaaaa

SEQ ID NO: 36808 - DNA, 1144 bp, Heterodera glycines
attttctttactttttccctttctcttcgtcccttttcctttatggttccctttttcgggtccgtctccgtttcggcccttccatctctccctaccgtctccgttttgtgttccttcgctttcgatggcttctcgaggcgcacaattacccgcgcttcactcttttgggccaaatgttcgccggctttgtcctcggctgcgaggcgttgtgtcgccactgtcccgaatggttcatggacaccaccgggtgtcccctcactttgccgctttttcgatggattgcctgtgccaaaacgatgtgttatgtgcactatccgttgatcacaaccggggagaaaggacataatgagccgggcttcccgtgaactccgtacgaggaaaacggatgagcatttttactttgccagaaatggtggcattggtcgactcgcgcgccgtttcttacaataactcctcacaaattgcgtccagcattgttctgaccaatgccaaattgttttactatcgtctcatttctctcctctactgcgcttgtggcacaagttcccaagtgacaatggccaatggaaggtccaaattttgctttttacgcattttaattaatttcaaaaaatgattttcagttggaccgcctctcacatcgccaatttgtggttttgccagccgaaggtcgtttttccgccgtgtaatgtcgaaattctgtccaatttggaaaaccgaaccgaacaactcttagctggtggcaatccgtcgttaattctttcagtgggccaaattcgtcccgagaaaaaccatttggaacaattgcgaatatttgctgaggttcggcgtcgtttaaaagagcgcgggagcaatttgaaggtgaaaattggacatgtgaagaatttgcccattttttattctgaaagattaaattggtaattgctgggggctgtcgcaatgcgggcgattgggacagagtcgactttttgaagaagttcgccctgggcaacttccagctgaactccgacgaggccgtccaatcggactgtgacatcgcatggcagctgaatgtgccatttgcagagctcacagatttgctccgagtttgttttaaatagacatagaattagaatcaaatttttgtctatttaaatattttttg

SEQ ID NO: 36809 - DNA, 1131 bp, Heterodera glycines
ttctttttctttgtttttcattttttaaatcttttttaccccttttttcaactattacattgttttgatgctcaaatttcgaatttatttgaagtataaacttttctgcgtcatttttcattaacaaatttaataaattttctctctcattgcttttatttttatgcaaatctaaaatatttgtaatttttcaataaatttattaataaatttaattttaataatcaccttccaatatttctgcaaaattttcatcattttttaattcattttcaaaatatttttgcaactctttgaaatgcaatttctgcattaattcgctgggctcattaataattatgtttaccattttattcaattttaaatttccttctaacatcgcttttttgaccatttcatcccattcgtttgtaaattttttcaaattgttttcagcttttttaaccatttttcgcgtgaaatttgtaatacctataaaaagatttttatggaaaaatttgtgccaataaataaaaatataaaataatatttaataaaaaatagaaagcataaagttatactgatcgcatagtgcctattttctagatttttatttttaaagcctaaaaacctttaaaaattttgaaaaacctattttaacctttttggcgttttgcctaaaattatttaaatgcaataaaaaccaaaacaaatatgaagcgacctaaaaattttttcaaaatattctcctaagaattggctaaaaatttctcaaaaattgatctccaaaatttatttatttatttgttgacaacaattttaaaaagaattgtttatctcatactgattggtcgaattttgttacttttttgaatagattttgtcattttacacccctaaattttccattttagtccctatttttggggtttttaggacctaaagcctacctattttggcggttttagagcctaaaaatctcatccctcttatacatatttttttattttagtccatttgggtgttatctctataatttttaaaattttatgattttttcataaatattcaataaatattttttaattatgcttggcttcttgcatgataagcgaagcatgaatttttataaaaataacaataaaaacatct

SEQ ID NO: 36810 - DNA, 919 bp, Heterodera glycines
ttcagccgcacgaaatgagcaaataacaggttctgtgatgcccttagatgtccggggctgcacgcgcgctacactggcaaaatcagcgtgcttgtccttccccgaaaaaggggtggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaacaaggtagctgtaggtgaacctgctgctggatcattacccaagtgattcctattcaccacctacctgctgtcctgttgggctagcgttggcacaaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacatgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtaggacccgtgcttggcctagcacgaggcttaagactcaatgagtgtgac

SEQ ID NO: 36811 - DNA, 1161 bp, Heterodera glycines
atttgggacaaataccttgtccgggtattgccgggtccagaaaagccaggtcagggtcctagtttttaaaccgagtccgggtccaatcgggtcatgaaaaatccaaaaaaatcttcaaaattttttcatgaaaggcgagcgttagcgcgaggcgagagttgtaccacccctggtacgtacctcccccaacggagtagctcagttgggccggcaaaatcaaaaaattatcggcactgtctgacaccaaaaaacctgtccaatcctatcttgtctctgatgatgcgatttcatttgcccgcttgacatttgtttaggcatttctccgtgccaccaccaccaattctccagtcaattacaatgttcgttttgcaacgaaaaagtcaacgccaattgtgccatttgaattggtgaatgaacggactcaagaaaagctgacattggagaaagaaagcgaagattattttgctaatcattggctgttgaagcgatgcccaattgttggggggacggcggcggcggaggacaatttatacgctaatgtcgatattttactttatggtggcaatgattgttgcattgggtgggtcaagcaaaacatttttaaacatttatgtgttggattttataaatatttcgattaattatttaattacctaaattaatttttccaaattttataaatccagcgacaaaatttgttaactctttaggcctttgtgtccaccgacgggtcaaacgtcaaattcagcggaagagaattaattaattaattgagcaatgacagaagattgttttgaatcactaatgagaattgatttgatgctcttttttctctttgaaatgcttacttttcccgccattttcttaaaaaatttttgtgtagttcggattaaacagtaattttctgctgttgctctatatttcgatattgtgtaatttggcttacttttatataatttttaagcgaattattgaattttcaatggcatcgcccgccgaaaaaaagaaaaactttcctccgccgaccattgattaatttcttctgccaaaattgctgaaaatcagcagcaatcgttgtcgggttcatcatttgagacatcatttggagaacaacagaagaaaatggaaaatcgaattttgaagagggaaatgtgagagaaa

SEQ ID NO: 36812 - DNA, 856 bp, Heterodera glycines
attcgcttttacaaatagacagtgccgaaatttgtagatctgctaaaccttaactgaaacataccatatcagcgagacgccatgctgatttgttgtaatcataataaaaaggcccctattgttcaattctgcctttcctataagcacaatgtgtttgatgggctctacaaaatattgcttgtgcaaagcaattattttcttggaggctgtaattttctgtagtcatttgatatgcatctgctatttttctagtcacaaacaccaatatttttcggcccgaattttataggcgtgaaaagtactgatttccaacttctttctattcggatacacccaaaatttgaaaagcatctgcaattcagcctcttttaaatcttaattttctgaaacccgaatttagaaaatatgaatgtatttctgcgacgccttctatacttaattcatccataatgggccaaaaatcataggttaagaccaaaagagggattttagtttcagccggaatttctataaaaatgttcgtgtgtaacctatctttgtctattcggataagtaagaaattgaaatattcgtattacttttcctcccttaaagctttataatgaaagcgtcgttgtctatttaggatttgccgtcgcaattctgtaattccactttggaatccaaaggaatttgattcgcttttacaaaatagacagtgccgaaatttgtagatcggctaaaccttaactgaaacataccatatcagtgagacgccatgctgatttgttgtaatcataataaaaaggcccctattgtataattctgcctttcctataagcacaatgtgtttgatgggctctacaaaatattgctt

SEQ ID NO: 36813 - DNA, 1739 bp, Heterodera glycines
atcattaaagatgaatatggtaagaccgtacagcattcacctcataagttaaggcccgcgtgcctttagaaatgccatttccaattgactactccgattgtgcatgcgatccgatccaaagtcaacatccaccagtaaagtgcgtcatccgcatgcaattcgcgcctcgcccttgaggaatggctttttcggaacaatggcgtgaagcattgccaacatttcaactcccgaggccggctcgttgaagctttttggggtcaacggttgttgggcgatttcgcaaaggatcagtcgcattcggactttggggaaattcaccagtctgaaaaaaggaaagcagtgaaaagcagccaaaacggagaacggaccaaaagacttctcgccaattcgccctcggacaattcagtcgcgagacgactctgtcgcaaaggaaagtttgtcgttgggtctgtcgttccaacagaacaaaatggccatctgatgagaggtcacttccaagtcgaaccttcccgctctgctggtgaacgaaaccttcgacagaacatttggcatttgtgaactttatttcaatgttaatttgctaattaccgtcccccgtggaccaatggtgggcccaattcagctttcgtccgcagtgctgcttttttgtagaagtcctcaacttccggggtcaaatcctccaattcccgtggcaaagtcaggtgcgaacggtctcgactcctcgaccatgctctggcattcagaattttgacgcttacacaatctgaaaaaccaaaatgaatgtctgtcgttcagtgttccgtcaaccggccatttggctgcagctgcccttttccagcgatttccttagggccaagttgagcatttcctccttttcttggtcggccaccaactcgaaaatcagtcttcggctcaagtgcgtcttatgataacgcatgaaaacatctttagctgtgacatatttcagcaccaaaagctaaaaaacgaagtggcgaaatatgcggaatacgtaacaacaccaaaaagaagtcaaatttcttttccgttttgtacttcaaatgtaaaataaccattggaccgccctgccctaactcaccacgttgttcagtctctcgtcgatctcttcagaagaaaactttttcgtcagggccgactttctgagcaacaaatcgcaataatttgctagcaattccgggcactttgactcgatgttcgctgggcgtccactgtttagtatttatttttaaaattgcttttgcgcattttcaaccttttcgttcggtttgggtccaactccaatctgaacacttccgtgttgttcaccacttcttgaaatgctttgtctctgacggtcaaaaagcgcgagtcgttgtaaaaagcatctcggacgagttcggagaacactgagtacatgttgagcaactgttccacgtacctttcgctgtcctaaattcaaatttcgatgattttttctaaatcgaattccaaaaatgtaccgtcacaatttccgccgcgtgttcatgcatggcggcgagtccttctgccgtgatgtgtttgtgcaagacgttgagcaaattgggaattccgtcgggtgtccgattgatcagtcggtagagcgtcttcagcctgtttacctcgttgtttttgatcagagtcggaccaacggccaaaagttggtcttgatattcgatcaccagcacttgaacgcattggtccaccaactaaacgtttaaatgagt

SEQ ID NO: 36814 - DNA, 1141 bp, Heterodera glycines
gaaaaacatttgttcattttgtcgttcgcttaaatgtgccgttggatgggaagggaatgtcgttgaagcggcaatgggtggtcagactaaacttgaacaattagggcagagattgtgctaaatgggcactccattctgttacggtaggtttagtactgtaaattgtccaataaattgacagaccgaaatttgtttatgcgattgccctccccccaattagcgaatcattaagcaactaatttatcggctgcccccgccgcccctttattgtgccgcctttctttgactgactttgcaacgcatggctctgccagccaaaggtaccattcgccttctctttcgtctctgtgctttccgtaactttaaaaagtgatttgtcttaaattgtccgtcctttctgtcctttcgcttacgtataatacttttggcagtttttgttgtccgtcggtcgcttttgaattacctaaaattgacgctaattggaaagtgccattggcttaattaaggccatcccttcggggagtttcgaattcgtcgtccttttccgtttgctttgggatggaattccctccctccgtccgtttccatttatttctttggcatttgttgtgcctttttcattgacccaccgaaagatcgttcttcgtgccgcatccaatcggacaaataatgcgccctcaacccaaaccgtccccaattaatcgccttcctccggtctttttacttgtgccgtcccccaccaatttgttccattcattttgcggcatcggctcgcgtcggcacggcttttgccccttcgaatcggcgccaaatttcgaatttggcgtaaccaaaatgcaattgcccttttgtgacgtacagtccaacgtccgttcttctgaacaacaatcattttcagacccgccaaaggtttggccactgaaaatgaaatgccaaaggctaaccccagcgaggccattgagcgctgccgaacaccgccaaaagagaaaaccacaaaagcgaatgtttaatttgcatctgccaaaaccaaagcgaaagaattaaagacattccctaaagaattctgacaagaaaatcggcgaggaaaataatgggggggggggagtcaaaggtaaacccatgggcaaggacggacccagga

SEQ ID NO: 36815 - DNA, 968 bp, Heterodera glycines
  misc_feature (852)..(852): n is a, c, g, or t
acaaaagaaattgggcgaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaactgtctaaaaatttttgttgttaatattcagaaaacgtgttttttttagtgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaatagcatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaattgatcataatagaagtttaatttttatttgtcccatgcattttctgggaaatcttttcgcgaaaagttgaaaaatttcaaaacggcacgacaacagatgcatttcaaacaattcaacaatataatataaaatttaggcaaaaatttttgttccttcctctttggaaatggtcttanattttgcttgtaaatattcagataacaagttttttttactgaaaattttttacacactacaggatgaaacgcaataaataatgtttgtaaacaaaagaaattggcgaaaaaaattg

SEQ ID NO: 36816 - DNA, 963 bp, Heterodera glycines
  misc_feature (685)..(686): n is a, c, g, or t
  misc_feature (819)..(819): n is a, c, g, or t
agaatggcaaatttttaaaatcttatagctaatattatcttggagaagtgccatttttattcggaagttttttcagaagattttgggtctcgatgatgttaaaatttatatccgatataaagcattgatcaatttctataatattacccaagcatggatagcttgggtcggtttcactattattaaatgaattggcaaataatgtggcaaataattcagatttctcagcactattatgatagcatttattttcataaattagattaggtattttaaagggattgacattgaatttttgtatatatttataaattgaatttcttccctttgaaatagcctttttctcaaattggctatggtatttatttgtttgtatttttatatgtaaagaaatgctatcgtatagtgcttttttggatgggtcagttttagctagcctgaataatttagccttttctttgatggatgctaataaatgttgtgggtatttaggagtcaaatcattcttggctaaacgctttattggaatacactcatttaaaatttctaacaacatactgttaaaggcggaatatttttgatttatgctaaagcattcatatgacaaggcatttagccttgatgctatgactatattaaaatgtaacacattcgatggacaaaaccaacgaaagtttacgatctnntgttttcggttttgttttaggagtaattaatgtgaaaaattgtgttaaatgatccgatgaaaatatgcctcctttaacagtacaatcagtaataattttttcattggccgtaaaaatcaaatctagccaggangtaatccttgttggctcgttcgtgggcaaacataagaaatttattgaaaagtcacaaatatttcacacattactcattggatagggatgccatttttcataccaatccttattcgaaaaataaatctcctaagtcactgaattt

SEQ ID NO: 36817 - DNA, 1147 bp, Heterodera glycines
  misc_feature (17)..(17): n is a, c, g, or t
ccccccccccctcttcncacgcgtttggtatatgttttgccacgagcatttttatgggctaaattttctttgtttttatcgcattttccggcggcataattcagcggggttcggttcggcacacacactttttatgtatgtgcaaatattttatttttgacgatgaaatatataagattttttgatgttggggggcaaaatttcggcacttttttgctgcttggcattttcctctcccatcactttggcatttttgcaatttaagtgagaatcggaatccttttttttggcatttagggtccatttttaaatgtagagtgcacaaaaaaaatatttatttatttaaaatggaaataaatttaaatttaaaacaccaagctattttatatagttttcattattttaaatataaaaataaaaatttctcgctcagatttcggcacttttaattatttgcattctctgcatactatttggaattttgtgcatttattggattttaccatttaatttttttggttttttctatttcaaaatttttaattaatttaaatttccacgaaaatttaaaccgaattaaaatttttgtaattttttaaaaccccaaaaattccccccaaaaaatttcggaaaattttcagaccatatcgcctgggcatcaagtgtccatcagtgtccacaatcaacccggacgactcgtcgctgtcatttgaggaccttgaacagcaaatgatctaccagcagccgatcaaacttggtggtgtcagacgctaccatcgccatcagcccaatcaaaagcagcgccgtggggtgatcagcactggcgcaaattattacgattttgacgacgacgacggtactgaaaattgcggcgccaaaagtgacgcggaactgaccgaccgagcgccgccctcctatcggtaccgcagcggcagtcaccggatgctccagcgacgaatgaatgcgggcgcagatgatggcggctcgccgccaccatcgcgcggcacgcaatccgcgccgcgcacaccgcaacggcacgcggtgccgcccgcgctcgaaatgatcgaggtgggtttataaacaggcctcttccattcatccagtgattttgctgctgatcagcttttgttcaattgttcactgatag

SEQ ID NO: 36818 - DNA, 778 bp, Heterodera glycines
  misc_feature (624)..(624): n is a, c, g, or t
  misc_feature (653)..(653): n is a, c, g, or t
gtctttcgctgcacagagtgcggcaacgaatggccaattgtaaggggaaaaggacaaaaaagcttttgaaagtcatttattaactgggttaattatttaattgtggataattatgggagtgcctttgccttttatttcgtgccgctttaataattaagtgctcagtacaaaaagataatcactttaacatttatgtaaaaatttgaataaattaattaaataaaatttaaaataataatgtaaatttttgtttaaaacatttagtttatttattttttattgtcagcttttcctcctctttttcttctggtggcatttctccccaaataattcccaaatcgccgctttatcatctttgctcagtttgaactcttccgtttgttcatccaaaagtgccaaattttgtctgtataaatggtaatgttagctaatccctaatgagactctctctccctctctctctctcttttcctctctctctatctttctcactctatctcttgcccccccttttctgcttacctgtaataactgttcatcaccgagtgccggtaggtcgaatgccgaaggccaagtgcatggccaatctcgtgcagtgccacataccgcaggtccaatgccatncgtgccatttgtcccctcggctgatgctnttgtcgtcctccacaatgccattgctcctccccgttctcctgtttttcgatcacaatgatgattcatccgctgttccttttgctttggccattacctgtctccgcccttggccatttgccatcgt

SEQ ID NO: 36819 - DNA, 1050 bp, Heterodera glycines
tccccctgccccccccccctcgtgccacctgtcttcgtgctttgttggcattttcttctcacttcccatatatcccaaacactatcctcctcatcttctcttcttcgctctcatccccgcgcagtttgagccgtttatgagcaaaaggggaaaaggcaattgggcgaggagagaatgaatgggtggggaggtgggagaatgggatcacatttcgtcgccaaaagcggattagccgcgaattttgaaaggcaattggggcaggagagggatgaatagtcccatcgtgctccttctgttggcacaacccttgcacctctgtgcggtcattaatcgccctaattaagtgctaaaagagaggggagggagggggggggggcggggtaattgatgcaacagacggggcaatcggtcgaattgaaaggcaatgccggggaaaaagataaaaggcggaggcaacaattgtgagggaagggggagggttaattggaaaagaagaagcggaagagtttatcaaatgggcagtacaaatcagtgatcagtactgcttttatcccccccccctctcaataatcgctcaattatctgctggtggtggatgactaagctcccctttcctcctccaattttgcttcttaatcctctaaagtgttccccgcagtgatgggctgaggagcagccatttcattgttggagtggcacaattgggaggagggaaagtgccaattggactcatacaataatatgcaaatatgcgaatgatgtcctgagaagggaaaccaaaaatgccaagaaaataaatgtttatttttcggtttttttttaaacagtgccgaaaaggaacggtgcttaattgagaatgaattagaagagagtaaaagtgctgaataagcgaacggacggtcctttacagttttcaaatttgctcactggtactgtacttgtgcaaactctccactggttttaaattttaaatttatttaaaaatttccctccctcctcttcttcaaataaataaaatcctcccccccctccggcgatctcttcgacctt

SEQ ID NO: 36820 - DNA, 1453 bp, Heterodera glycines
  misc_feature (1237)..(1237): n is a, c, g, or t
  misc_feature (1298)..(1298): n is a, c, g, or t
  misc_feature (1360)..(1360): n is a, c, g, or t
  misc_feature (1365)..(1365): n is a, c, g, or t
ataataataattttatcgtaatgacaaaataattgccaactgtgtaaattaatgattaaataaaattttattactttctactggagctcattcgaaaataataaacatattttcaataaaaataaaataaatgcacaatgtaaagagattttagaaaaattaaagagattttatgaaatttcattatatcagaaaattgatgtaaaatggccaaaaatgaaattttagcgccgaaaaatgttgatgttcacgaaaataatagaaacttgaatatttgaatgctttgaacacctgtgggtttccacaaccgaaatcagaaatttttaataggaattttcaaaaggctattttgggtaattttcggcgctaaaatttcattttttcagaaaggaaaaaattgcaacaaaagtcatttggcgaaatatttggagaaaaatgggaagaaaaagaagaagaaaaaagagaaataattggaaaattttataaaataaaagagaaaatcaaggaaaagggaagaaatattcagcaaaagaatggagtaaaatcaatgcgaaaataaagaaaattttcaaaaaaagaatggaaccaaaattataacgaaatttgtaagaaaattggagttagtcaaagaataattgagaaatggaagaaacaatttggattaagcagtaaaagaataacggagaaagaaaaaatggaaaaaatgaaaaaatattggcaagtaaaaaaagaaaatccaaaaatgagtgacacggaaattggaaaaattttgaaaattcatcaacagagaatttcagaatggaagaaacattttggggaagaaattttgaaggattgaaaaaacggaaaaatttacgaaaatttggataaatttatttaaaaaattatctgcgctctaaaaaatagatttgttatataaattttcaaaaatattgtatttgtatttgataaataaatttttttttaatatttaataaaagtggttaaaaggaataatactccttaatgattttatggcgaaaagatttaaaaatttcccgtgtatttattaatttcggatttgtgtttgaatttcgggtcgggattcggaattttgaaaaataaatgtcatattcgtgatcagcgcccccaatttccatagaaatgactttttatttgaaaacttcaggggggggggcaccaaaaccgaaagtaccggattaaacatttggcattagcagtgaaagaatacgacaanagaaaaatgggaaaaatattggcaataaaaatagaaaagccaaaatgaatgaattgcaatngtaaattgctgaaaattgtagaaacatttgttggagaaatttttaagggattaaaataattnaaatnctttatcagctttcagtcgaaaatttgaattcatgaaaaactgacgtaattatgatctcaaataaaacatgacttgaaaagcaaacaa

SEQ ID NO: 36821 - DNA, 1431 bp, Heterodera glycines
cacattttttcaccctagaaaaaactaaaataaaatttttcatttaatttttcatcgggaccgcaattctaaaggattaccaaaatgatcataaataaaattttaaaccaaattttgaaaacaaattgattgagataacttattgttgagaaaaaaggtaatcaatgacactaacttaatcagacgatcattgggtatgaaaactcaaaatgtccaaaacctataatttgtcactaatttattaaatttcatttgttgattggatttacttatttgattttaggctatattcaatttttggagatgttatcgttgatggtcttaacattgctgagaatggaatcgtcagaattgtgcgggacgaaaattcattatgcccgagaatttatgaagtgcgcgcttgtgcgttcgattctcatccgacttatatttatgaatcaataaatttttgcagatgtccctttttcgctttacgtggtatgttatggtgttgattctaaacattttttgctagcccaccaattaatatgtcaaaaaacattgaaacaacctaggataaataatattgaatgtttatttatatgcctgccttccacagtttatgagaatttccaatttttattgctaatagaccattaaaacataatatttttcttatttagttctgcatgagaacaacgcttacgtggttggtcagttatatttttgtagtgtttgatacaagcgtcggtgttccgtccggccctttggtgcaaaacaggctgattgtgagcctagtctggcataagcctggtttcagacgactggtgatagcgaaagtcctatctctagggctacacattcgcgctctggacatttgcgcctatgtacaaaatcgggttcaaacttaatttttccaatccctgatagcctaaactgaattaatattaagaaaataaggtcttttgttcattaggagcattgattctgttgtttgaaaattgatggatttattcaataaacaaattttaagattatcagtgttcggcaatcctgaagaatgagggtttctaatttttctttcaaattggtttgaaattggtgttatgcagcaatctgacaaacagatttatcacatgaagtcagttaatatatgattttgtcagggttttaaaagctgggtcttttgaattttattaaacaccaaagggggggatcgagccaattccctaccgccaattccctactaaggcatttgggccatttccataccaaaagtgttgaatattgataaacattgagattaaaacacacaagaaaatttattcactgctttttagacagctcgtcaagagctttcggatgataccaaatttatcaagattcgatcgttttaaaaaagttagaagtgacaaatctctcaatttttcgagttttgaaccctcctaaaaa

SEQ ID NO: 36822 - DNA, 1644 bp, Heterodera glycines
ttaaatgagtattttcataatatccaaaaataaatattcatttatttttttaattttaccgttttcataaaggcgaattgcgagttgaggaaaatgctgaactgaacttggccaaaaaagcacaccaaagcggccaaataaattgagcgccagtccgtttttcgatcctctgctgagaatgaatcttcggttgcgccgctggcggttgattcggtgccattggaggggacgcatttctgactttttgggaatattttgtagtccgacggtttgagtgccgctgacattttacagaaaaacacctaaaaaatataaataagccaaaaaagtaaaatattattcttttaatagcctcttaatttttcatgaatttgttcttttttcttatcggaacagaacaacatgggtcatgggattggttggttgtggtcattgcaatgattaatattaatgagtgtgtgcacacacaaaaaccaaatttatttgaaataacaaataaaatatgaaaataaaagaaaaataattaaaatactaaaaactctaaaattccatttatgttatttgaactttcgacaacagaataatgcaactttattgcagcaatggccttctccatttggtgctctgcttcaaacaaaatgttaaaaatagcggcgtttgtgtgtaataatatgataataattgtggattaatcgttatgcaaaatattttttcatttttatattaaagaaaatataaaaaaataatccaattagggaaaagaagagaatttttatgttaaagtgcctatgaaaaaaaagttttaatttaaatgcaaatattgtgtttcccgttgaattgatggatgaattaaagacaattatgaaataagaaacaatgttttttttcattaaatgatagtgaaatgaagagactcccaaattttatagcctcagattcgctgatgtaattgatgcaatttggccggttgatccacctacacttcgaatggctttatcacgggatgaaactgacaaatgaacacattggggagaagaaacattgacgaactgataaaagacaaacgaatggaagagataagagataagcagcaaagctaaaacagaaatttgatcaaattaacaaatgttttgaaatatcaacaaaatgaaatgagtacatttgtacgcagcgattgggggaaacatagggacaaatgataggagaaaggccgaaaagaaagaagcacgatcagaaacatctgaccacaacttacgggaaggcctgtgctaattgaacgttacaaaaaaatgttgaaaggattaattacactatttggagtggaataaataaattaaattgtcaaaattatgagacttatgtcaaccttttttaaattttttctttattatttggtccaaatttcttcaaaagtatttatcataattagggaacggaatttttaacaattaataaatttctaaaaacttattcaaactgaaaatttgagaaattactgaaagtcgtaaatttgaaattttaacatttttgttgtaattaaaggcttctgaccaagttgaaattcttttttcatgtcttttgatcgttaaaccattaactagtttaaattaagcaaatgcttccgatccaatcatttaccaaata

SEQ ID NO: 36823 - DNA, 73 bp, Heterodera glycines
  misc_feature (7)..(8): n is a, c, g, or t
gcaggtnnctcgatcttttttaatttatttaaatttatgaataaatgaatacaagcaattttggggtttatta

SEQ ID NO: 36824 - DNA, 836 bp, Heterodera glycines
ttgtcgaaaatttgttgattggaacggagaaatgcgatgacagagtgatcgatgtacctgaaaaaaagggaatgctttcatcggtgaaaaattcactgaattttgaattacgaaatgcgaaggtccttaaagcgaattttgttgggcaacggatggtcggccaatggaaattgcacagaatcggcataatttgccaacaccgatttcggcactccaatttgttttcgaatttttgttgttttccaaagcgtcaattccggtttgccatcaaaatgtgcgtcaaccaaagcattgaaacggtaagaaagcagtgccatttggagaccgagttgggcatagtcaaaagatggaagaatgtccagccacacgtaattacaaatccaactgaaatggggggaaaataagttgagcgcggtcttaaaatgataaatttaagtttagactaaaaactaaaatcgaaaatttgagtttttcgactttttgttcgaattcgggtctaaatgggtgccgatttcgtgatcagcgatccttaaaaccccgtaaaacatgtttataactttagaaaaaaaaaattttcgaaaaatcgggggggggggggggctgcaatattaccaaaaaaaaaaaatttttcacattttcctcaaaatccgattcgttttcgttgccactcgaacacttcgccgttttccaattgatgtgacaaatgaacccaacggttgcggtttcttttcacaaatgagccgacggtcgtcggaagaaaactttttctttttgacggacggtgccattaaaaaggataattttgctaaataattgaatttttatcaccttttaac

SEQ ID NO: 36825 - DNA, 654 bp, Heterodera glycines
ggggacctctagagtcctggccacaatccttcagtttattcgatccttccaattttcttcgcatttgctgtgcttcgcttggcgttgtgcccgctttacacttggccagcatttggttcattgcctttttttggcttgtgaatcggcccattatgcttctgatggcactgcaacatttggccacggcacttcctctgcgggcatttttacaatgctgctgaaattgtgatgcatgcttttgcagcacctgccgtgccattggttctgaatttttaatttttgtttaaaaatcagaaatactttattgacataccattgtatttgcactgtaaaaagtcgactttgacaagaaagagcaccgctaaaacaaagaaaaaaccgttgggattcatttccgatttaaaaaagggctttaaacagaggaattggtgaagggattggattggcaaattctgacttaaatatgccaacttttgactgtagtttgtgagaccagtacaaaaaagaaagtatgacagcagatgagcaaacagaatcaccgaaaatttggcactttttcaatttaatcatcaaaaatttgaattatttgttcaggtaaatagtgaaattgtggaagtcatcaaattcctaaaactaaatgaatttttattaacc

SEQ ID NO: 36826 - DNA, 974 bp, Heterodera glycines
  misc_feature (20)..(20): n is a, c, g, or t
cttgaaaaatcgattttttntgtttcataaatatttttttcagaaagggttctgaaacgcaccaaattttatttacatgttagtttaggcactctgatgctttttctatcaaaaagggagatgaataaatttttaaaaatttttaattcctttttaaacaggccaaaaagtttacggcttaacttattttttcagaaacttatcagaagcgccccaaactttgcagggatactgaaaggaaataattaacctgttttatcacattagcttgtcatcagtttttataaaaaattttcaaaattctgagtctcctattattttatttttttttcaaaattttgaagggcggggggggggcgggttaaatttataatttcattttgtcaaatcattgaaaactcaaaaacaatttttccaaccctcctgaaaaatccctgaaaatgcagaaaaaaacctaccgagtaagactccttgcgggcctttctccgctttttgtctcccgtgcgcaccgccttggtcgacttgaccgccttcttcgctcctttgccggatggttttggtggcattttgtcgtcgaaatgtggagaggcgaaggttttgctgaagagagctggtgaatagattcgtttgctttctaatgaaagtggggaatggggcgacagtgagccccttttatgttgctaaagtggagggaacgcccatcccattggcagacaatgcaaatccccggtgggagcatagagaaatgtaagagagagagtgtgtgagagagaaagtgcggcgtcactttttgaaatggatttttttcgacaatcggagtctccgcgtgcctgcacatttcatcagccatttttttagcataaatagcgaccaccgggcattctcttcctcactcgtcttcatttgctcatttgattcgcttcactcatccccaatcagcaaaaatgtccggacgcggaaagggaggaaaagga

SEQ ID NO: 36827 - DNA, 988 bp, Heterodera glycines
ctaaagcggtcggatgggcgagccaccggcgcacctgcaagagattgtcgaacattaactcgaccagagtactagctttgtaccagaaatcataaatgccagatttgggcatgatttatcccagcatttcgtggtgccatttttagtccagatggacctgtttggtttctgcgcaagtgcccaaatttgcagcacatcgaagctgataaagcttggccaaacgcagcgggctgagcagccacagagcggccaactcgggatcagtgccgtgcgcagcagtcaagctcagctgacggtccaactggtgaattaccggcacaaaatggacaagcatagtgccgaacacatcgctggcactgaacagctccaatagcgcatgcaatgcgtccaggccgaccaacaacacgccaaggtcgtcctcgtgggccaaatagctgaaaacgtggagggatttttacaaatctcgggccaaatcttgatctcagattctcgactccagagaaattcaattcttgaacagccctagtgactaaatgattttaaaattttttaatgatcgaaattgggttgctgtgctatgacttttaaaattgctttgtgaatatttttcgattttttaaaataaattttaggtttttaataatttaatgatgaaatagaaatattcataatttcaataaaaatttaaaaaatttgccttaaaagttggacaaataactgagtgttggccgactggcgcaaaaatgtttcgccatcgacgattaattgcatgcgcgacattgtcggtatctcttgatgattcttatgcagctaaatcattcaattaaaaaaataataactaattaacactaaaaatttattggtcaattaatcaataaaaaataattaaaatttaaaatttaattcctttgtaataaaaagcacctgcgcaattagcattcgccagtttagcgtgtcgtaattgactctgtacgcatacaccctgaaa

SEQ ID NO: 36828 - DNA, 902 bp, Heterodera glycines
tctccaaccgttcagttgcacgcccttttctcaagcgccttattgttggttgtgattttgtggatcggcgcttggctcgaacctttgccaatggtaatttcattttataatgttttaaagcaattaattcttttttatttgttaccttaaggcaattctcgcgtgcattgtcaccgtcagtcttaggccacttttcatccagtttggcgaattgcctaacctttggcggactgatcgctacgaattcgtaccattttcggcagtccattttttcctattatagggagagcttagttttttgcacaaaaaatcgcataataggcagtaattagtcatagattatatttttcgtttttattgcattttaaggattgttcccaaattccttaataggcactaaaaatggcgaaataggcacaaaataggggtccaggcattaaccacaaaaagtccaaaataggcattataaaagacatcttagacaccccaaacaaagtataataaaatgcttttaactgcgcaggaattttaggcatttgcctaaaaaatgaagcattaataataattaaactaatgaatatttttaataaagcaattaaaaatactaaacgtccgtccctttcccccattcctctcccaattttcagttcgtttggttggtcgcctttttcggcaccgctttcctcaacattacgttcggcttggccctttctctgctgttctccttggccatgttcggccttcgcaaattgaatgatgccatcgccacaaaagggcgacgcgcttcgcccgaatcgtccgccgacagcgaaaggcaattggcaaaattgccacaaattgtaaatgttacgctagcggaggaaaagtgattttatagcatagcaccacacatcgatgcattc

SEQ ID NO: 36829 - DNA, 887 bp, Heterodera glycines
attggtacgggggggggaaggaaaaggatgaaaatgagaaaatgaatttgtatccatcgccgttggcaattaattctctttatttttaacagtggtggcgaaaaaaagcataaaataaataattaaaatgcttttgaggaaaagccgaattatttattccgtcgctctttcctttgtttttgtttagcttaaccaaagtaaaggcaaacttttggcgatttttgttaagttggagaaacgggcgacaaatcgaagaaaaggccaaagaaagggacggacggaaggaagggaaaaggaaaggacgaacatccgtcactttttcattttctcccgtctcaaaagcgattttaaatgtgtttgaagacacaaccgccgattgagggggaaaagggaaagggagagaatgcgttggaacaggcggaaaagaggggggagaaacagaaaaacgagactcaaacggcggaaagagacaaacacctcacaacacacagagcagggatcctcaatttagagaaattttccataatttgaaatttaactcagttaaaataatttaaatttaataaaaaaaaattaaattttgttgcccgtgatttttcaattctttcgttacatttagcaaagctttttttattttttaattttaaaaaattattaaaaattttttttattttggttttgacgcattaaactgctgctaattgagtacagtttctttctttttaatcaacaccagaaatcaccaaataaaaacaacaaaacaattgcgaatacttccacatgaatacactgtctcaattaacaatctttgccttcttcgtctcttttccttcctttttcgtctcttttccctctggccccttttgcgctgcgtttttcgtctctct

SEQ ID NO: 36830 - DNA, 511 bp, Heterodera glycines
taaaaaattttgacaataaataataattcatttcaaaatcatgcacaaaacggtccctaaattgaagatcacattgccaaaattggatctgaatgatcctgccagtttggcggcatttgcatcgcccgaatcattggactcgcaagaattggacgaagacgacattttgttggacaatgaatggaacgaaccgatggacgatgaggaggaggaggaggaagatgaagatatgatgatgatggaagaggatgatgacaacaatgatgtaggggacctttttgatgtagaagatgttccaccagcggaagcaatgctcagatgcagtcaaaatcggtgattataaaaaataaaatgaaaattttattatttgctattggtttgatgtgccacaattttgaattacttagcgattatgggtccgattaacttcatttaaatttaaaaacccttttttttaattgcaaaaaatttttaaagaaaatttcaagaaagaaaaaattaaggaaatttt

SEQ ID NO: 36831 - DNA, 1110 bp, Heterodera glycines
agagcaattgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactgaaacaattatggggagcaaaaatccaacgcagaattaa

SEQ ID NO: 36832 - DNA, 1248 bp, Heterodera glycines
  misc_feature (77)..(78): n is a, c, g, or t
  misc_feature (156)..(156): n is a, c, g, or t
  misc_feature (1186)..(1186): n is a, c, g, or t
  misc_feature (1207)..(1207): n is a, c, g, or t
gattgctcttttttgactttttaagggcaaaattgatggaattatttttaattatttgctatcaataaagagttaannaattacccaagtgattagataaatgcgaaagagaagatttgcaattgaaagcaaaatgatgccgtacaccattcgacnttcaaccacggtgactcctctgcttcaaattcattgcctaaatccttcggcacattaacggataagcaaagagcagaaaagccaagtggcaaatggcaaacattttggtgatattgtaataaatttgctaaaatgatgaaaatttagaaaaatattattttaaaaataattaataattttaaattaaaaattagaccgaagatcataattccaatgccaggttttcaaaaaagttttgaatcagagtttagaaaataaaaaaaacaattaaaaaaaattatataaattacttactattgtatttaataacccattgtataagcaggaaaaaattattttgagttcgatttttagtgatatctctagaaatttattgtacattatttcttattttctgactgtctgattatgttattgtgtctgatcactctgatcaactttatctccgaagctattttaaggctaaaaaaattaaagcttttatgaatatggaatcgtacgtcatttcaaattataaccacaagcaaatagaagattatataattttttataatcatctttccagaattttgaaaaaacacatgtccgtcgggcaaccattcaaaaaacatttaagcccgagcacgaggcctgcagtttgaaaatgccgacctctactaagaatggcaaaagcacacaatatgccaacgaggtaaaaaaaaatcggaaaatctttgctcaaaataatttattcaagttttaaaataaattttctttattttgtgctcctccattttttacttgtgttggaatttccatgaacacggggccgtccattttgtgctgtccttgcccaagcggtgttctcacttcagacaaccgaaagcacacagaatgccaaagaattggtgcagaaattgccaaagcgaacaaaagaataatggccaataaatatttgctaattatttgtgaccaatggcgccgatacatttgggaacaacaaatggcacaaaaacggttcaatgacattaggaaattcactgaaattttnaataaggttcttttagcctanattagaaaaatgcttttaaaaatattttaaaataaaaatgc

SEQ ID NO: 36833 - DNA, 1185 bp, Heterodera glycines
ggggtacagcagtgattagaagaggtgcagcagtgattcagtaaattaaaatgaaaatattttttaacaaatttaattaaaaaaatacatgaaattctatcaattaaaaaaataattaatttaaacttataaaatttatttatcaaaaaaaaattaaatataattttttatttattaactcaacaaaatattttaaattaattaaaatcattgaaaataacgtaaaaatgcacagaaaaataatgttacaccgtccggatccgaacctgccccctcccccctcaaaatgatgcctcagaatccccaatcacacagggattctgaggtcttgacgatgtcaaaagtaaaatctgatcacgtattagtgatctgcatcgtaaattacccctaatgacatgtttttggaagatttttgtgaaaaagaattttccactcaaaaatcctggtcacccccctttggacccgaagcacaaaatcacttttatttttatatcttttttaaaaatgtgataaaaatgtaaaataaaatttatataatagagcaaaaaattgcggatttttgttgtattttacttttcccgaatagcttttcagaaggcagctacgaatttttttctgaaaaacgaaaatttccagaaattctggaataacttttttcttttttgagataaaaaactcaaataaatcccataaaattctccttatttttctctatttttaaagctttaattaacttaaatttaccaaacctgaagttagttatgaattttccaatattagcccaaatttccaagggccaaaaaattgccaaaaaataaagaatttttaaaaaattccaaaaattatgaaacttaaaatagacatcatattcgtactcagcaccttattttaccccagaaaaatatttttcacccccattttcgtccgaaaaaaaatttccgaaaatttctagggggcctagctcgaaaaattttgaaaatttccggccatatggcacaccattcgatagagcttaaaaagctctacaattttgccctaaggcgttttttttgataaaaccaacccctgacgagttatgggcccgggactcaaatgtcccgctcaggccaaaaattttttctatttccgggaaaaaatcgaaatttttccgaaaaaaataccagtcgatagagctcgaaaaactat

SEQ ID NO: 36834 - DNA, 1649 bp, Heterodera glycines
  misc_feature (1548)..(1548): n is a, c, g, or t
  misc_feature (1585)..(1585): n is a, c, g, or t
  misc_feature (1598)..(1598): n is a, c, g, or t
  misc_feature (1614)..(1614): n is a, c, g, or t
tttttaatttttaataatcttgtttcaaaatatataattataatttaatagaattttataccttttatatcatcttgtttcaatactcctgcagcgcatttagtaagctttcaaaagtgaacgcaaatatttgctgttgtcatatgacgtttttttctgatacaccaattgtcgtcacttaatttcgtccgatatgagaacatcattcgatgcatctatccatcacccataatggaatagttgtctaatcggaattcgatgttctgatgacaggagaacattccggcaaaaataccatcttcattagcaatgtgattgatggcattttgtccgatgaattgatgcaatttgtgcacttctttcaagtcctattccaccaaattttgaggctttttaatggtagtatatatttaacttgatgtcagaggtgaatgtataagagaaggaatcttatcaaaggaatttaaaaaaaagagtaattattgaaatatactatcgatttttttatcttcgaattattaaatagcttttagtcatataggcaaatgtcgagccgcaaaggtcgggaccgcaaatgtctgggccgcaaatgtcgggacacgggaaaaggcataaaatgaaaaaatctaaaaaaatgtgactaaaaacaggaaaaattacgtcttgggaggcttatctgctgacagtgaggggagtccttctttaccattttaaaaaataatttatgtatttttttcgctgacaggccacgtgcagcgggctcgacattttgtgcaaaacgaagtgatcccttcttcgtcccatttcgactcgactggcgaggttataccacataattttcgtgccctcaaaaaaaaatggaaaatatttaaaaaagggtgttttttggattttcttaaaacccaaaaaaaagggggaggggactccttgattagcagtttttttgtcataataagtcgttataattaattccattgggttttctgagccgctacgaatctgacgcccatggaccgattcctaacccgaattcgaacaaagggccgaacaaataaactattcataatttagtgttttggttcgaattcggttaaggaattctgaatggcggtaatggaggctctactgcagaattaagcatccaatcaggatggtcattgattggacgcgtaaacggcaatagagccgaaatggggttcagatcttcaggttcttgaccagccccgcaaagcccccgggaaacggtttattatgacgaaaaaatttgcaattccatagtatttgccccctttggtttttaatagcattcaaaaaatgccttaccaaaattttgactcccaacttggcacttttgccctgttcatacagttcggcactttttccaatttgatgcttttctttagttcccctggccgtgggtgcgccgtgcccatgcgcttgggttgatgaacaccggcatcccccctgaacacggcggcattgggctaccactgacggccaaagttggcattttcgagaccatcgcttacggcgacatgggccttgggngtgttttttatttggtgtggcttgaacattttcgttngtgttaattgtgntattttagtaccactnttgatggtcagtgaactgtctcaacagcctctgct

SEQ ID NO: 36835 - DNA, 1205 bp, Heterodera glycines
  misc_feature (30)..(30): n is a, c, g, or t
cagggatggagttccgaggcactaaaaatnttcggaagtcggaagtcggaattccgaggccccaaaaattttggaagtcggaagtcggaattccgatgccccaaaaattttcggaagtcggaagtcggaattccgatgccccaaaaattttcggaagtcggaagtcggaattccgaccccaaaaaatgtcggaagtcggaactcggaagtcggaatttttcaaaaaaaaatataataaattttttaaaaaatatttaataggctaaatttttaaatttttaaccatgtaaaaggtaatttcaaactgtttttagtttatttctatattttttaaaaagatcaaaatattttaagtaattttacattattttggattttttttttgggaaagttacaccctttttttgcggcgcgctttatccaaagagaatttgagaaactgtggggaaggaagggtccggcggtgccgatatgcgccgccgggaaaaattttgtaatttttaatgtaaattgttaacaaattttgtccaaaaaatggaaaatttagcgattttgagcaaattttcaagaaaattaagtttttttttgagtccggcggtgccgataggtgccgtcggaaaaaaaaaattgaaaatttctatgcaatttattaacataaattgtacaaaaattgctaattttttgaaaaaaaaactcaaaaaaattccgaaaaattccgacttttcatcaaaaatttcggaagtcggaagtcggaattccgaggccccaaaaattttcggaagtcggaagtcggaattccgaccccaaaaatgtcggaagtcggaactcggaagtcggaagtcggaattccgtgccatccctggtacacaatggttaaaaagggtacaatcatggttttaaaattaaataaatttccttttattaattaaaaaagagagttttaaaagtacaaggattgaatatttatttaaattgaaattaattttacaaattctaatttaaaaaatacaggagttctttaataaaagtaaataaattattattttaatttaaaacatcacaaaaaaataatttaatttaaattaaaaatttttattttttatggattaaacaaaactatttatatttattaaaatccaaatttaataatataaatatttatttaaatttgaaatggaataaacctggaaaaagaatcaaaaaaa

SEQ ID NO: 36836 - DNA, 799 bp, Heterodera glycines
aaatttatggccaaaagttcttattttacctatgtataaatttaaaaaatttatgcaatttttagacaaaatctgttaacaaatcgcattaaaaatcataaaaaaatttcccggcggcgcctatcggcgccaccggacgcccctgtccaacctccaaaattttttttaaaatgtcgcaaaaaaggccttttgaatgtaaaaatggtcgccaattgtctcaatggacaccagtactaaatgtaatgcagtgaactggtgcaaataggtcattttggttattgcgctaaaaaactgccgcaaactttttggacctgttcaaatgcaattttgccgcccaaccggaatggaatgtgcgaaaaatttggcacaattttcggacagcgcttggctttcgcgatttggcaaaaatgtttgaagagaagtgagtgcctttcttactttttagggacgaaagaaattttaagtgatcgggtgagaaaaatagagtaagcaccgatggttcgcctacataccattttcggcaaaaaaaaatttttttgaaaatttttttgtgtctaaaaaaatggtctaaatgtaaggaattttttttcatgccctttgtgtacagtttggtcgccttctcattttgttggttcgtgtttcagtttgccaagtccaaaacgcgcaacgaacggctggcggttgcggttgcctacgttttggctgtcttcatcttttggttctttgaccatgccgaacagatgcggacggtggtcaaactgacattgcatgcatggcgttgtgagtggtgggcacggac

SEQ ID NO: 36837 - DNA, 810 bp, Heterodera glycines
accacttatttcaatctatgattattacaaatatgatgtttgtcacaaactctacaaaacatgatatcagtcaaatgaacacattcgaaaacattaataccacttatttcaatctatgattattacaaatatgatagtttgtcacaaactctacaaaacatgatatcagtcaaatgaacacattcgaaaacattaataccacttatttcaatctatgattattacaaatatgatgtaataccacttatttcaatctatgattattacaaatatgatgtttgtcacaaactctacaaaacatgatatcagtcaaatcaacacattcgaaaacattaataccacctattacaatctttgattattacaaatatgatgtttgtcagaaactctacaaaacatgatatcagtcaaatgaacacattcgaaaacattaataccacttatttcaatctatgattattacaaatatgatgtttgtcacaaactctacaaaacatgatatcagtcaaatgaacacattcgaaaacattaataccacttatttcaatctatgattattacaaatatgatgtttgtcacaactctacaaaacatgatatcagtcaaatcaacacattcgaaaacattaataccacttattagaatctatgattattgcaaacttttggtgtttgttacaacttacacatcatgaaatgtctgatcaaaacattcgaaaacattaataccacttattaatatctttgattattacaaatatgatgtttgtcacaaactctacaaaacatgatatcagtcaaatgaacacat

SEQ ID NO: 36838 - DNA, 724 bp, Heterodera glycines
cccccccccccccggataaactccgttcccccgtccatatattccatcggaagatcttcccccctgatgtctctttctgtatctcctccccctcgagcctctctatttctctctctctctcagaaacttccccttcgctcttccccgctccctctctcactctcaccttttggctgtgattgggcaatccttcgctttcgttcctttcaccgtttgtttccattcaccgaaaagagtgggagaagctttaaatggaagaagtcaattgaaacgaaatgttgaagttgtttgtgcttcacagaattcggcggacaatgcgccgacaatggtacaattggcaaacggagggggcgcaattggagacgaagttgggacggaagcggaacagcagcagagggacagaatgggaccagcaaagaaaaagacgaaaaggccggcggagagggaacagaacgatgatcaacagcagaaagggcagaggagggccaaggagagggaagacaaagaggagaagaaagtgggaaatcaaaggaagaaaataaacggaggggggagagtgatagccaacaaaaaagggaatggccaacggattgctaattcatttcacctgtaaactctgccgcttttaagcccggggctgcttctcttccgctcccttcaaaacaaaagccttagccggactcgtcgccgggcattgtcacaacaatggaagcccagcaattgc

SEQ ID NO: 36839 - DNA, 994 bp, Heterodera glycines
tttcgtttacaaattccttgcctttgtcgctatgaatcttttttggcgcccctagcactaaaatgaaattttttagaaaattttgtgccacggtttcagcgtttttgttcggaatgggattcgcaaccaaatattttgaaaaatggtcaatcgtaaccaaaatataatggttcgacgaatttgctggcccaattgacaaaatgtcaatacataccaactctaacggttctgaagtctcaattgcatttaaaggaggttcatttgaccgtggtttgcgagcgtgtgcgcaaactcgacatcgaagtgctgctcttatgcaatctccgaacatatttggccaaaagtaaagctcggatagttgtcgaaaaattttaattccgctgaggtgttcagcacaagtaccggagtgtctctctcttatcatcttttcacggaattctcgtggtacgaacaattgtagtttcccctccttgccacttcggaaaagcaatccctcgattaaggtataattgtgtagataagacatcaatttttggcggtcacgaatatcattcggcaagacacgtttatccaaaaaatcataaacaaaccctaattcacttttctttgatttttgggcccagtcttttctatgctcattttcaatttctttggcgtgttccgctaactgtatttctctaatttggcctataaatgcgattttgtcagactctcacagttttcagcattctccgattttaacagcgtttttgaccgagacaaaagatcggcaattatattcattttgcctggttggtattcgacttgtagtataaaacgggaattcattgctagcagccacttatcaactcggctattacccgtctcttttttgctcttaaacatagggacaagcgcacggtgatcagttatcactcttgttggtatcattgtgataaactgagcatattttttggtaccgaatccgattgctaatgcttcgagctcggtgggg

SEQ ID NO: 36840 - DNA, 975 bp, Heterodera glycines
  misc_feature (943)..(943): n is a, c, g, or t
tttcgccgccttttccgatcagtgcgccgaccgccgccgatgggatcaaaactttgatttggaggttgtctaagagaggaaagaccaattagattagcaataaacaaaggaatcaccggactcaatcacattcgccttcttcgaggccgggccgccgttttcagtattttgtcgcttctgtccaataatagagccatcaacatcttcaaatttttcctcagacattgccttttgatcagtaaatgtaccaaaataggaacttaaaagatacaattaattatacaccgaaaatggcattaggaagcaaaacaacgcattaacaaataggtaagtgggcggaacggaggttaccaaccgcaaatgcgccacactcaacacaatcgattttattatacggtaaacaaaatgccataaattctaaatacatttgaaaataaataatttaaaaattttcataagttgctttatggtacatctcggcatgcctaagatagtccatcagatcatggtaattccgtcggcatttaaaacagacgaaaaaatcggaagacgattttcgaaagtccaaataggggtagcagctgagagcatcactaaaactgggatttgataattaatgtggtttttgatcacgagtgtgtgcacctttcactgccgaacaaacaccgcaatgtcggccacaattcggtcggatggtaaaggaacgtgtgaatggccagcgaagcgcactccgagtcgcggttcgccgtctgcataattctgtgccagtctctgttccccctgctccatgtcggtgccatgccttcgcccttctgaaccatcgccaaatcttcagtggcgattttctcaatttgtttcccgcaacggccacattcactgcagtccatctggtcaaagtccaagcgcaatttctccatttttcgtgccctgaatattattttanaaagcagcataaacgcaatagagaaaaaaaag

SEQ ID NO: 36841 - DNA, 1220 bp, Heterodera glycines
gtgggagggcgggggacgcgacggcggaaaatgtgtacaataaatgggcaatgaatggggcgattagaataaataacaaacaataaaaaagacaatcaaaacataatatagaaaagctagcagatgttgtggattagtgagatttgtgatggtgatgatggtgaaaatggaccagcaggacaaagcaaaagattgatcaccctgatatgatggattccacatatttgaaaggaatgtgccgataaaaatgccgacttaacccaaaaatgacaaaatgtcaacaaatccaaaatgtgtcaaaatttgcatatatgatcatcagttttgtgcctgaactgatcagccttttgtattgttcggtcatcatgaatatgaacattggtaaaaacgatcgatgatcactgatgagtagagggcttcggtttatagttgctaaaaagtgccaaaataattagtttttcgtttctaaaaaacccccaaaatagttgctaaaaatggaaaatagttgctaaaaactttcaaatttaggggtgtaaaatcgtaaaattttatgcaaaaaggtaacaatattaattcaaatcattattgaaataataattttaaaaatcacaacttcttcaagaaataaataaataaattttggagattaatttttgaaaaatttttcatttcttaagggtgtatttttgaaaattttttggtcgaatcttaggcgtgtatttttcctttttattccatttttgttaacaaatttttgggcaaaacgctaaaatagttgaaaatagtttttcaaaaattttatagttttttagttgctaaaaataaaaaactagaaaatagttgctaataactcgaaaagtagcttaataacagccgaaaaaacatgttttcgtgcatttcaggctacggggagctcaggaaaaaaatagtgaaaaaactataaatcgaagccctattcattacagttgaagaatttggttagaatgtttaaaaatacgaatatttcgacttatacgatgtttctcgtggacggatcccgacaaatatagtaccaatcgatagctaaaatttccgattcccgacttccgaaaaatttttgtgccccggaattccgatttcccaaaaatttttgggtcctcggaatgccatccctagacaattcagccgaggacaactcagctttacgagaatttacaaaacgcaactcgtacaatggctta

SEQ ID NO: 36842 - DNA, 1625 bp, Heterodera glycines
cgtcgctttgtttttatgcaatttcccatttttggctaaattctcacgccgtttttctcggcattgcctccgttttttgccgttttttctcaaatttcaagttttgtacagactatttttggcactcgcaaaaaaattattttgctatgctcaacagaagacattattatttcatttgcgtaaaataaaatggaaaacaaacaaaaaaaaagaaaggcattttggcaattcattcactccatttatccattttcatcttatttccatcattttcatttcattcacttttggcacaatttacatttttgctcttccgcggcttttggcaaataaaattattttcgttcaatttaagtctgttgtatatatacggctttaaagtttaaacactaattgccaaaaatggaccatctttcctcctccgccattggtgcctttgtcgcccctcccacctctcccggtgccgctccgtcttcgccgtgccatcggcagctgccgctgcagctgcagctgtcatcagcttgcagtacgtatatgactgagttggaactagtcgccgaaaatattctcgtttcattgtttatttttagaaaagataaatttgacttctttacaatgactgcttcatcccgtcgtttgcaaaaggttgactaattacgggcttttaactttattaccatatgggatcagaacttgaatctcttggctgacctaaaatctcacttcagtgcttttttaaaaattctttttcatgattgaaactattcttctaccttactaaaatatttactatatttactaacaggaactttccgaaatgcgtgggaacaattcgggcgctgttcgtgttcttgaggttgatgagtctaatttgcttcgctggagccttatgctttatccggtaatgttttatacgttatagcaaacaaacaattagattaatgtgctttctttaggaccgtgaaccatacaacaaaggtgcttttcgtgtgaatgttgattttccaactgagtacccattcaaaccgccatccgtgacattcgcaaccaaaatttaccatcctaacatcgacgataagggccaagtctgtctcggcatcattctcgcggagaattggaagccggcaacgcgtgcagagcaagtgatgaacgcgctgctgtcgctgattgccgagccggaaattgctcatccgttgcgctccgatcttgccgaggaattccaacgggacaagaagaagttcttcaaaaatgcaggtggagtgtcttgctattttaatttttcttacaattaattttagaagactacacgaaaaagtatgccgaacgtcgcgactgagtttgtttggacagatggagttatttgtgcatgaaagtcccgctggtatctacgaataatctctcgccactcaaattgttcaatttataaattattgtgttttgtctgtcgttgattattttgacttttttgtatcgatttaaacttgaagaaaatatattaataaggattctttgttaggatgtggaattccagaccattttgttttttgttcgtttgtcagtcgagtttttttttttagtttttcaaaagtttcttagggcttacaactgatcgatgtcaagtgtta

SEQ ID NO: 36843 - DNA, 640 bp, Heterodera glycines
ttaatttaaataaaataatttttgataaatgctttgtattaaaattaattatttatttgttataattaattaaatattgtttgtttgatttatgtttaatttttttgatgaataaaagttttattttatttgacttttcgacaaataatttcctttcaatttcaataaatatttcatattatgcatttaaaaattataataaagctttaaaaatagagaaaaagcgcgaagcgcccgtcctgaggccgcgaagcggccgaatatcccccacaaaatttaaaaacgggcgcgaagcgcccgttctgagaccgcgaagcggctgaatgttccccacaaagtttaaaaatgggcgccaagcacccgtcctgaggctgagaagcggccgaatatcccccacaaaatttaaaaacgggcgcgaagcgcccgttctgaggccgcgaagcggccgaatgttccccacaaagtttaaaaatgggcgccaagcgcccgtcctgaggctgagaagcggccgaatatcccccacaaaatttaaaaacgggcgcgaagcgcccgtcctgaggctgagaagcggccgaatgttccccacaaagtttaaaaaccagcgcgaagcgcctgtcctgaagtcgcgaagcggccgaat

SEQ ID NO: 36844 - DNA, 1021 bp, Heterodera glycines
tgaccagaacggaccggggctaaatccgccttttgcacggaggccgccttgtctttggtcaggacttttgcaaagctaaagccaagcgcagtaaattgacaatctttgcggtttcatcaatcaatgtccgtccgacctggcggcaatcacatcgcccggcagtccgactttcatctgtccttcagccgattcaccggcgaccgtcgcattgcgcaacgtaagcgatgttcttctcgcgacgcttcaaaaacccacaaatataaatttaaaagaagagaaccgtatggaaatgtaaaacagaagcattgccaaagtgcacattttgatttttgacgaaaaattaaaaaaaaagattttaatggtactgacaagagccgatggaaagttcggtgtttttaatacccgtcgataatatctttttcctcgaaccaaatcctaacttcacgttcatattcttcgacggagtctgacgcatggcacacggtgtcccttctgcgtcccaaaatgaccgaatttgcgtacgttgcccgaatcgttcctgctggtggcacacgcacatcagcacctaagattttgcgaacggatgaaatcgcgttcggccctaaaccagatgattgatagaaaaataagtatttgggcagttgattaccctcaagtgcaactgcgataacagggccggacgtcatgtacgcaatcagttctggttgtgctccaggataatgacggcgaatcgtccttgccctcggtttaaccttctcaaataccaattagttttcaaatttgttacaaatttttaattaaaccattttcattccaacgattcgaaaaaaaggcggttcttccaagcgtttcaaaatttctgcggtcgctttttggaggacgctttcgggtttaatcagaaccaatgtgcgttgcacctcgcagcattacttttatcaaacattgccatttctgctaaaagaaatatacaaattaggtattcaaaaagtttattggaatgaagggttggatttcagaggtg

SEQ ID NO: 36845 - DNA, 832 bp, Heterodera glycines
gggggggggggggaagaacagctgctcccggactgtttctgcccgcgcctcggttttcccaaattggttgggttagcaaattgttactccgcttgtttggtttgtttttctccattggttcacctctctcccttttccatctcttttctcttccttcgactcgtcgcttttgtaccaccgtttcgctgctttgtcttcaccttccccgtggcgtccgtttcgctcatctctttcccggtttcgcgaccgctttcttggctcctcccagcggtcttcttcctcactttcagacgaactcgcgtgtccgcttgaactcgagtactttcctgcttctgggattttgaaaattattttgatattataaaactaaaaaaggtcaatcccgacacaattccacagaataaaactaaaaaaaattgagttagctcaaaaaatgttttgaaacgtcaggatattgttgtattgaacacctgcggttgttactgaactcgtcacgtgctgtccttccgccttcggttcgtatttagtcggtccattttgggcttgatattgatccttttgatgaattgtcagtctacaaaatgaagttttagtgtctaattgtacgtaatatgtgtgttttttaaatagattgcaatagacttacggaaggattatatcggacacatgcaatttgtcataattgaaggcgggctaaaaaagaaaatgaaatccaacaaaaaacaagcgtttatgtaattatcaaaaaaacgaaaattttaagcatatgatgcttttttcgcataaaatttcgtgtgaggggggtcttgggggggttagtaaaccccccccc

SEQ ID NO: 36846 - DNA, 1258 bp, Heterodera glycines
ctcagtaggcttgttgataatgatgtttaggttttaggatatttagttcccaaccctcaactaaaattgcttttgaaccacaccgcagtttcgccttcacacattttgatgcggtggtcagatttgtttcccgcagagatcaatgtggcaatgcgaccaacagtggcggacagctcagcttcaaatacatgtagaaagcaattaaaattaaggaaggaaaagccaaaaaaaaaagtggaactccaaataatggaaattgaaaaaataataattaaaaccattcgtgaaaagggtacaaactgcggtactttatgccccaactcataaaaatggacaaattccgacaatttttttccagtgatttaacaaatttaacaaaacgacttctgaaacctacatatgtacaaaaaacttcaatctttgggtcaaataactaaattcctaggctgctatatttgatgcagaatttttttctcaatcatcacgcaaaatttaaagaaatctgtaaggcacaaaaaaattctttagataagctaatgatattttttacattgttaaaatgaagagatagtatataaaactgagagaaataaaaatataaaggccaataattgaaaattctcttctagtttaaataaaaacatgaaaaatgcatttttgtaaatagaaaatgatcgctcaacgtcacaaggagtaaagaatttagatgggcttaaattttttaaatttaattttttttatatttttccatgtttaaacgggtaaaaattatcactttaaacaccatacaaggcattaatttgcatattagtgaacaaaaaattcacggtcgtttaaccgaaccaaaacaaaaagcggctattttgggaagccctaataaagacattaaaatgatgatttcgggataaaaaaagttttttcgtgcatttctcacaaagaaaggtcaccatttgtataatagtgtgtaggtcaccattttttgagtcccaggttcggattccctatatgaatccatttacaatttctattttttgatttataaaagtcaattattaaaaagtaatttttgaaacaaatgctactttttatttattccatttaaaataaaatttttaaaaaaattttttaacatttttattgagtgtcttatgtgtagggctggtatttataggtgctaaaaactgccaaaataggtaggttttaggttctaaaaacccaacgaaaataggtgctaaaaatgcaaaataggtaccaaaaa

SEQ ID NO: 36847 - DNA, 783 bp, Heterodera glycines
ccttatgtcaaaaggaatgtttgatttaggaaactttttgattgggcgcgtaaaagtcgattggccgcgtaaactttggattggacgcgtaaactgtgattggacgcgtaaaagtcgattggacgcgcaaactgtgattggacgcgtaaaagtcgattggacgcgtaaaatgcagtagagccaaaattagattatggacccgaattggtaaaatgtcggaattaaattttcaaatttcgtgtttctcgttcaaaactaaaactgccgatggtagggagggcccccctttcttgaaaaaagtcactaaaaatatatttctttggcttttcaggggcaccaaacaagaatttgactgttttcgacgaatttcgaatccctactagcattaatcatcgaatattttttagccagaaagtacaacatttcggggctgatcagtcggtgtctgaaaattccgatttcaaatttgtccaatgttttcttggccattgctcaggcgcgtcttttcgacttggaggtgggaaagacgatgatttctttatcttcttaatttaagtagagttcccaagtttttgaaatttggcataaacagaattggaattcattttaaaataaggggagggtggtggaaatttagaaaattagggtttgtcgatacggctgagcctgtaggcgctacaggggaaaaatttaaaattttatgaaatttgatgttaaaatttgattccttaaaaaaatttacagcccttaattcagaaaatcagcaagaatataaacaattat

SEQ ID NO: 36848 - DNA, 678 bp, Heterodera glycines
ccgggttagtcgcattgttgttttggctcataattgcgtgagtgaacgacacgaaaagacatcacattcaaatgaatggcacggttacagtacgccaaagggatgccaagggccctaattaaaagcccaaaatggcgggggggggggggcaatgccgcaccgaaatgattaaattcgagtgtcccaccttctgttttggtaccacgttttcacttgagtgtcggtgagtcccatccgttgtgccaaactcactctgtcctgcaccgacaaataccttcaataatttggcattttgcttattgcattttcttggttttctgtacttttgtgatccgaacatcgtttccaattcctaaaataattaaaaacaattaaaattgtttgaattttgtccgtttcgcttttgccacctgcagctgtttgtccgtgaaaattgtcctcgccttgcgcgcctttttccctccgctgccgccccctccggcgccactggcgcccgtctcagacggagttggcggtgcggacgaacggggcgaaaatcgcccgctggtggtcggcgaagcggagttgtttcgaggggcgagccgagaagcgaacgaatcatcgccggcggcgatgtcggcaaagtgattttggtgggcgaggaaaatcgaaggacggaagagatggcgtgaggacaca

SEQ ID NO: 36849 - DNA, 1172 bp, Heterodera glycines
aacataaaccaaaaccatacatatgtataagaagaaaagtgaaggcttacaattatgaattttgtaaaaaaataaaagaaacacagtgcacgaaaatcaccccttaattaattaattacctttaattggttaattagcatatgtaaatagctatttaattgggataactgggcagcaggtaaatttcattccatttcatctcttccttttcacgatcatcattagttgttttgttcaagaagttccacaaattggggctctcgaaagaactcgggaattgtttctaaaaagaaattaaattaaatgtattcaattaaaattaattaatttgtaatctctcaccatcaagttgctggatgactttgtaaattgcctgaaataaattttatttttaaagatttaaaagtattttatgccattctctaaccaataattactttggaataaattgtaaaaataaatttttaatttttggccttagatcataaatttttttgtaaaaaaaacttaaaatttcaaccaaaaatgcttaatttacctttttccaagacgattccttatcacggccttccttcaatgcattgtagaattcctttaaagtttctgtatcacaaaaagaagcctttcgggagtgtggtacttaattgaccttttgacttcttttatgttttgaatgataattatttattggcgttttattttcttttttttatggaccttaaaatattagtgagttttttttttactgttcggttcttgtttggttttttgtcttgttttctctggaattgttttgaatttcttttgatgctgacttcttctcaattgattgttgtggtctcgtctttttaattattattgttgctgtttaaaatttatcgtcgtaaattattttgttttgtttatttattaaagtgtttgcgaatttgttttgaaacaggtgctgacaagccgacagataattgtgttttgatccatttctgaaaagagacaacccatccctatccaattttgttgattttgtacaacttggcgctcctggggacaaaggtttggcttagtgacgactattcattaaaggataatatcggccataaaatttttgtgaaatcaagtgaacaaagtgattactgtaccctcgtgttgggtttaaagcatcattcggcgtattt

SEQ ID NO: 36850 - DNA, 765 bp, Heterodera glycines
  misc_feature (694)..(694): n is a, c, g, or t
ccaaatatgttataacttcaaaaatttaccaaatttcctttgattattttttccattttgaaatgctcattttcaaggacgtccttgcatccaaggacgttttttattttcaagaaagagggcccaatttcaaggacgtccttgcatccaaggacggatggcagccctgctttaaagggcattttaagtatctttttttcattgtcagctaaaaatgagcccggaatgaaggggcccgacaacggcgtggtctgttacgtgctcagaacggggttcaacacgcagcagggaagtctgctgaggacaatcatggtaagaacaaacaaagagctatcttattactggtagcaattaataattgaatgctacattgtcatagtaattggatcacagcaaattcatccacagaaacccatgttatggcattttttttacatatggatgagttgggtggtatatggcaggtggtgttgcttgtctcgtttcctgtattctcttattttagggcatctcatagttactttaatttttttgtccctcattatgggtattgtgtttaaccctcactaatttgattgattgtgagattaaaaagtctcatttttactttttgatgccccgttttgttcgtctgtctatggaatgtttcatctccactttttcagttcggtgtgaaacgcgtcagtgccaacanatttggagacgttcttcttcatcctttttctgctcatttttgccattgttgcggctgcctatttgtggatc

SEQ ID NO: 36851 - DNA, 1024 bp, Heterodera glycines
attgtaaatagtcacaaacaaactttttttcactcccaatatctaccagttatcatacaaaaaggcaatagttaagcactgagatataaaaaaatcgtctagaataattatctaaacaatttgtcgggaaagctgtataaattctcgggaaaaaacttttcaagaaaagctgaaaaattttcaatcgcatcagaagcagcctcaaattcttcaacaacataatgtaaaaaatattacgcaagaaattatttttagatcctttttagaaatgctgcataaatttttattgtaaatagtcacaaaaaaacttttttttactcccaatatctaccagttatcatacaaaaaggcaatagttaagctttgagatataaaaaaatcgtctagaataattatctcaacaatttgtcgggaaagttgaataaatttcagttgcaataggcatattggcacaatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaaattcacaaaaatttggcaccggaaaaactccatttttttatgggccagcataataaagtaaacccaaaatgtaagggaatttaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcaagaaataatttttacatcctttttagaaatgctgcataaatttttattgtaaatagtcacaaacaaactttttttcactccccaatatctacccagttatcagacaaaaaggcaatagtta

SEQ ID NO: 36852 - DNA, 987 bp, Heterodera glycines
  misc_feature (73)..(73): n is a, c, g, or t
  misc_feature (75)..(75): n is a, c, g, or t
  misc_feature (77)..(78): n is a, c, g, or t
tttgggaaattttatacgttaaaatcctctcgagcatgataggaggggcggtgcgcatcgccaattaattgcncngnngattttaaatttatctatatccaagaaaaatgactatctctattttgagaaattttatacgttacaaatgcgctcgagcgtgagagggagggcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaatttatacataacaatgctctcgagcatgataggaagtgcggtgcgcaatcgccatttaatttcacagagaattttaaatttatcttatatccaagaaaaat

SEQ ID NO: 36853 - DNA, 940 bp, Heterodera glycines
  misc_feature (893)..(893): n is a, c, g, or t
  misc_feature (905)..(906): n is a, c, g, or t
atttaaatttcatttagtttactcatttttcttttattattattttcgcatttattcaagcattttccggctatcaatttcattatgatactatttaattattaaaaaatagctttgtttaatctttttaattattaataatttttaactgaacttatggctttgacaatccttaacttgattttaaattttaaggaggtttattattctctttgtatatcatttattaccatatacaaaccataaaaaaacttatttaaattggtgatttaattaccacttttttaaagttttatcaataataaatttaaaatttaatttaataaaaattttaaataattaggcaaaattggtattattagtttctctattttaatgttttttccaaaatcttatgattcaagatttgcatttttgttaatcaatgtttgttaatgactttgataaaataaatattcgttatcgtctcattacatattactgattctttttacaacgaattaatttaatgttttattcttttattttttattgtatatataaatatctttatttaaactcatcgttatgcccatattacacatattacagagtttgtggtatcgaagttgttttccatttagtcatgttcaaataatagcaaaattttcaattatccatagtaaataaatatagtttttttgttaaataatttttaaattacatgaacgggttaacgaattaaataagttaatgttatttatttatttgatttttgtctatggaaacattttattcatttattattttatcttgtatgtttttttttacaagtcttgttctgtgtcccgtttcttaattatttgttatttatttgctataaaaatgtccaataaaattgacattgctatttnaatatgattcannagggtatgtctgtttatttttatttttaaaaatc

SEQ ID NO: 36854 - DNA, 992 bp, Heterodera glycines
ccaattcagttccatttccaggactaggtcaaaatttaaatattccaaatgaattcctcgctatgaatccggaaaagtttaaaaataagaatctcataaataagtgaaatcatcaataaacagttataaaaagcaacaaatctcattgataggatgagtcaaaatgattaaattaggaataagcattcaattggttcacctcatcaccgttggccgtgtcgcagatgcgcactttgtccacgtaagtgaatggcatttcgttggcggcgccttcagtttgttgcgcactttggactgagttggccgcctccaaaaatgtttgtccgtcggacaaaattcgaactttggtgaacaattccaaattggccacattgtcaagctgaaatatgcagccgtgaaacttttttaagtggatgcccgacttaagaaaaattacgtttttgagctgtaataggttaaatcagttaaaaaattgcaagacaaatttttaaaaaagaaagaaacggaaacgccagtccgaaccgctctcttttggcatccccggctcgttttttatggaatgagtcaaacaaaatttgtataattaatcagctcagcgtggtgcctgtccaaattttttttcaaatttctatttttaggcgatttagtgatcagagattgcgcaaaaaaaaaactaatggcgctcacttggtagcttagaatgccatctgagagcgaggggtcccagcggtgtcattgccagcgcttgcttttcccagcaaagaaaaacttcgggggagaatggtcgaactgttaagtaaaaaatgaccagcaggtgatcaacaagctacaaacgcacccttccgataaagccatttgaagaagccatttcctttggcatttttttggactgtttttttccgatttcgcaatcgtgtagaattggccctgaagggggaatcagaagaatttaatgaccaaaattcattaaaatttaaaattttttgcgacag

SEQ ID NO: 36855 - DNA, 1037 bp, Heterodera glycines
  misc_feature (1017)..(1017): n is a, c, g, or t
tgggagtgaaacagccaaaatgagtcatgcttggatcacaccatcgccataaacagaagtaaatgacatattttgctgttttcaatataattaggataatgaggggcatggaatatcatttgaacagttgttgaagctttttgtaacaaactgacctacccccaattattgctaattagtggggatatgcctttaaattaggcccgtgtctgcttcttctgctgttgctggtccctgggcttttccccttggacagtgtcagccttttggggtgttttgcttctgctctggcctctttccactccccaattttgggaactgatcgctctgttccaatttgggccccttaaataccgattagccggccattgttttgttgttgtgttatgagatgacactactcactcgcttctcccggcactgctgcggcgccaatttcagtttaatgtgtccattaccgacggagtgtcggcggctgcagcgaccgctttttgtccgtaggggtggaactttcatttcatttcattcattttaaatatcggcggcgcgatcattagagttctcctaattgtctccagcagcagttcatttctacgattagcgcacagcaaaaaccccggggcaaaacggacggacgacgccaatttgccgagggcgcccccccccccgccgcgggggtaaatagtatttcgtgtccatatttttaggccgaaataaaaattaataatgttttttttggaccgatggaattccttccttctatgatgggaggggagagaagcagaaaaaaaacactggctggaagaaaacctgtagggctggaaaatcggggggaaattttaaaatccattttttcgataaaatttaaactgtaaaatttgtttttcccgttttcttcggtgcatttaacacagtaaatggttttattgctctgttattgagcaaaacaaataaaaaaaaattctgttccaaaggtatgtcgtgaaattttacccaaattctttttcattcgctcgnagcgaaatcttttggaaatt

SEQ ID NO: 36856 - DNA, 1071 bp, Heterodera glycines
ccaatgaacggttgacccgatctcttcgtcggtgacccatttgatcatttgccgctcaattccctcaatcggcaaactgtccgttgtccgcgtaacaatcgccgctgttcccccgccattggaagtgccgggcattgccaaatggtggcacttttgttccgcttgttgttggtgaatttggtgccaaaccgactgtcgcaacagtgacagattttgctcgaccttaggaaaaaatggcacataattaaaaatgaatgaattccccggggctccgtcgcccaattcggccgcgctgttccccaacaattgcagcccattctcgcgcagacatttcagcgcggcggaaagattggccaagtgatgaacgcgctgttttgaactgacaccgccggaagagtgccgtctttggactttcctgacaattaaattacagtaattacagattatgaaaatgcaaaagtctgagtttcggcacaaaatcacccacccgttcgattgtccgttttttgacattgcgacaacggcactttccgtaatgacgagcttaataatgcaatcaaaagtaacggaactgcggaactgctattcccattaaagcctaattagcttctattttaagcccaaacactcaccaaaacttggccagtcaaaacttccaacaaacggcacagcaaaacgccgtcacgcatgtcaatgaaaaggtcggtgactctgccagaagaggaatgcttaaaggaagaagagaactaatgggataaagcaaaggaggggaaagtcaaagccaattgattgatcagtaaaaagccattttagatgattaaatgcccaaaaaggcaattaacaaaatccaaaacaaagtctaaacggaaaatcacctcttcgagacggaaattgacccaattagtgaaggttttcttctgcatttgctgttcagcttctaaattaaaatttgccaaaatattttccattttgagctaaattcccgtaaaatattttggaaagtcaattggcaatgaatgattcgatttatttttgcactctttccaaggaattaatggccaataaaacgcg

SEQ ID NO: 36857 - DNA, 818 bp, Heterodera glycines
atcaatcatttatcttttttattgttatataaatttctaaaaaaatgtttttattcccttttaaatccattttggttgatccctccaaagaacgtcaacaatcggaaatagtaacagtcattcatccgttgccatatggccatagccatacacatgtggtcccagttggagtcagatttctgagtgagacgtagctgaattgacgacgaaatccggcggatgatccaacttggattttcctgatcacccgaccgatgattgatcatccatctcaaaccttcttttgtttattcattttgagcaatcatctggtggcataccaacaacacacatgtgttgtgttgaatgccaccacacatcattggccatatggcagcagctgatcctgatcagtcagtcagctttttcactcactttaatgaaaatcacccgtattttggtgcctgatcagattaactaatcattgaatgaaattaattttaatatttttgttatgttaataatctttttaaattgaaggaattttttttgttcctgacgcatatgcaaaagcaaactttgttctctccaaaaaaaaatgctttcttttgtcaatgggcttttggccatatttttttttgcttggccctaaagtcagtctcccgcccgaatgagtttgatccgcttttatccaacatttggccaaaatgctttcaatttcacgacatcatagggggaggggggggcaaacagtgggtgatggagaaatggggcaacgaaagtaaagttgatccattcgatcaattttttgtgcagtacccctccccaaagagaatttt

SEQ ID NO: 36858 - DNA, 797 bp, Heterodera glycines
agtgattgaaatgttggtgggtggagtatcagtgattgtaatgttggtgggtggagtagcagtgattgtaatgctggtgggtggagtaccagtgattgaaatggtggtgggttgagtggcagtgattgaaatgttggtgggttgagtgccagtgattgaaatggtggtgggttgagtcccagtgattgaaatgttggtgggttgagtagcagtgattgaaatgttggtgggttgagtgccagtgattgaaatgttggtgggttgagtgccagtgattgaaatgttggtgggttgagtccagtgattgaaatgctggtgggttgagtaccagtgattgaaatgttggtgggttgagtcccagtgattgaaatgttggtgggttgagtcccagtgattgaaatgttggtgggttgagtcccagtgattgtaatgctctagggttgagtcccagtgattgaaatgttggtgggttgagtgccagtgattgaaatgttggtgggttgagtgccagtgattgaaatgttggtgggttgagtgccagtgattgtaatgcagggttgagtcccagtgattgaaatgttggtggattgagtgccagtgattgtaatgctggtgggttgagtaccagtgattgaaatgctggtgggttgagtgccagtgattgaaatgttggtggattgagtgccagtgattgaaatgttggtgggttgagtcctcagtgattgaaatgttggtgggttgagtcgcgcagtgatagaaatgttggtgggttgagtccccagtgattgaaatgttgg

SEQ ID NO: 36859 - DNA, 899 bp, Heterodera glycines
ttttttccctttcttaactttttctataataattctcctaattgcatcttttctctttcatttcgtccctaattaagagcccttcccaaacccaaaagtaacttcgatttgcttattctctccacaaaaagatacatataataaagggtcttgataataaagaaattattttaactaaattttttaatatttctcacttttatgcattccgtcaatttgtaccgattgaatccattcggcgctctgttcaaagttcagtgcttcgatcagttccatgcttccattctcgtgaatcctcaatggtcccgattccaaattcattttggacactttctcatcggcgctcaaaggaattcgctgaaattcgccattcatttgcgttatgccatccgccgtcagtttaaagcttgtgacctgcttaagtatgccattggactgatcttccggaaggccaataacaaaatcgtcagctctgtcccttcgatttcgaattggggcagccaaaggactgtcttttcgggactgaaattgctggcgttgattcggctgtgctgatgagacttttcgctccacgtcgatttcgatttcgcattggccttcctaaagcctttttcatcaggtttttcagccaattaattggacttggcccgctgagtctacggcaacaactctgaacgcatatcgccctgaatccaaccgctccttggcaaaaatgtcaccgaacaatggggccacgtcgaacggagatgactcgggttcaacacggaagatgggcattccgcgcgaggttctgaaccagcaggcggtttcagaagggtgaggggggggggatgatattgatcctttgtgctgagcttaccatgctttcatctgaatgccgctttcctaattttaccctc

SEQ ID NO: 36860 - DNA, 896 bp, Heterodera glycines
attcgtattttacaaaatattttccacttaagagttttcttgttcaatggaacacatgcactaaaataattttagttatctcttttttatttaaatttacaatgattatttcttttgtatcataaaaaaatgatttttttatgtctttctatcaatattaaatattaaaatgaataatttattctcataagaattattttttcgtttctccttagaaaagaaattaaacaaaattacttatttttttctatgaataattaatttctttgtaagaaaatttaaataaatattggaagcaaataaatatgaaaatagtttatttaaaaacaattatccatgaatgaaataattaaatcaataataataaatctaagaaaatttattaaagtaaaaagattaaaaaggattattatttattactttgttttaaattgtgttttatttaaaatgtaaacagatgacaaaatgctactatatttcactcaaacatttacttaatttcagaaagtaattaaatacatttaattaaataattttttaaatatcaaaaaattctaaaaatatttgtttaattattatttcttcaaaaaattttttgaaacaaagattaatagaaacttaaaaaacacaattaattagttcaacgttgaaattcttgtatcaaaatataagtaaattaaataagggatttaaaatattagtcaagttatcaagattaattccttctattaattaaattattgactaattttgctcggcgtctctgtttcaagaggagagttttccaacattgttatgtcatatttaaataaataagaatacgaagtagtattttgtttaacatataatttttacaatgataaacgaaataagtttaataattaacgaataattaa

SEQ ID NO: 36861 - DNA, 982 bp, Heterodera glycines
attttttgtgccgctctctttggcatttgtcgaaactcgtctcctccgtgaagcccttccccaaaacgtaaaaatgttgattaagctgtttctttaccggcaaatcgacaaattgcgccgcccgtttggtctgccggcctttgctttttcattttcaaacgcttttccaattcgatgaataaaagcaattggccgccgttttgcggcttctcgcttttcatcacttccgtactccgatgttttaattccacatgaaatgtgtccaaaatgttcgcttgagttgcaagacaaaaggcaaattgttcgttttgatcacagaattctttataaaagtcgagcaaaaatagcgccaaatgtttcacttcgatcggatctatgaaattggaatttaattgaaaagaaaaattaattaaaaaaactgaccaataaaaaccgaaacagcaccatgtattgctagggcaaaaagagaaaagcgaaacaaaaatgatttgatcatccttaagggttaaatataaaattaaaaataaaatgttttacaaaaataaaatcttaaaaataataaaaaaggaaataaaaaaatatgtgaaaggtgaataaagaaagaatttcaatgcaactgatttattggctaacaaataagctctcgtgattcaacggcagcaaagctaaaatggcaaaatggcattggattctatgattttgctgtagccaaagcttttggctttttcatgaatataattttgaaatgccttttcgatttcccccccccccccccccctcccaacgccgccccttcgcaatgaaaaccattgcaacgacccatgaagctaaaaatgtaaatgctggaaggaaatatatgcctattttatgtgtaaaataataaaaaaatgatgaagtgctgattggcattgtccataatattttctagggttacacgggtccgaaagattttgtaatttagaataattaaaataaaatattc

SEQ ID NO: 36862 - DNA, 279 bp, Heterodera glycines
ggggaattattggagagtgccaatgccaattctgccgctaatgccaaaggtttcgccctctcactgagtcagtctttgctttcccttcccttcccggcaaattaatccaattaccattcttcgcctgttaattgcaaatgcctccaagttgctccccacccttcgatgccaaaatggggggggggggggcgcttcttctcagttttcccattccctgcagatggcccctgtcattggcattccttcttccgatgccaatgccattctcttctccccccc

SEQ ID NO: 36863 - DNA, 1610 bp, Heterodera glycines
  misc_feature (1466)..(1466): n is a, c, g, or t
aatgtttcttcttcagcaatctgcacattttgttgtttcatttggggcgcatgggacgcaattgtggcggccataattacagtaattagtcactgtttacggtatttatctttcaaaatattttaaaattagaatcataaaaaagaaataaatggtctccaatgatatttattttattatatgtgcacatatgtttacaatggcaaattaatactttgaggaaataatagggtaaattaaaaatatattgcggaaatatttatttgaattatttcactttttggaaatgattaaaattatgggcattaattaaaaaattttagaatgaaaaaatgcaaatgaactctcaatggcttaacaaacagcagaaaggattcaatgcttcttactattagctgcttaaccggggctcatttcttagcaatgtttgccgacatctgttgaagagccaaaattagaggagattatgcaaatgaaaagggggacaaacactttgccaaaaagacaaatgaattttgaaattggaaattgggaacatttatttatttatagggctgctaattttatgtaagaaaatttgcgaattatgtaaataaaatatgtataaaaaatgctaaaatatgtatgaaatatgtacaaaaatcctcaaatatgtaggaaaatatgtaaataaaatttttttaatggttattttttggaaaaaaattcttcgtaagtgaaataggcacaaaatgccataaaaatgaccaaaataggcttagaatcacatttgaatattttacaaattaatttttgatatatcattttttgaaaaaaatcgatttttagggatacattttcaacaaaaaaatttttaattttttacaaaaaatttctataaattctcaaaaatcctcaaaatatgtaaaaaaatgaaaaattgtacgaaaaattgcgaaatatgtacgaaaaagtccaaaatatgtataaaaatatgtacatatgtaatatgtagaaaaatccgaaaatatgtaaaaatatgtaaataaaagtcccaacttttgttcgcaaacacaaaaaagaaagtgtttttcctactaattaggctatggagaaaccaggaaaaaaaatatgtatttacataaaattagcagccctaattatcaaatatattaaaattataaatttttgcctcgtgtcagggctaaggtcagtcagagtgaatcgtttgctttttccaatttcaaaacggcgccaatactgaaattgcggtgccggttcttgggcgaacaaaagaaaatattgctaaaaattaaaatattttaaataattttttattattcaatacttcaggcccatgatttttctttggtgaattccatgtgattgttgcggtcattgaacttattgcgcacagttcaagcagctgtggtaccgtacagggttcgaaaattaaaaaatgctgtcataatttaattatttatttnaatttgccggtgtattcttgcaatcgagtcgtttctgaggtgcccattgttggtcgaaatgcgcacattaaactcgtacaaagtaaaagaccgaaaaaaattcaataaactaaccaatcaaaaattggatcaacgataatttgc

SEQ ID NO: 36864 - DNA, 1125 bp, Heterodera glycines
tttctacggtgaccgccccactaataacgcaacaaaacctgaatggtttttcacccaactttcctactgggcagagatcaacatcgaatacttcgagcagtacattcagcccattgctgatgaggtcaagtcgttatcttcttttcatttggcttaaaattgccaattcgtttttaaaaaaatggcactttctcttcttttttatatccctcggatttcagctgttttctcacggaatatctgaacgaacagcaagagatattttcctgcaacttttgatgtctttggcctctcaaaaagtgtcagaaattattggctccgatcggattttggagaatcgacatcaattgtcacatttgatagacgagacggtcatgtttgagaaggaattccagcagaactttggctattccgaggaggcgccagtgcatgtcgtttcacaactgtgccaatcggaggaagtgctggagaaatggataaagttggagagggacactctttgggcgggcatcgacgcgatcctcgcggacgaacaggcgtacgagccgcggtacaaagaggcggcggacgtggacccggtaaattgggggggggggggcgggcggtgattagacttgtttatttaaatggggacgcgagcgacaaaagttcgccgcaaaaaaatatccatagtttttgcaactcgttacaaaggcaactcatataaaggcttacaattagacttgcttgggcctaggggtgcacccatttaaattacataataaaatttcaggaaagaatgcgaaatttctttcattttattgctactaaaattataaattttctaaaaagggttttatattaaaaattaagaaatattctcgaggacattcatcggggctctgaaaaccatttccatgaatatttgaaaatttaactgattttatcaattctaaaaatctcatttttgcaaaaaagaattaaatttaaatgagatttgttttactgcttgctcttttgtttcatagcaaatgttgttttagtatcttctgcccaattttgccgattcctttgtcattttgatgcagtcgatgtccgaaaggtaccgttccatcccggaattgcgtctgcagtgtcgtttcctga

SEQ ID NO: 36865 - DNA, 1755 bp, Heterodera glycines
taagtcaaaaatcatctcttcaattttaatgttttttgccatttaaaatttagtctttttaaaataatttatgtcagaaatccgtggtttttttgtttgcatccttttgtataatgtttatgaattttgcagaagcaatggaaaaaatatacataagcagctccaatgttacaaatatattgtgtattgttacctctcaatttttaatataattttatttatttaagcattttaataaaataaaattattttttataaatttaaatttaaaaactgaaagcttgaatttattttagagtttctcatagccaacaaaccgttgccggtgatcaaaccaaggggatgactaagctaattcggaaaaaattttattaagaaaattcaaggaaataaattcacaatttttcagtaacacaaatgcaaaatataagggaatgctttttagtaatcaccaatataaaatgcattctccaatttgtcttttcacttcttaccattttcttaattcagcaagtaattgcaattattttccgttaatgggcaaaaacaaaactcgtcacttttcagggccattaataaatgaaaaatttacaacaatattttttattttctttttttttttttgccttcggttttctcttattgattctgcgcaacagtttcaaattcatcgcaattaaacagtccaatttattattattattattgttctgttctgttcaaattgcagcagaagtgatacaatcctttagaaaatgaatggttttattgtctaaaaaaatgcagaaatattttaaatttattaattttttgatgaataatttaaataaaaataaaaaagattaaaaacccttttgggtttaggactaaaaaatgcacggtaaaggatattttttaacaaattttaaatttatcttaaatattttttaacaaaaaaatatcttaacagttttttttttatattacgacaaaataaattattatttttattaactttaacaattttttcccatttatttttctccctttagaaatgccgtcattttttgccattttttcattttcgttgctgttcattttgtgccatcattgttcatttgccgcttttttgatcaccaattatccaaatccgttaaacaacgcttcgctgtggaaatgcggcatttcctcgccgggccctttgtgcgacccggactcgctgctcaacgaaacggcacggcacgaggcattggagcttttgaagcagttccaggaccaaacggacattgatgtgggagaaacaatgaaaaaaacaaaaaaaaacatttaaaataatgatatttaaatttaatagagcggatttctcgtttttattgtattttaaaaatccaaacattatttaaggaaatcagaaaaattaaattaaaattccgattattatcatttgtcacatcaaagaaatttaaatgttgaaaaaacataaattattataattttattgaaggacaatggcgatggcagctgcaaaggcaaaggagtgattgttgggttggcgctaacgaaacagccaatcattgcgagggtattaatttttaatttaatgaccaaattaccatggaagtcgatactcattcagtcttcggacttatttggcccattccgttttatcactcctttacactgccgaacaaaatcaaaaagcatattttaaaaaattgagggatcacggctaaaaatgccaaaaccgaccaatactacctaaagatccttcacgcc

SEQ ID NO: 36866 - DNA, 986 bp, Heterodera glycines
ttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaaccgaaccagcactgcttacccccgcggaacccggcacggtcccccgaaggaagggatttaattaaattctctcctttcggggatttttttttcctttaggtcgcccgttagcgttcaattggtctagtcaaatttttcaaaatttttggtgaaaatatttgccggggttctgaaaggggggggggggggggggggg

SEQ ID NO: 36867 - DNA, 777 bp, Heterodera glycines
cctcagagagaagatggaaaggttgcgattggcaaccatccggtgctaccagaaagggaagttggtgtgggcccgaaaaataggaatacgaaaattgccgagtttaaacttgtcccgtggaatggagtttggtcccaatttgccccttccaatttaatatttaatttattctttaattcctcgtttaatcctccatttcctctctctctctctcaaatcgtccaaattccataactaatttatttgttgaaaagaaaaatattccataattaatttatttgttgaaaagaaaaatattaagtgtgaaatgaaagtgtgcgaagtttgattaaatagaaacgatcgatcgtctgaataattccgaaataaatatgatgccaaaaggaaggaaggaccgaggaatcacggacttcggttcctttagtgcccggagggtatgggaatggtttttgcggaaattgaatcgtaaatgtgtcctgaaggtggagaagggactggggagagttaaaaacggggacggagaagaaaatccttctccggagttttgctcgtaattgaccgggggagctaactgatcttccgtttccctacggggaaaaggatcagcgaaatgctgatccttaatccccgccttcttttgttactgtgtgtaagggggggggacaggggtactgtacgttacattgtcataattgaaaaaagtattatttatttagatgtttaaattaaaatttctaatgcaaaaaggacgaaaaacattttttaaatttttaaaaa

SEQ ID NO: 36868 - DNA, 737 bp, Heterodera glycines
ggtgaaatggcttaaaggaagttcaaatactgtgcttgtttataagcattcctttgggctacccctcggtgaaaattgcaaaaaaaaaaaaaaaaatttttttttaaacccatcgccaaaaccacgacgaagacgatgcctcactttgcttaatttcatcgcacataaaagtgacgtgttcattgggattctgtccattattcaactgaaaagcaaatcatttttagcgacacatttaagaaaggaaaatttgtcgaaattgaaaacaaatttgttttacaaatattcgcactgtcccattttcagactcaccacgccacgtctctccaaaacaaaaaagtttaatgtggcgaagataaagcggtacgagggagggggggggggggtcgttttggcaagaggacgaaacaaatcgccacccgaaatttaaaataacccaattaattgtttgttgtgccttattaccataatttccaccaggtatgtctgttccttgagaagcacagcccaaaatggtgaaagtgtgcctgaattggaaatgaattaatgatgataaacggcatttgtcacactgactcatcgtaacgaattgaattgtgacggacgaatcggtgccatcggttggaccaataattgcgctcttttccaactaaaagtgtaataagccaaacaaacaaacgaaaatcaatgagtagaacaaaaataaatgaccatcaatccgcccgcgtttcattgca

SEQ ID NO: 36869 - DNA, 937 bp, Heterodera glycines
  misc_feature (824)..(824): n is a, c, g, or t
  misc_feature (905)..(905): n is a, c, g, or t
  misc_feature (911)..(911): n is a, c, g, or t
aaaacaaaaaaatcgattttttcaagtgtccggtttggggtactcaaacaattatgggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttanaaaggaattaaaaatttttaaaaattttattcatctccctttttgatagaaaaagcatcagagtgcctaaactaacatgtnaataanattttggtgcgtttcagaaccctttc

SEQ ID NO: 36870 - DNA, 1501 bp, Heterodera glycines
cccttgcccaacttgtttcgtttccatggcgcaattcgatgcgtcctccgcttgaaccctcccacacaatttcccattcaccgaaacgactgccgactttggtcattcactgatcggaaaaggcatccgatggcacttttggagcttataaattgtggacccaatgtgataaggaaaagtttaattggttttgcttgggagaatcaaagtgacgaagaaggaaagacggacaaatggccaaagggacggaaattaacaaaaaaaagtgaaacgaattggccaacggggaaatgcccgcggggataatcagcggaagaaatgccaatgccatggcaacgaaaaagggcattatttgaaaggagaaacagctgaaaaagacgagctcacaatcaaagaaagtttaattgttatgcatttattattagcaaatttaaagtttgaatggaacaaaatttggaaatcttttgggttggttaaggcatttaaaggggggaggggaattaaggagaaaatgaggggaaaaaggaaaagaaatgaattcggatgggatggattgtgacgagatttgtgctttggaagagaaatggaggcgaatgaacgaatcaaaaacaaaggacggcactgaaatgggaagaaagaaacaaacgacggtttttggacgctatgagtggacactgtaacaaggggacgggtacggtaatggtccagagtgatactgtacataaaatgaatgttattgtgcccttcttcttctccgtgttcttcttcaactgcttcttttggtcattacgagttgacattctgatggatttggtggagctgtgctcttccaattggcatcatcacatttgtgatgaatctgacaacggccgatgccggctgatctgaaaagcaaaaagtgatcagaaaatagctgagggacgtgccgggatcaagctcagcaaaaagatggcacgcgttgtccacacttccgctgtggtcggacacaacgcatttgcgggcgacgaagccaaaaatgggtgcctaataaaaggaaagattgacacttttggcacattggaagcgatcatttgggcaaccaattaacaactcgagaaagtgacaaattagctgatgattaaaaggtgctttacctgacggacatacgtcggagggagttgggacacattgttattgtcgaacacgcgactttcggggtcaatgccggcgaaagtcactaaacggaaaagcaatttctttacaatttggggactcaatttgccgcaaggactgccgtgaatttaaaataatatttttaaattatccaattaggcatattcggcgattacctttgttggcggggtaatggcgtcggaagacatcgaccgcgtgttgtcctgaacaaaaggggtaatggggcgaagaggccatttccatgctattagtagcatcagtgcactcgccaacatattcttctcatattaatgccattcccaaacttttcatcccttcgctaattaat

SEQ ID NO: 36871 - DNA, 1635 bp, Heterodera glycines
ctgatccaaagttttattcataaatcttgctaatacttctctttattttcaaaaaaaaaatttcaaaaacttcctttagtgcgggaccataaaaacattggcattttggccggtcattcactcataaatttggtcattgacgagtaaaacatccacaattagtatgattttcggatcggcaattaagcaaattgatcattcagtcactacattggtcatcttatatatttattgggtaatctattaaaatgagccgacaataatatcataataatcaaatccttttgaattaattcaattttggtcaatagcttccaaaattgtggcatttcctttttctgatcgttgatccaatgactttctgctgatcacttgcactgatcagccatcccttcgcggcgtcgcctcattggcattgttgttgttgcccatcagcagaatggtgccattgcgctgcttgtccacattgggctgcttctgatcagccagcgaagaaccattcagtttctgatcagcactacggtatttggacttgccaccaccgtacacataggcgtggaggaagaagttgatgaacagaatcagatacgatactgtatatgaaggaaattttaaattttttttaaaaagtcgtatataattatttgtttttatgcaaaactagttaatttttgtttaaattggacctaatttcataaaaaccaagttattgattgaaatttatctaatgatgtctatcaaaatttcattagaagtttttttaatttatgcccacaaactgatcatttttggacagaaatttgtagaaaaattcccataccaaaaatttttttgacaaataactttaaaaaattaacattatgtttaatggccaaatattgtttacaagttcatttttctctcggttttcgttaccgtacaccaacataattaacaacagtaagaaaaaagcataccgtccattgcgacagcaaaagtgaacactctcgtgtccaagtcacagctaaccttaaaaaagacgaaattaattttttatggaatgttttgttttttaaaccagatactttttccacgaaaacaagccaccccaggtggcacagaatggcgacggagatgatgaattgccaaatttgaatggtggtcacaaatttggccattacaccttgttggaaaaatatttttaaatttatattaattattttttcgattaccgggcacacgccatttcatcgaccgcatgaagtagtactgtaataaaaaacataattaattagaataaaatcaaatgcaaaaaatagatcattgagttggcaaaaattatcagaaatttgaatgttttcgttggaaaaattggcataatcagaaaaagatgaaaaacaattgttggaaattgaaattttctgtaaatataaaaaaagggttaattatttctatttaaattggctaaaatgaatttattaattcgaaaatgaaatattaaaatacgaaaaaaaattgggatcacaaattgtggtgtaaattttcggaaaccattcttaagaattttgctttttaggtattatagaattttaagtcattttaggagtgaatttttatttttatttgttatgggaaattttgcgaaatatcaattaa

SEQ ID NO: 36872 - DNA, 595 bp, Heterodera glycines
aaaatttttaatttttaatccgatttattaacagattttgtccaaaaatgaccaaattttgccacaatcttatattttcttcgtaaaatagtgatattctgacataaaatttcaaaattatcttgctttttatataaaaatacttatttttaaataatattaaaaataaaaaacaatcgcttattaaataaattttttttaaattggtccaaaattgccgcggagtcccaaattccggggactaggtcgttttggcgccagcctcagtttttttattataacttttttctttgtcgaccaaatctaacaatcttggtatcattcgaaagcccttcacaagctctattagccttacaaaaaaaacaaaaaaaaatttagcctgtaaaaaagttattaagaaaaaacttcaaaaatttcgacttttttgcaatttcatgttataaattttttggtaattgtctaatcgcgaagtaatagcttagaaatagcttctaaacatgttaagctttcgaatgataccaagattattggatttgtttaacaactaaaaaagttatagtccgaaaacttgagctggcgccaaaacgatacggac

SEQ ID NO: 36873 - DNA, 776 bp, Heterodera glycines
aagtgcaaaagtggtggtgtctgcaaaaaattttccaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttaatgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttcta

SEQ ID NO: 36874 - DNA, 1210 bp, Heterodera glycines
  misc_feature (1076)..(1076): n is a, c, g, or t
aaaagagatagccattttctgagaataattcacatttccgcagctcttgcggtaatgaaaaattttgaagaggctctgcggaacagattagcatcggggttacgagatagaatattgtcctaaaacgagatagccatttttctgagaattaattcacaatttccgcagctcttgcggtaatggaaaaaattttgaagaggctctgcggaacagattagcatcggggttacgagatagaaaattgtcctaaaaagagatagccatttttctgagaattaattcacaatttccgcagctcttgcggtaatggaaaaaattttgaagaggctctccggaacagattagcatcggggttacgagatagaaaattgtcctaaaaagagatagccatttttctgagaattaattcacaatttccgcagctcttagggtaatggaaaaaattttgaagaggctctgcggaacagattagcatcggggttacgagatagaatattgtcctaaaaagagatagccatttttctgagaattaattcacaatttccgcagctcttacggtaatggaaaaaattttgaagaggctctccggaacagattagcatcggggttacgagatagaaaattgtcctaaaaagagatagccatttttctgagaattaattcacaatttcagcagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaaaattgtcctaaaacgagatagccatttttctgagaattaattcacaatttctgcagctcttagggtaatggaaaaaattttgaagaggctctccggaacggattagcatcggggttacgagatagaaaattgtcctaaaaagagataaccatttttctgagaattaattcacaatttctgcagctcttacggtaatggaaanattttgaagaggctctcccgaacggattagcatcgggggtacgagatagaaaaatagtcctaaaaagagatagccatttttctgagaattaattcacaatttctgcagctcttaaggtaattggaaaaattttg

SEQ ID NO: 36875 - DNA, 1178 bp, Heterodera glycines
  misc_feature (29)..(29): n is a, c, g, or t
aaaaaatggtgtaagtaaaatcgtattancgctcaaaaagcttctcaaacaatttagcgctttccaattccttctacatcgccctttatacatcccattatgagcgctaaaattatcagagtgccgaaaatcgcatgtgatctaagcctagaaaaaaatggtgtaagtaaaatcgtaattacgctcaaaaagcttctcaaacaattttaacgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgataaaattatcagagtgccgaaaatcgcatgtgatctaagcctagcaaaaaatggtgtaagtaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatagcctttatacatcccattatgagcgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgctcccattccttctacaatcgcctttatacatcccattatgagcgataaa

SEQ ID NO: 36876 - DNA, 968 bp, Heterodera glycines
ttttattttttttgttgtaatacctgaaaaccgatgcaataatccgaccattggacggacgtaaaaaacgggcaacagaactcattttaacaattcattggcacttgacgaaacatatgaatgataaaaaatgaacatttattgaaaataggacttaacaaaaggaaatatggtatttttccacattttgacaaagtataaccttgcttttggtgtgtcaaaatttatcaaaaatcaaaaaattgggctcgcgtacaacacataggtatattgtccgcatcaacaacaaaacaattgatatcatttcattcattcaatccttaagcccgtcatcagcaccttcgcgagaagcgccaccaccgccgccgccgaggctgtacatcgcgcctacaatttttttttaatttaaagttttgcatagagtttagcaatcacctggcttggacaacgggtagatgctctccaagttgactgaacaaatgcgcggggagcgcgacccgtccgcgttcagctgaccgccagtgtagtgaagacgtccggtcaagtaaacacgggtcccttagcaaaaaaaaacgtaaatttaaaatggatggggtcccttagcaaggaaaaagtaaaatccctaaatcggacggttccttagcaaagaaaaaaataacgtaaatttttaaatcgggtgagctggctgttgcagaaaaaattgtataaaatccccaacaaaatgtgcacaaaacctcggtcgacgttcttctccacgtatctggccatgccaccgaatgcgatcacgttgtgcacctccgtgcttgtcattgtgcccccgctggacagccgacggtccacattggtgtacagattgaacgacgcgaaggctgacccttgggcagtctgtttgaccacccgttgtccaccgacaccaccccaacactccacacggttgatcctgcattggaaagtggaacatcaaaaat

SEQ ID NO: 36877 - DNA, 942 bp, Heterodera glycines
tctaattccaaaattaatttgtaactgtttgttttcaatttctctaattttattccgttctttgtcccaccgaactcgcactttcctctcccctccccgcccccttctctcgctcctttctctcttccatttccttctgtctgttcctttctctcaacattccccattcttttctttcatttgataccaacaacttttccttatcaagacattcgttttactcctttcgtattacatagtcccactaaatcacccccccccccatccgcttgcatcgtttgcattataaatccaaccaaatgccttcgtgcaattcttattgttagctaaacgaatctccttgccaagattaatttaagttattaaaagccagttgttttataaagaaagacaattaaatgatttgttccttttttgggtgttccttaactcattattcatttaaagccattaccaaaatatcctaaatacatttttcacacagttcttaatgcatatttatctgtgtaaaagtgtctcctcccgtttatttgccgtttattgattcatttggggggggcggttgggcgaatggaagatagaacattttcaccgctcacagaaatcataaattttaattatagaaattaaatttggcagttaatttgtcggctgtttttaaaaagcaaaaactaacgaaatgaacttttttccgttgctttccttccgatgaccaaaggcccaaatgtgtcgatcgatcctcgcctaatcccaagcaaaatattcgaaaaacagaaattcacaaaaaaatcggtacttgtaggttttgctactcctcccccataaaaatgtcacaatcccaacaaaagaaagcactttttttaacacttgtcataagacacaaacaaaaaaagttataaaaagcaaaatttaaaaaatatatgtataaaagaaattgccatt

SEQ ID NO: 36878 - DNA, 926 bp, Heterodera glycines
  misc_feature (867)..(867): n is a, c, g, or t
cccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaaggtaaaaataaagtagaggtatatcgaagctattcccgaaggattcggactccttataaatctgggcgcatcggttcagggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatctggtgcgtttcagaaccctttctgaaaaatatttaagaattaattttgcaaaaataaataanaaacgaagactcagattttcgaaaatttttttgagccagctagctcggcgctcatttca

SEQ ID NO: 36879 - DNA, 921 bp, Heterodera glycines
tgttaatttcaatttcttttacagaagaaggcagaattattttttcattaataaaagttttcgtggcaataaaaaatcatattcaaaaagcgttggttacgtacaacatcgacaattttatgaaattttcttagcttataacttggtgaatacttcagcaaataaaaccattttatgctcattttgaagggaaaattctggagaatattgtaagttttatttggtttggccttaaatcgaggacttggctaaaaagaattaaaattatgaaatgttcgtccctttcaaaaaatttttctagctttttaaatttttttaaattttgcatagaccaatattttgaccccctctagcgattccaagtttattttgtgaaacttaagtttttaactcgagatcggctcttctatttttacaagggaaatccaaaaaaaattttaagttttgcaaagttttggcgttctgattactaaaaataataaacttatttgtacttggagcccaaaattgaatcgccgtgtccagtaggtattattactagggacgcgatttctagtgaaaaaactttttttgctcgtttgatttgaagaaaggagctcaaaaaacgcatttctgcattaaaattttttcatttggacgtcatttttcgtcactagaaatcactatttggcgtttcgttacttaaaatagtgaaaattcacttttttgccgttttgtcactatttttcactatttcgacattttttggaaaatttgttaacaaaaatgcaataaaatcaaaaaatacacccttaagaattgatctaaaaaaatttcaaaaaaatacatccctaagaatcgaccaaaaatttttttaaggctctactgcagtttacgcgtccaatcgacttttacgcgtccaatcaaaagtttacgcgtcca

SEQ ID NO: 36880 - DNA, 1215 bp, Heterodera glycines
ctaatagaaaacacttagtgctatttaatgatatcaagaattaaaaatttggatgcttttgaacaaagttatatcaaaaaatattttcatttgatggtttttgactaacgcccattatgatggttgttgactaacgtcatagcaccttaaaaaactgtgccgattttcaattatttttagcactttttttaagcatcgcttgtccttattttatgaatgtcttatctacaagtactggacacccaaaaagtttccaattttcttcatttcacccaaatctaatcgcgtaaatttttagattttgtcaaattggaaaaatgtgagaaaaaataccgtgtacaaaaaaaagaatatggcgttgaattgccggaagcccacaaaattggcacgagatttaattagcctctgggaaaaatgtttagcgaatttcggaaaaaaaattaattaacaatgatgaaatattttcttacattgacgttatccaatgggaaaatttataaatttaaattgtcatagtttttaattaagtatgaaatattgaaaattaaaacttggtgagaaaaagttactaacatcaattctttttgtttttcggcaaataaaatttaaataattaggcaatatttttataattcaatcacctttgaactgttaaaaatgccctcaattaacaccagctcgcagaatacaattatagaagatgtaaacccaaacattcattataatactctagttttttttaaattaagatttatttggccttccgtttcgccggtccgtccgccgatttgattgtgccggccgttgcgctgtatttggttgcgttagttggcattgtgatgaacggcacagttttggtggtcactgtcaaattcaggcaaatgccatggcatttctgaatttaattttaaattttcccatttaaatttcatttttccatttaaaatttttcagttccctccgcggctccgccaattttctgatggcactgatttgtctttgtgaattggtccaccaaattgggcacatttttttcctggttgttgtcatttcgggcataaattttgtcagtttgctcactgctgacttaattatggcggtaatttttttttcaaatttaaatttaaatttttcaaattttagccttcgatttttgctttaaattgcggattaatggcaatgttttgcgctgcttttgaccgcctctttactgtt

SEQ ID NO: 36881 - DNA, 886 bp, Heterodera glycines
  misc_feature (827)..(827): n is a, c, g, or t
ctgaaacatacataaagtttgaaactatttccttggttaaaatttttactcgttgaattgcttcctcgatgtactggtgaattcgtctttggatttcgggatcggcaagcctctcctttgaacacactccttttccgaggacaagttgcacagtttccaatccatcttcttcgattgcgcagacctagttacgaaaaatttaacgaattgaaaaaggtttttacgataaattccgctgcacgacgagcaaagtgcatgtcgcactccattccaggtacaaacggggccgcgaaaaacaacaattcagcggcggttgatccttacaggaaataacttcagtataagtattcttcggtaaatcatttaccaacaaaatactccacaattacgagaatttgttgtctgttgtagctttcacggcctactacgaccgttttcccattgtagggatagcgctttccgtcctcctttacgtcaacgcctgccgcggcagttatctgaaaaacatttgtctgggtccgatccccgcctcaacctttgttacttacaaatctaatttacttgcagtccttgtttcttctacaagccacagcatgccctgcctcgtggaatgaaactcggtgaatttcacttacgatctctccctgcatctaaatgccgtcacgatttttttctgaaacatacataaagtttgaaactatttcaacggttaaaattggataacgagatacgaacatagtttgaacaggtacaaccactgttagaagaggtacaaccatggctggaagaggtacaaccatggttagaagaggtacaacagtgattanaagaggtacaacagtgattaaaagaggtacaacagttattagaagagggtacatagtga

SEQ ID NO: 36882 - DNA, 1000 bp, Heterodera glycines
  misc_feature (17)..(17): n is a, c, g, or t
tgatagtgaaagcatcntgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaaatctttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaggaattaaaaatttttaaatatttattcatctcccttttgatagaaaaagcatc

SEQ ID NO: 36883 - DNA, 1006 bp, Heterodera glycines
tattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcccaccgtgaatgttatttttattgaatttctgaaccggtttgagtaaattaaaatagaaaaaaattggaaaattttgaaatcatgttttcccactcccttcctcccagggggtattatttttgaaaaagtctttttttttccccaataaaatttg

SEQ ID NO: 36884 - DNA, 895 bp, Heterodera glycines
ctctttgtaggtagaaatttgcagaaaaagagatagtcattttccggggccggaaggaaaaattggggaaggctgatttagagataaaattcgaaaaggacaagctaaaagcagccttggcctttgagtcatgggcttttttgccatttgctctttgtaggtagaaaatttgcagaaaaagagatagccattttccggggccggaaggaaaaattggggaaggctgatttagagataaaattcgaaaaggacaagctaatagcagccttggcctttgagtcatgggcttttttgccattcgctctttgtaggtagaaaatttgcagaaaaagagatagccattttccggggccggaaggaaaaattggggaaggctgatttagagataaaattcgaaaaggacaagctaaaagcagccttggcctttgagtcatgggcttttttgccatttgctctttgtaggtagaaaatttgcagaaaaagagatagccattttccggggccggaaggaaaaattggggaaggctgatttagagataaaattcgaaaaggacaagctaatagcagccttggcctttgagtcatgggcttttttgccatttgctctttgtaggtagaaaatttgcagaaaaagagatagccattttccggggccggaaggaaaaattggggaaggctgatttagagataaaattcgaaaaggacaagctaaaagcagccttggcctttgagtcatgggcttttttgccattcgctctttgtaggtagaaaatttgcagaaaaagagatagccattttccggggccggaaggaaaattggggaaggctgatttagagataaaattcgaaaaggacaagctaaaagcagccttggcctttgagtcatgggcttttt

SEQ ID NO: 36885 - DNA, 947 bp, Heterodera glycines
  misc_feature (51)..(51): n is a, c, g, or t
ccggggatcctcttctggtcgaatctaatggaggcattaataaatcaattngggttactccccgcattcaaagtaaacaaaaaaaattcccgaaaatatttaaaaaagtgacgaaaacttcgatttttaagagtttatttttcaatttcttctatattccttacaaatttttttaaaaatggcaaaatatgtataaaatatgtgccaaaccctaaaataagtgcgatatgtttttatgtgcaaaatgccaaaacatctgtttttatgtttttgaaatgataatctaactaagtaataaaaaatgaaaataactaaatttagctaaattaattaaaatatatgaaattaaaacttcattaaattttttacatttttgaaaaatattaaatattactttaatgttgctaggtcgtttttagccaaaaaattactattttgggctccatttttcaaaatatggtaaaatggaggttcggcggtgacgataggcgccaccgggaaaattttttgagtattttaatacaattttttaagacaattgaataaaatttcaaaaaatttactgaatttttttagaggacattgcgggatttgagcaaaaaacaaacaaactcaaagaaaagcaaattttaactaaatattagagaccggaattttgaaatggccgggaccgggacttggaaaatcgaccgggacgggatcccgggaccgggactcccgtttttccaggatttccggtcccggtcgcaatttttggaccgggatcccgccgggaccgggactttttcaaaatatttgaaattttgattaaaattcgaaaattttttttataattttaatttttagcttataattatattaagcctgtaaatcggccgtttttgcttttcaaaacccttttttttacggcgcattttttcaaaaaaaatttggctacgggggggggg

SEQ ID NO: 36886 - DNA, 886 bp, Heterodera glycines
cttaatagtgatcactgatcagcgcttcattttagtagcattttatatccataaatgccaatttttgtcatatgccaccaaaaattgatcagccggttaattgatccactactattcttaatttatgacacaacattttcttggcattttaagtctaaataaaatgccaatcaatgctgagtgtgccgtcaaaaatggcacattgatcagcaattccctggctaattattccaatccgtgttatggtgtttttgatcacagtgatcactgatcagagcattcatttaactgatttgatgactagcggccgacaaccacttttttggcatttccagtctaattacttcattaaaatgtcaattagtgtttggtgtgccgcacaaaatggcacatttaatcttcaggctcattaatcataacccgtgtgcccagtcttttcaggcgcccgcacttcggtccgcggcccgcgagtttggccgtcatttggccggcacattgagcgccaagcgtgaaggctccaccggtccggcatcatcaaccgcaatagttgttgatggcacagcgtcacttcaaatcatggacaggcacaaaagtgtgaagaaaagttcgtcgcccagttccatcggtagcatactgtcaccaccggtgactaccgtacctaccgtacacaaacaacagttgcctgtgaccacggtagcggccaacaaatcgcaacaacaacggatgcgcacatcgccgatgtcgacgagtacgcattcgaattgaggaggcggcaaaaaagcggggacggcacggcacgcggcacacaaaacctaacgccacaacttttgggatggggcaaaagcggacacgcgcggcacggcacaaaaacataatgccacaactt

SEQ ID NO: 36887 - DNA, 923 bp, Heterodera glycines
  misc_feature (917)..(917): n is a, c, g, or t
ataatgcgcgcccataatttacatttttctcactgtctgacttcacgctgtctgcactcctacatagatatatagacaaaaaaaagttgggcaaaaacgagttgggtgtcgtcctcaaaaatgctaactggtggcaaggcaaacgacgaaatggagccagaaatgactgctttttgctgctattttccgtgcttattaagcattttccatgcttattaggtgcttaattatcattttggtgcttaaaaatcatgtccctacttaggaatattgctttttagtagagatcggattttctggatccaccggaccggactgatattttcagaagcaaacggtttccagatccgttctctcaaaatccgaccaatccagattttcaaattgcctaattcggaaccggtttcaagattgataaaaattaaaaattttacatgtaattcagcactaaaattgaaaaaaaacgtgcaaaatgttaaattttggctctatttaactattggagtcaataaattacacctttattcaaaaaacctaaaaatttttttataatttaaagaatttatttagaaaatttaagatttttggaatttttttttagaaaaagcaatttatattaaaaattgaaaatcgtttaaaattttttaccaattaatttattgattgtgtcatgaaaatgaaaagaagtggaaaaaactacaagtgaaaaagtgcaaaaatacaatatcattcaactttcatagaaaggtgaaaaagtaagtggaaaaattatgataaatggaaaaaagtgaaaaaagagtaagcctgattttaattgagtcataaaagaagaaaaaagatactaactcagagatcgcattcgtcctcggatgccaaggacgtccttggattagggcctcgctgatttgaaaaattgnggcgat

SEQ ID NO: 36888 - DNA, 586 bp, Heterodera glycines
aagaaaatggagaatgggccgggcttttataccctcacaaatcaataggggcggggccaggcacgtaaaaatgtgcacaaacagatggacaaaaatccataaaaatatgatgaagagaaaagatgactcataattaaggagcgagcgaatggaaaattgatcgatgaaaaggatcaaaaataagtgaaatttcatttgtgtcgcttttggcgacaagaatgaattttagtcaaaattttcccacttctatgggatattaaaaaaatttcaggacaatttaaggaaaggccatagccagaaaaaattttttctgatgtgggaatccaaagcccttttttgttttttgacaggaatttgtagcggtttagcgccaaaaaatggcaaattctagcagtttttactaaccaattgcttggatttaattttagcaaaaaaaaaacagctcaacgaacttctgctgatatgcggccgtttttcaaacaaggccccatgaacaaagcattgcggctcggaacttatggcacggaacattaatgtgagtattgatctggctaatttcgaaacttgtttaaacaaaaattgaaaa

SEQ ID NO: 36889 - DNA, 1090 bp, Heterodera glycines
  misc_feature (1065)..(1065): n is a, c, g, or t
cttatccgtttttttcgcaaaaattcccgatctctaatttcaactaattcaccaattttcctttcgttttaaattcaaaaatcaataatttgactaattcatgaaaatttaatatattcacaaataatttagacaaaaacccaagaaaaaaaacaaaaaattatcagaaattcattttttgcacaaaatctgttaaccgacccatccaaattttcaaaattttttccggcggcgccttataaatgacaagaaattgatgaatttgattttttcaaatgaaaaatatgtcagttaactgattttggatgggcggaatggggggcaaggatgattggggaaggaaatggcaaatgcaccaatttgtaaggattaacagcaaagcacgggttgggtcgacgaatgaggtttttcgaaatcatgctaaaacattaaattcaacatcagcagattatttcgactatttgctgcaaatgactcttttgaaattcgtctaattttaaattaacaaaacaaattaaaaaaattaattcgtttgataggcaatcggcggtttcaattaattcaatgaaggactcaaattgggactcattctgccgcgctcaatagtacgaatttgtgccgagcaccaatctcttcttcagaagcattaccaccagagaagagaagaagctgaggagggagatgaagcagccgacaagcaaaacgaagaaactgtagtggagggaacactttgcgacgggagacgacgaaggcgaagacggggaggaggtcaaatgggagacgaagtctgaccaggccaaagcgattaattgggtcaaattgatttaaatgattactgtcattttcgctgcatcctctgaacaaataaatgacagcggcgaccgatgccaaagaaaaagtggaaaatgccaatgccggaagagcccaccgaggtttattctcccaaccggagaacaaatcaaacagaatgaccagtgaccagaggaaggcgaacagtccgacgaagacaccaaaaacacataaaatggagacaatccgttcgaagagagagacattctgaggggngggggggggtaaaggataaaggggg

SEQ ID NO: 36890 - DNA, 1256 bp, Heterodera glycines
agtgccattgggcgcgcgtgtgggttcatggctgatttgcagcctttgtgacttaatcatttctgatcaaattcagtagaattaatcatttgatgctatgagttccagggcgatctgagtcgagcatttaaacaattttgtttttattgtgctaaatccggattcattggcttatttatcctgctgctcatatttttgtgttattttgcctagtcatctggtccctagctgatccataccatgatcacattttatcatttgccttatccttctctcctctgatcggcaggtatcagttctttctccaacttcggcacgacattcaaacgggccgtttggactgtcctcgagaggctgtgatcgatttggctgcattggcattgcaatgtaatcgctgatcagagaccttaatgccaaaaatggtcactcactttccatcttatttagccgagttcggtgacttcagtcccaaagagcactccatggaatttgtgtcagaatttcgctttcacccggcccaggacgagcacatggaacgcgacattttgcacagctatgccaccaaatgcagcggaatgtcgccctcccaggcggagttggcatttctgaacaacgcgcgactgttggacttctacggggtggacatggtcaaaaaacaaacattcataaattaatttaatttttaatagggaaatcctgtttttttttgtaaattagaaaaaatgccattttcagcatccggtggagggccgtgacgggaacacctaccgactggggctgaccccggtcggcatgcaagtgttcgacgggcgccagaagatcggactgttcgtgtgggaaaaaatccaacggttggactttcgtggacgaaaattgaccctcgtggtggaggaggacttggaacagccggtgagccaaatatcgcaattttggggggtttatacagtcagaaggatgcttatccaatttcatttaatttttgaaaatttgtccgtttttatcatgagagtatcctgcaatgtatgatagtctgactggtaaatgctcgagtaatttgccaatcccggtggatccgatcagtcctttcgggattagtctcgactcatttctccgtccaaataacttctaagaggaattcaaatctctttaatacatccaaaataatttattattaattttctttaattgattaaccccaagttgccatttgctttcttatctgttttcgttttttggcattttccctcttttcccat

SEQ ID NO: 36891 - DNA, 1269 bp, Heterodera glycines
  misc_feature (32)..(32): n is a, c, g, or t
atcttataaaaatttgatttgttttttatttntggtttttataaatgctatatgctaaaatttatatcatttcgaatttttcaaaacgataatattggggtagaaaatttaattcattttattattttgttaaaataaacaaagcaaagtaagctcaaaagcgcaaatggcaatgtaaaatgtcataaattcgttgatgtaactcgcaatgaataaatgttaattttccataagaattcggcccaaagggcaatcaattatggcataatttgcccgatcattttgatctcttcttaaagacgatggatcatttcctccacccaatccttggtgtttctggtgcccacgctgtagtccgaccacatgtcatcgtaaatgcgctcaacgtcctcgtaggttcggttgtaaatgggtccactgattttcaccggatgtatgtccgtgtgacggccgaaagtgtcccatttggtaccattctggcgaatttcgtaggttttgtgcacaatttggccacactgctcacatttgaattgcacctccaaactcttttggacaacatctaattaaagtttaaactgaattatcaaacattttggattaaatattcgtttaaaaaaaatgaatacaaacaaatataaaacaattctatacctccgcatatttcctcttctgcattgagaacgaactctgtcgcgggcttgaaaggccgaggccggtcaaggcggacaatcccgcacgattgatctttcgcattccacccaatatttttgcgctatcatgatcatcatcacagtcatattcagcctaaacgcgaaaataaaattttattaaaataaataaaaataataatttaatattaaagtcgctgtcttttgtcactttcattttaattgaaccatctatacaatgattaattaccacaatgaatttggtggcaataagctgcgaattggggcatgaacaattgctctcagacttaaagcctccataatcataggccatttgtcaatgtgtgattcaaagtagttatgtctattatgctattgagtaaacattaaatttgaattaaataaaatttaatatccaaggcacaaaataaaattatgttttgaaatgaagcgctggggaggtttaagcgcgtgcgcgaaattaacaagacgagcataaaagggatgtatgaattttccggggttccattgggccaaggacaggtctcgaggcttcgaaattaaaatgaaaaatgacatttgctataaggtttggttgggc

SEQ ID NO: 36892 - DNA, 1011 bp, Heterodera glycines
tctcactcactttttcgtgtcaattctctcctctctctctctctccccctcccccccctgtttccttctctcttcttaactcccctctctttctctcactcactttctcgtttctatctctctcccccctctttctctctctctcacttactttgatcattatttacgtgatcaaatatcccacatgaacaatttgtgccagatttgtctttttattttttgaagcaagagtcaaatgccaaatctcaccaatcacactgatccggagaccgacctattttttgccataactcctccttccaactaactctgagaacacatgtgacaaaaattaaaggcattataaattacggaaaaagcaataaaagttttattgaatttctaattggcttaaggtaaaacaaaattttagcaattaaattaattttttttttactttattgcgttgaattacacaataagaagcagtttttttgttataatataattttgttctctattctttcataatatttatttgttccataaaaaaattatttttcaatgctaaataatttctcgttacttaaagtgaaattaattttaacaaagttaaatttccttttagtttatcgaacaaaaataatttttcctttacattttattcatcccttgcggcatgcaaattttaaactaatttttaaattatttaaaataattttttaagcaaccgttttaaataaattaaatgactgaatctgacgaaggcaccaattgggttgagtctcatccgtgccgatgtggtgccaaaaattggacagccagtcacatggagcgtgtgatggtcaaactttgctgcggtagcgaagaagtccaaaactgtaagtaaagtactaaatttaaaacatttttaaaattttatttgtttaatttttttatttcaaaattattcattataataaaaggtttcttgtggtgtcaaagatcattgtgaaaaacttgttatcacaaaataagtgttgaattattatt

SEQ ID NO: 36893 - DNA, 1097 bp, Heterodera glycines
  misc_feature (376)..(376): n is a, c, g, or t
  misc_feature (380)..(380): n is a, c, g, or t
ttcctttacgccgttttccttccttccccatataaccattcccaatgtgtatttgtgggggcattttttcacattcccatttttcaaaaccgagagaggataagggaataaccagcatgtgatgcggctcggggctgcaggaggaataattgcaatacagagagagagggaataaataaaaggacggacgaactatgagcatccctcagagtttttgttgtcaatatttgggaaaaaagaaccccattttattcaaaagcgaatgtctgatatattttaatgatttgttaatggggatcgaattctagtccggctcaaaaaattgttgaaaaactaatacgtaattcgaatgtcaaccatccccaaatgccaccanccanccaacacaagacgaaaaggaccaacaagtgccataaatgaatgtaattcaaagtaaaactgtaattaagaagaaatcccaatggaaaccgctggagataggaagtaagtctgagagattaaggaacaaagtccggaactttcagtccaaaacgagattttttgttcagcaacgaaaattccggacccagaagaattgcctttcggaattgtacagactgcattccgagcttcagatcggatgcgcacgacctcagaagattcggccgagtcttttgacgcctatggaccggagtgggaagggaagggacggggaattgggaacagaagggaattcagttcgccaaatatgaccagttcggggagacgaatgagcatcacagaacgcttatttggacgtccagtgccccaagaacgaagaaactcattgggagaggaacaaatggggcaggaaaagccgaaaagcatcgcggaggtttattcgctaattattctccctgtattctatttctattacagaacaaagacttcaaagaattaatgaagcgtcagcgaaaaattttgggcgatgatgagtggcaataaagaaaggcaaaagaaaagaagccattagaggaaaacaaagtcggaatggatcaaagggtagaaaagggaatgacaatttatttatttgtttatattatttaacacttcttctgatttttcaataatgaaataaa

SEQ ID NO: 36894 - DNA, 1182 bp, Heterodera glycines
  misc_feature (1051)..(1051): n is a, c, g, or t
  misc_feature (1058)..(1058): n is a, c, g, or t
  misc_feature (1066)..(1066): n is a, c, g, or t
  misc_feature (1071)..(1071): n is a, c, g, or t
  misc_feature (1126)..(1126): n is a, c, g, or t
ttttctttttctgttttagaaaattaatgaaaatagttttaaaggggttttagaggtcgctgatcatgaatccgggctcagaccagcgctactgttcaccacatgagctgtacagaaacgaattgacagactccctgtaccaagggtaccctcatgggcaagatgcccatgaggataccatcaatacaaattttcgaattacacatgcatataatcgtaatgagtttaaataatttttattgctgttaagatgattttaaactcatttttatgtaagaatatggttcgacaaaaactcgaaacccgaaaaatttaaaatttttgagtttttgttcgagttcgggtaaaggtgttcgaaattggcaaaaatgatgctgtattagtgatccccttaaaacttattttcattaatttctaaaacaaaaaagaaaatctattaggtaaacttaaaaagtacccatgtaattacctaaccattgttttgcttgttagtaaaattgttaattgatagaaaaattttttactataataaaataaaattgcctggtaagaatcgtcgcccgggtgcttgtcagtctgtactcttaccaattcttggacattaaaagacaaattcgacggagcatcaaaacgacggtcgaaattcaccacaccatccatttcagacaacgagaaatgttttgtttcatacaatgcgcagaacttaaaaagtcatagataagaccaagcggactcgatcagtcgttaaatttcaccaaattctattctccgtgtcttttagcaaaaaaaaaaaaacccgaaaaacctcatcttggccggctacaataaggaattggccataatacggctcatccgacaacgcaatgcagtccatgttcatgctggcggattggcctgtgtcaacaacatcgctcagtcgcgcaaccatttgattagaggattcatagattcccttttgaaggtcgaaattgctatcatacccaagcaaaaaaagctaaattcggtatcatttcaattgctaatatcgcaaaagatttgaaaatttgtttanattgccntgaatttnggtgngaactccagtttttgcacttcctccacccccgcccattagaatatgtcgacaccnatttccacgcaacagtaagctgggatagaacaatagccgccttgcttgatttttgc

SEQ ID NO: 36895 - DNA, 1000 bp, Heterodera glycines
ttaaaaaattccaaaaattatgaaacttaaaatagacatcaccattcgtactcagcaccttattttaccccagaaaaatatttttcacccccattttcgtccgaaaaaaaatttccgaaaatttctagggggcctagctcgaaaatttttgaaaattttacatcatgtagtacaccattcgatagcatttaaaatgctctacaaaaatgttctaagacaatttttcgataaacttaactcctgccgagttataggcccgggactcaaatgtcccgctcaggccaaaaaaattttctatttccgggaaaaaatcgaaattttttcaaaaatatcaccaatcgatagagctcgaaaaacggttgcttgaaagtggtctccgtttttctgggaaaattcgttaaaaattcctaaaattcaaaaacccgaaaaccgttttttaggcctagctcgaaaaattttgaaaattttcgaaattttaaaaactggaaaaatcgggcttttaaagctctacaataagtctgctggccaccctgcgctcaggtcaaagcctaatgagttattcaacggggactgaactggacaaagttggtactgaaaagttctagaagcacccagcccagggggttagagctagaggcctagaattttttttaacttttaggcaacattctcacttagggccctcacagcgggaattttttgatccgattttcagaaaaaaagttatgggccgtcaaacgcaagaaaaagtgagaaatcggtccccgggactcagtcgtccgcgcagaatttttctctatagttttccctgattctcctcaaaaagttgtaagacccttccaccacttttagacccgtcccattagccgttaagcccaaattagtttttgaaacgaaactccttgtcaatataacgtatatattaactagcgggtgcgtgaaccgtcggctatttagctgggaaaaagcgcttcgcgctttcggagcttcgctacctaga

SEQ ID NO: 36896 - DNA, 1536 bp, Heterodera glycines
  misc_feature (96)..(96): n is a, c, g, or t
  misc_feature (127)..(127): n is a, c, g, or t
aagatgatactgatgattagcgtcttgttcgatttggcgctagtgcgatatttattctcatggttcttggaaagtactcaggaagtattcgatttnttgtaaataaaccatcagctgatataaaganaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaatgccattaaggcaccgttgtagcaatgatgcacgtggtccttggaaattcctcaggaattaatccctgaatttcttttattttcttatcactcacaaatcacggggggaaaattaagatgattctgatgattagcgttcttgttcgattttggcgctagtgcgatatttattctcatggttcttggaaagtaatcaggaagtatttcgatttttgtaaataaaccatcagctgatataaagaaaagcattgttgtctgtccttttccaattatattgccatttcggcatcggtctaacaaagctgcgcatggctttgggaaattcctcaagaattaattttcgttgtctaaagaaatgcactagtgtcgggcattttgacattaaaatgccattaaggcaccgttgtagcaatgatgcacgtggtccttggaaattcctcaggaattaatccctgaatttcttctattttcttatcactcacaaatcactggggaaaaattaagatgattctgatgattagcgttcttgttcgattttggcgctagtgcgatatttattctcattgttgtgttcttgccaatgaacacacaaagaataaacaaatatttattgattggtcggtggacaatgcaaaaatataataaaaacgaatgaatgagggaaggaccaaaaaggaggggaatggtctccttataaacacaatgagaaggggggaaagggcgtggagaacaaagtacaaatatgaaaataattaaaaaggtcaaaacgccaatttaacatttccaacattttccatcaaataattcagctgatattgctcatagtctcggtataatttaccagcgacaattaaaataattgcgtctttgtcatcaaactttttcctttaatttgattaagaaattaaacaatcaaaaaatatataaactaataataagccttatataaccaaggaataattattgtatttaattttcattttaaattaattttaaatgtttaaaaaattaattaatccataacttttatttttccattttatacaactcttttctgctaaataaaattaaatagatgctaatgccagattggacttaccatgccattattaatgcattgatcagcatggtatcgcacggattgtccggcattttctcttttgacgtgtcaaacccggccaaggccatcgttcgtctgtgcaattttgtgatatttgctgaattcacgaagccaccagattggccaatgttcacttcaatcttaa

SEQ ID NO: 36897 - DNA, 555 bp, Heterodera glycines
atgtttgaattatttctctaaaactgatcgaatgaacgacgaaacggacgaagtgaaagtgccaacggcgacaaaaaaaagaaagtgaaagtgaagaagggcccggccgactgtacgacgcatttgcgcaagcggaattggtggcggaacggcttaaattgttggactacgagcgcgaatttgtgcccctcggcgacagccttaaaccaattccgaggcaaatgccgatgaatgaatgccatgccaacgaattattttttgattttaattgtttttttaattatttaatgggtcagacattacttcgccctctccacaaacattggcgagcagttccatttgttcaccagcctttgcgcgtggctcatcagaaagtcgggcgtcgatccatcgatggaaatgccacacgaatttgacgaccctaacgcaacgatcgcacaaattttggaatcactgaaagcgaaggtggcgggcggggggagacggggctaaagagaaactgtcgagactcttgaccgagcttttcccccaacaaatcccaattaggatttgcat

SEQ ID NO: 36898 - DNA, 1084 bp, Heterodera glycines
  misc_feature (1074)..(1074): n is a, c, g, or t
tttgaaaaattaaataatatttataagatatttgatcagataaaacggttggtctatcaataaaagttgaatagaaaaaatagtaaaaattttgattctaaaaatgtcaaaaaatattgaaatagtaaaacatttagccgcaagatttgctcaataattttgagaaacgatattctttttcctaattgatacttactgaaatattaagctaattaattaataaaaagttaaattaatacatttctatatataaatattaaaaatcaagaaaaatgccaaactcattaagcacaaaaattttgtcgattttttcatggcacaccacacaacttacacaacgggtgacccattgacaattggcacgaccaccagctcgacgagcagcatgacacacagaatgctgtagccgttcatttttttttggaaaattatttttaaattaatgcaattaaccttcaataaaatttaaatatttgccattattaatttaatgtataatatttgtgtaaaaaatgttacgggcttcaccttttcggtatacaccagggataatgccgacactctcaaaaaattcggcaatcagcaaattgaattccgatcgcatttgaatttttttttgccttttgccaacccacactttctcagtttcattccatttttgagtaagtttttatcggaatttgtaaaataagatctaattgattttccgtctttcaaaatgaattattttagtttaatatattctaaaatagcatataaaaaaactcttggaaattgattaactatttaaaaaatactcttaaatccatttaattattaaatttaaatttaaaatgcttaacattggctcagaaaatgaactctgttcttgggaaacgagaatttcttaaaatcttcgctggtcatgtgaattgtgatggctgtgattttttcaggaccaaagttttggggccaaatgttccactttttggcagtttggccaaatccaattttatttcgggtgattaatgaccggccaccaaatggaatgtgtacattcattagagttaggaagatcagctgatccgatattgngaaatgaata

SEQ ID NO: 36899 - DNA, 980 bp, Heterodera glycines
gattttttaaatataaaatatttttttttaaatttgatctttagcggtgtatttttgtaaacatctttggggctgtatttcgaagttttcggtgaatgccgaaatagggaaaaaatatcggagggtcgaattttaaatatggagaaataaaaaaagtttcaaactaacttaaaaacacattcacatctatttaatcacatacacttttttaaacaataactcacattaaaaaggaaaaggaatatgccagcaatgaaaacgtcattagaaaacaacttatttgtaagtacaaaaatatttactcttgaccataccatttccgattagtccgaccaggaagatcaatgcatagaaggcagaatacgtcacctgaatgggcataattatgtcgaatgctatgcatatctcaatcagcaagcagacctgaaaatttgattttcctagccctatttgtactttgggaaagcggatatagcaataatttttatcaaaattatagaaaaatgccaatttgctctggacttatcgtttaaagagaataattatttgaacaattcaatgtttactcaattgctaaaaattcaaaattccaaaaaaatttgtaaaaaataaaaaagccaacgtatttaaaattctattaacactctctaattcgaattttctcgatgaaaaattgttttatttaattacgaaaatatcaaaataatgatttttaaacttttatagagggttgttctaattgagattttttttacaaaattccaaaataagactcccatcataagaactttaaacctaatagttaatatatgattttcgtgaacatttcaggccctctctaaatttttattcctaattatttccatttcctccattgcctgcacttccgtcctcagggtccaatcgccgaacgaactcataaaggtgttcaggtcaacacagtgctgcttaattcgttcactaatcatcgccggcagcgg

SEQ ID NO: 36900 - DNA, 1323 bp, Heterodera glycines
aagacgttcatttttcctgtgcattagggatggcatatttattagccaggtagctaaacggggtgacgttgttgcaattgttaaatgactccataaagtaatttaagcgctttgaaacaatagagatccgactgtccgtacctgaagttgcccggatgggttacgtgtcagcacaagatagtgactgttcgccattgctgtccgaatatttcgcccatacaggctctgagttacgaaaattacgtttacgttccagttatgcgaaccgcgtgtaaacaaaagatccaaaaaatcattgttcatattcagcataaggtcgtccagcacaagtaggagaggtttaggtttactattaatcaatgcctgatctggaatcccattatgggtttctattccacgtttcatcagatcaatgaccgaatcgttcatttcagaataacaaaataaaactttttcgggaggtgggttaatcagttcattatggtgtttcaacaacctcatcagccattgggttttaccacttccggtggcgcccgataatataagagtgaagggggcattaaacattttttaaagttcaatttttctaattgtaacttatttatatagtgtttgtcctcaattttgtatgggacatatgccgcacattttgggcacatccaacatttttctgcccaggggaagtgtacggtgccaaaatgcaatagactttgtttcctacatcttttacaaatttcataatgacatgggcagtaatgacaacattttacttgatgaatacaaattttgttcatttttaataatttgtaacaaattgaaaaaaacagaattgtttaaatagtgtaattaatatgtagggggatcgggtttcatgatgtattcgagccattgtgttaaatcagccgaactgccagataattctactgtttccttctgcgaccactcttttgtcaatttggctgttttaaacagagtctgcgggtcggactcggatattttttaggtggtggagatttctcacatgacaaatcgttttcaaaagtttgagggactgttggtataaacgatgacgatttttcttgtgggaaatcttcatcaggcggttcgatttttggttgtatgagcggttgttcgcgttccatttgttggtccggcggtggtaaagtttcacgctccaattctttatcaaccgataattgtatatttttctccatgaatgtttagaggtaatgggtacaataatttctattaactgtacatttcttaaaacgagctgcttataaaggacgctaggggcgggggtctggatcctttaataggaca

SEQ ID NO: 36901 - DNA, 1272 bp, Heterodera glycines
aatttaccatctttttcggagtttgaaccatttacacaaataattattactagaagaagagaaaagttggcataatataaacacatttcggcaaaacaaaaattttcaattcgttcagagtttctctataaatgattgaaaattttttgtcatgaaaaataatttaataaaatttatacattaaactagctattataatgacatcatcttttaaatgaatgaaaaaatattataatttaataataataattaaaaaaaaatcaattagacgaagagaaaatgtgcttgaaaaatatatgtaggaatgagaaagcttttgcttcacacatgataaaagtggaaatgaaaatttcagaagatgccgattgactttccctaaaatcccaaaaaaaatgaaaatttttgtgaaggatattttggctgtatcgctccaaaaaatttttaattttaaagaaaatttggttttttagggctagttttggtgatttttgaccagtaaaatctcatcatatttataatttttaaatatatggcaataaaattaactcaattttccaaataattttttttttcttaaaaattccttggccttttcgccgtttttccaaactatttagttgaaaaattcaaaaaatcttcaagaaacagagggcaatcatggcatgaaaataaaatttggtgcgtttcagagcactttctggaaaaatatttagaaattaattttgaaaaataagtaaaataaagaaaaactcagaatttcgaaaaaaaactttaaaaccaataagcgttgaaatattttcaggttaagttagttcttttttttgagaatataagcattcgagtgccttattaattaacatgtaaataaaatttgttgaaaagggtgccaaattatgtaattgagaatgactggccttttttggagattatgtattgaatgatcagattgatctttatacatttgttgctcattaatttttataatttctatttcattcatttttgacataaatactagaggtgtgccgtgaatcacggtcacggttaccgtgaatttcacggattttttctatcaaacggtcacgattcacggggtcagttcacggtttttccgtgaaaaaacttacattggataaaactgaaaatttcagaatttcgaattgttttatagagaacttgtcatttttggccaaagtttgctaagaaatcggatcaaaatttgcatttaaagaaaaagaataattaatcctttacaaattaataaacccatat

SEQ ID NO: 36902 - DNA, 1032 bp, Heterodera glycines
  misc_feature (10)..(10): n is a, c, g, or t
gcagtatctntggtgagacttgaagtatatccaaaatctttcgtctacatctttttacactgttttaagactttctgatgtattacttttattacttaacctaattttcaaaattgaattttttcggattctggacatgattccgcatcaagtatcttggtgtgtatttgacatgtaatgcccaaatacatgtagggcgtctttacacattattttaagtatttccagtgtaaaaaattcatcataattacccatcaacccctctgaatccctgcgtatcccccctaattctgaaggcaaatatttttggtcaaaaaaaaaatccgtgaaatccctttttagggtatttcccgaacccggaccaaaacctgccttataccatctgaaagagcaaagtctgtagatgtgtcatcaactcttcttttttcgattgcaccgattttaaggcaggatatgagccatcaaacacaaactgtcaaaaattttcgaaaaaattttcaaaaattttctgaagaaacttttttttacgtgaaaatttcaaaaaatggttttcaccattcgatagagaatccttaaaaaatagtagtgctcttttgttcggagccgatccgagcactttgaagagagttattcaaaaaatttgccttcaggtgctagattcctcttatatagagaaccagggccctgcgggccctgtgaaagcgccgggggcgctttcaacgctggctctagtgggagatataatttggggcgtgcaaaaagcatctattggccgctaagcgatcctcatagtttaggaatatgagaatttggaaatgaacaaataattaatttaaaaacgatattgttttaaatttaatttaaatgcgacatttttatttatatgcttgtgatttttatgagattttttgttaaatgttataattctaaaataaataattttcgagttgtcgctcttgctgctctgacttcctcttccactttctcttccactttttgttcttcttccactttctgttcttcttccacttt

SEQ ID NO: 36903 - DNA, 772 bp, Heterodera glycines
tttttgaagaaattttttgattttacaccctaaatttgaaagtttttagcaactattttcccatttttagcacctattttgggttttttagaacctaaaaattaattattttgcagtttttatcaactataatattgtccccctcccctatccataagaatgaaaaatgtttcttgataaaattatttaatcaaaattttaattttaaaaagaaatgtctaaattcatgatttttttaaaatttttttgagtttcttacttacttttatgttaaattaaagtttttaaaacattttttgaaattataatcttttagcaaattagttttaaaatattcaatctaatttatcgagcatatcctggtaaatttgattttttatttggcaatttttatgcgtgaccggataatgcgtcagtggtttaaaataagtctctgtagcattaagtattgtaatataaaagtagaatatcattatgaattccgaaacccgggtccgaattcaaacaaaaaatcgaaagtccaaatgttcgaaattagcatttttttgattcaaaatcggtttaaacacacggaaacaaactgaaagccatcaacccttcaatagaaattcatttatgccttttttgaaccaaaaatactaaattcgaaaatttgaactttcgatttttgttcgagttcgggtccggggttcgtaattggccgaaacatataccggattcgtttcaatgacaccgaaaacccaagaaaattatttttatgacaataaaattt

SEQ ID NO: 36904 - DNA, 1014 bp, Heterodera glycines
  misc_feature (852)..(852): n is a, c, g, or t
  misc_feature (898)..(898): n is a, c, g, or t
ttttctaaatttcagtcaacgaaacaatttcccatttctgccacccatttcattttttggatttgcgaaattatccccccataggaaagactcagatagttcaaggtcatggattccacccatccactgccatcaagtacataattgttaatgttgcaactgactatttttgctaaaaaactccattcagtttgaaaatctttgtcccagttttacaactgtaatcgtaggtcaatcgcacaatcagtcattgtgttttggcaccccattttcgtcatttttccttccaaattttcactcttcagtttttcatccattgcctataacaatttgttcacataaaaataaacttttcttttaaaacccggcatatttttcagtcatcatttgtcattacaaggcggaaagcgtggcccctctgctcacatttggctctctgtttggcattgtgttggctgttctctccgcctattttctcatttggaaaccctccgccgtttgctcactcgtcaaaaggtagtgagtgaccaactttataaattacctttcctatataaaattcaaaaacattttgtttagatatgaaaattttctatttatattaatttaattgcgttagccaaaagatggataatgaatagggattccttttttcgtaagaaaaatcgcgaaataggtacaaaaaagctcgaaatcgttattaaataggtgcaaaatcccgaaataggtagaaaaataggtaaatttaatgaattcctttaagactaaaatttcgaggtttaacccttttgttgcttaccaaaaccactggacataattttaagcttaatcaaaaacctataaaaatggcangtttttagtgaatatcttaaaaaataggcaaaatttgcatccttcnaatttataaaaatatttatctacagaaatgttcagcgtcggcttcttctttatgattacgagttttctaccttcggatgcaacatactcaaggcaagcatttaaacaactgtttat

SEQ ID NO: 36905 - DNA, 802 bp, Heterodera glycines
tatgcaaattttgtgcaaattttttcatttttactcatttttttcatcattttttttctatatttttgggttttttgaaaattttatataattccggcacctgaataacataaattattctccttaaaaagtggtaataaaaattcttaagcccttaaaatcacgagccccaaaagcttaattttaaaaaaatcaacaagttgacttcaagcagcatatatagcatttttttgagatagtaaaaatttcattttccaaaaataagttttattataatattaaaattaattcaatatacgtaaagtaataaaaattaaaatataaatctaaattgatcaataaaataaatgtaagtaacatttatcggcagatcctcctggacatctttattcgtaaagataatgacgaattatgaaagtgcacacatcacatggaaacaatcataaacaatgaagaaaaagaaaaagaaagtaatggcacaaaaggatgaaaattatttagcatgagaaaaagagtattttcaataatcgaaatataatggggaaaagaaaaagagctaggcgaaatataatggggaaaagaaaaagagcattttttatttaagaaatagcataagaaaaagaaaaactgcatttttaagcattattacaatatattcattcattcacccgtttgcatggttgcgaataaatttttatcaagcattgtcattgtaatccacgtggacataatgccaaacaatggcagagagactgtgtaaaataagggcggggcaccagcagaagccacattttaaaattaa

SEQ ID NO: 36906 - DNA, 979 bp, Heterodera glycines
  misc_feature (156)..(156): n is a, c, g, or t
catgatcgagagtatttgtattatagattatccaaaaaagagatagccatttttttgggatacagatgcaatttaaaaattcataaaaaataaaagggccattacgcaccgtcttccctctcatgatcgagagtatttgtattatagaaaattacncaaaaaagagaaatccatttttttgggatacagatgcaatttaaaaattcattaaaaaataaaggggccattacgcaccgccctccctctcatgatcgagagtatttgtattatagaaaattatccaaaaaagagatagccatttttttgggatacagatgcaatttaaattcattaaaaaataaaagggccattacgcaccgtcttccctctcatgatcgagattatttatttgtattatagaaaattacccaaaaaagagatagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgtcctccctctcatgatcgagagtatttgtattatagaaaattatccaaaaaagagatagccattttttgggatacagatgcaatttaaaaattcattaaaaaataaaagggccattacgcaccgtcttccctctcatgatcgagagggccattacgcaccgccctccctctcatgatcgagagtatttgtattatagataattacgcaaaaaagagatagccatttattttgggatacaga

SEQ ID NO: 36907 - DNA, 1024 bp, Heterodera glycines
aaagggaaagagtgggggggggggaaatggatttggtgttttggtgttgtttcgagaatgtccatgaaggtcatccattattcacgcactttggcattgctgatcaatgaccacagatcagtagggcaccaaatttaaatgttttttatccaaaattcgaaaccaaagtttccgaattgaatgaaattttgtataaagcaaaaagaacaaagctaacattttgaagccgataatttcatgccgttttccttcgtttgatggtttatttggtcaccagtggaaacaacaacgagcagttcagtgaaaattgttaaacaacaaatttgataagaaatgaatggaagcgaaaacagaaaaggggcgaccgatcaatcagttttatgatcagtgatcggctaaatgaatgacacagacactttgccaatgaatgagcggagccaacgccaaaccgaaacgaatcatcggaatggccaacttccgcccatttgtgggccggccccgtcggcgaactttcgcaacattccccccccccctcttctgatcacatgtcgcgcgcgactgatcacttggcgaaaatggaccccaaaatgatgggcgaaggtcgtttcactcgtaaatgatccaattctttttccccttttttattttcctttttcggccgtttgtatttatttttttggccttcccccaacaaaacctgtccttccgcttgtcccaaacacaacaacaatttacaagcaatggcaatgtttggcgtttggagggacaaaaaaagcgaaaaaaagagaggaaaataatggacaaaaatggaaacataatgacaattggtaactcataatctaattaattaaatattcaaatgatggaaagaaataaatgaaagtgaaaggcgtcggcgaatttttggtcatttcgccccgagggaaagagcgccaacgaaacgcgaatgaatcttcggcgcggctggtcaattgcacaagggttgggtggatggatcatcaccagcgccagcatcatcagcaga

SEQ ID NO: 36908 - DNA, 80 bp, Heterodera glycines
tgcaggtcgcaaatggacagacaaaatgccaattcattcggaaggggtggcacaaccgacggaggacaaactgccgaaca

SEQ ID NO: 36909 - DNA, 1657 bp, Heterodera glycines
taaatgaaaattttgtaatttaaaaaaatatttgctgaccggcggttcattttgtggttcaatcagcacaggtctcaccaatttttttcaatttaatttgtgtgtcacaaagggcaaaaaaaactgtgttaacttaaagcatagacaattaggaaaaatgagagagcaaaaagaacacaaaatttagagaaggtacatgaaaagtgaaaacagtaatttcacattaaaaactttgaaattaccgaaaaggagaaaaaatggcaattttatactaaaatattaaaaatgaattaaaactcgaaagaaataagagtcaaacaaattttggtaaaatatagtgtgggtaatgcgtgggtaatgaatagggctgtgacttttagtgaccaaaaatctcgaaatagttaactaaaatagtgagcaaaaatgccaaaatagtgacaaaaagtccaaaatacatagtgatgaatagtgacattattttcaaccaaaaattaagcaaaaaaaatctttattcactagttgcagttacaaatgaggtacattcctttcttacatttttttagcaaatattgaaattttaaaccaaaaattttgtcaagaagaaaaattttggggaaaaatttttatgaaaattttccaattctaactggtattttttgaaaaatttttatgaaaattttccaattctaactggtattttttgtaaaatttttaggtcgattcttaggggtgtatttttttgtttttattgcatttttgttaaggaattttccaaaaaatgtcgaaatagtgaaaaaaatagtgacaaaatgccaaaatagtgatttctatttctagtgaacgataatgacatcagaatcgaaaatttttaatgcagaaatgcgttttttgagctcctttcttcaaaacaattgagcaaaaaatttagttaaaacctaaaaaagtcgagatttttgaagttttttcttaataaaatttttccaggcttgataatcctttcgattttggtaaggttaatagagcatttgttggatttggatgccaaagaaaaaagctatcgtggaaaaacgagctctgctggtagggttttttccgaattttgtaattctcaccgatcggttcatgctcaaatgcacgaaatcttgtttttgatttgaatgttgagcgcatagcatggattcgtacttgaatggcaagtgcgtacttgaaatcgactctcatgcgagaaaatttaaaatttgcttattttcatgaaaaactatttcgagttttcttcattaaaatcgcaaccctacttatgtattaccctagtaatttttaattttttttttctaagcgggctggagggaaacaccttaactactgtatttctaaattctctagacaatcgtttcattggtaataaagaaattgtccaaaaaaaatcaagaaaataaatgttttaataattggaacgaaagaattaactgttggatagtgaataatttgaatttatgtgtaaaaaatgagccacacattgatgacttaaattttcgaataattttcgttcttataaaatgttttaccttgattttcctaagaccctagccattcgctgcatgttttttgcgtcatcacggacaatgggaattaaaattctcatttttaatccgttttc

SEQ ID NO: 36910 - DNA, 1257 bp, Heterodera glycines
  misc_feature (37)..(37): n is a, c, g, or t
aaagtgtgcgcgactcgtcgctttttttttgttgaanaacattggccaacagcacagcgaatcaatcatttggcagggcaaaagccggtcgcccccggcgattattgtccgatttgcgcatgagagaagcgacggaagaaagtgtaaagatgggacaggggaagaagctcacattgtgaaaaagcacaacaaatacacaatcacaacaaacagtgggggcgacgcaacgcaaagaaacaaaacaaaaacaacggaggggggggggagacgaaggattgggcccatttggtgccatttgcaaccattttttgaaatttcaatttgctccttcgtgccgtttatcatattttggccagaggcaattcaattgacaattttatgttgtgttatttgaatctgcttaatcttttccttgcataaaaatacttacaatctctcaatcagaggaaatcaaggagttcgttaaagtgtaatttaatttattattattttctttattttttttttattatttatttttgtttttctgtttctgtcactttcttatgcaaagtgtgcttcttctttctttctcttatcaattatcatatgcacaaaatgacaacaaatgttgcactttctttccttttttctttttgtttcgtccccactttttcacttttctccccttttttatcgtcgtttgatcggtcgttgtgtgaatgtttggacgatgatgacactttgcagaatgttttgtgaagataaaaaacaaaaataaataaacataaataataatatttgcataatttacttttcgatttactttttctttcctttttaatcaatttgaaaatgttcactgatcatccaatactttaattataaattgtgccattcgccccgctaatcccccaaaaatgcctttgattcgtccgccaattaaccgcttccccaaatttgtcttacaaattcaaatttgcgttacccccccccccgccctctttcattttggtcttttgtttcctcaagcgaatatttgaatttgacacattttctacacatacgataatccccaacagtgcattaagattttataatttcgtacgctcatttgtgccattttgccatttccttccgaatggcgtctttttccctttttcttttctctcccgcctttttaataaataataattttatttttatttttttcattcctctggtttctttctaaataatttatttaaatttccgtttggttattcaaaattccgtcgt

SEQ ID NO: 36911 - DNA, 1143 bp, Heterodera glycines
ctgtgtacaatgtcttctgccacagtaatgcacaatttgatggttcggtgattgtggtggtgacggaagcaaattcatgttcttgctcctccacgtgtagtcgttgttgttgttgtcttcgcaaatcaaatggcaaattttttggcgctgttccgtcaagagtcgggtccatttgaatggtaatgattggctgcttggcattgtccctcctcgcttcctcttctgttgttgggcttttcatcaaacgatattgttccatcggcagaaattgaaaacagtgaagccaagggatctagtaaaaaaaaagaagaatgatcagattaaacatttactctgatcagattaaacattcactctgtttattgcatgttgcatctaattgactgattaatgatgctcgggaatcctatttcaactagacgagatacaatttactggataaactatctaaatttttcatatccaaatccctggaatcctattttattttccagaattccggcataaaaacaaaattcaaaaatattgtcacaccatctgatcggatgctccacttctgtacaccggttgcattgacttggaccaatgccgtgccgaccggcgtttgtgcgttgagccaaagttcagtttgaaaaggtgcccacaaatgaatgccatcatcaccaccgcttgcatcatttggagtaagtgttgtttcagtgccgttttgatcgacaacgatcaacaattggcacaccgatgacaatggcatttctgagctttggtcttccgcaatcagaatgatggagcgcggaaatgaagaagaagaaaaagcagccgtggcatggccaagatcaatcggacgacgaaggaagagatcaccggaaatttgaaaatttttaaagaaattaaacctagctttgcaaacgtgaagaggggggagggactcaatttcggcatttcatttgtgaatagaaaggaatttcgtaaaattttcggagataaacgataaagcactgataaagatggaacttttacaaattggaaaaaagtaacaaattttatattttttaaaatttatgaaattgatgaaaaatcgaaatttcatatgggtttgaggtcaatttcgtaaaatttttagaaaattgaaaaaaaaacattttt

SEQ ID NO: 36912 - DNA, 887 bp, Heterodera glycines
  misc_feature (813)..(813): n is a, c, g, or t
  misc_feature (821)..(821): n is a, c, g, or t
tttctttcctctctttcgcacgattgcgttgttcgaattccaatctttagcaaaaggtccctcctgtcaatccttttgaaataaactaaattgcctgttcttgatgatccgctcaatgattcgttccgttgtcatctcatttccagaatcaaccgttttgaaaattcccaaatgccttaaaatgcaattccaatgccaaaatccaatttgttccctcactttggcacctcataacaatctgcttcctcggtagcagtgtggtgttcggttcggatgccttgcaccacaaaattaatgcgaaatcggtcgatcaattctttcgtaacgcacagaggggcgccgatgacgacctcagaaacgggctgattggaaaaagaatggattactatggtaataacattaagtggaaacgtaggtaccttataggccaaaacactgaggactctttcgtggagtgtcataattgggtaattctgtcctttgtacgaattgacgtccttaattgaattcaagatgccattgaaaggaaaagctgtttattggtccacttggtctgagtatattccgacgattaaataatcgccaagacgacgagcttcttccaagaagcaaaggtggccaatgtggaaaaggtcaaaagagccacagacgtaaacaattcgatcttcgggggttggagctcggcctgtaataggaaaatgaatatttatgatttcgggactggaaataccctcagaaaattgcataattgtctgagttgaaggcagaaaacgtgaaatgcatgtccaaggggagcgggcctcttggtcctanagtattanatgaaagagtaaataaaaccaaacaaaaaaaaaaatcgttttaaaaagatacaacccaatgaacac

SEQ ID NO: 36913 - DNA, 1149 bp, Heterodera glycines
  misc_feature (77)..(77): n is a, c, g, or t
  misc_feature (1066)..(1066): n is a, c, g, or t
  misc_feature (1074)..(1074): n is a, c, g, or t
  misc_feature (1085)..(1085): n is a, c, g, or t
gtcatatcaacaggaaccggttaagaataattaaaatttgtgctatctaataatgcataaatatgtcatccatcacncaggggatcggaggaaaattatgcattttttgccggtttttttaatttgtttttctcttacattatgtgcttttgcttattgattcattttgtcacagctgctgctgccatttcaatttgttaagcttttcagcagcagtcagtggaatgaaaagggcagcttttcctttgaacagataaaaggatttgttcactccccaaaatcctttaatttcacacaaaaaataaagcaaatatacgagcaaaaaaaaaacaagaaaaagaaaattttcagacgacagcccttaaaacattttcgttatggatagagaaagaccgacttttgaggcatatgccttttttgctgcgcattatttccgatatattaagcataaataacacagtttccacttggttttaggcttctacgttgacttttattatgcctttttttcttggttaaaaattttagttttaaaaattttccttttcgaaaacattataaaatatttaataatcaattaaatgaccaaaattatgttgtttccctaaaatccttaataaaaagattttagtgctttttcttgcttttttcgggattttcgtgccttttttcaattttttggtgcctattatagtgcctttttcgcgatttttggtgcctttttagtcggtctctaattatggaacaactgagcccacctattaaaagatgggcacttatgtttacatgaaaaatgacaagtgcgcccctgacaaatgagccgattatctcattgtttgcgcaagattgatgaatttgaattaatttaatgatttaaaatttctgtaaaatggtaaaaaatcggtgagcacggattgttaaattattttcactttaattttgcatatcaaataatttttaatgctttttattaatttaaattgttttttcgcattatttaattacagacctagaggagtcgattgatattaaatcccggaagcattctttacttttaccgttcggngaattaanattttttttanatgaatataagaattgaattttcgaccctgaaacccttgatcattatatactcatactcatatg

SEQ ID NO: 36914 - DNA, 523 bp, Heterodera glycines
attcgtaaaaaaatgtatggggtaaatgaaaattttgtaatttaaaaaaaattccttaccgtcgattcatttttgtggctcaatttgccgtttttccaattgattggtgtgtcacaaaaggcaaaggcaaaactctgttgttatgtaacttaaaaagagagagttggaaataatgagagagcaaaaagaacacaaaaacagaaattcatccaaaattcgcatttatacacaccgtccgaaaaaacgagatgtgtaccaataaatagagagtgccagagaaaaacattatctttttttctctaattttttgtctccttttggcgtactatctaatatttctattattaggaataacaacattcacttcgctctatagaactttttttccgccttacagaatttcttcatattttgcatatcgatagagaaaaaaatatagaattgttcaatcgctttttaaagaaaacaatcgcttttattttggtctaaaatttaaaataaaatttcgaactcctataacttt

SEQ ID NO: 36915 - DNA, 1394 bp, Heterodera glycines
atgtttttattgcgtttccttcacgcaaaatatagtttttagaaaaatcttattttttggggtcagaatcttagtttttaggccattttgtcttatttaaaaaaaaaaaacttgggaactctgcataaatgcctcttgtttttcagagttcgtcgtctttcatctccctcggtactcttcgccacacattccaacccttcccctttctctggtgcaccgtttgatcgcagcggccgaatccgtccgagacgctcttcttttaggtttagtctgatttgaaaagcctttgatcaatttcagtctttgtcagtgctctgtcccatcgcttcgtttgccctgcaattgatcaccgctgcacaaattgtggcaaagcgttcaccggaaactcccaatttggcactaatcttagccgacttggccagacgggggttacggtgagcagcattaccgtattcatatcgttttttgtccgttgtttcagcagagtgacgccgactcttcgcctccatccgtcctcccccctccttttgcttcctttggctgcgtttgtcgacgtccgtccgattcggcactttccaagcatcgtttgccgtgcaaaatgtcctcgacctttttcaagcctatgatgatgcagcaatgttttgacaaagcatcgccgccaaatgtgcaaaattggcatcgtccggccgaccaccgccaccctctccccaacattttcctcaacgatgcttcacctcccaatgaaatgacggcatccgcgtgccgtgtgggtggtgccgccgaatgtggcatttcggaccaattggacaatgtctgtgctcctttttctgctcataattagggatcggatttttaaatttttacttatttttctgcggctttaactcgacgataaatgcgcgaaaacagattttttgttcgaaaatttttcgttttatcgcccttattcgatcttagaaatccttattttaggtaatcgcccttaaaaatccttattttagatgttcgcccttaaaataagattttgcccattttgacgtttcgtccttattttcgccattatttcgtgattttttcgccattatttacggccttattttggacttttttgcccttaaaatcctcgcgctattcataatcccctggctcaatttagtcctcctcttcctcctcctactcttccattgcttcgtctgcttctgattcgcttccactttgcaatgcttacgattgccgctcggcagacgaagacgcgtcgactccgacgccgtcgcgagtggatgcccccgcggtgccgagcgcttccgcccgagcgtcgtcctgcgcggatggtgtgcccctgggcaaagaatcgctttggacttgcgccgctcatcagcttttgccggtgacgt

SEQ ID NO: 36916 - DNA, 755 bp, Heterodera glycines
  misc_feature (17)..(17): n is a, c, g, or t
aggcactgcatacttantgcaataggaagaccaaaagccaaaaagagagcaatgtgaagctaatgaaggtgggactttgggaggggcgagagtgagtgacgagtgactctcgaggaacaaacggacgaaactgacgaaacgatcccactgccgccacccctcccccccccccccccgtcggactgactgcaaaggcggtgagttgggttggccagcccattagtagtgaaacgatatcacaattccttcctctcatcagttcccctcttatcatcgcccattaattctctcgccattttatttttaatgcttttccatgcaacccaaaatttattccattcgaatggcctttcacacgggcaatgtaaaagataaactgtacactttcattgtttccgtaagcaaacaaaaaacaaataaaagccgaacgattttaatcagtgatcaatcaattccaacaagtcataacttcattttgatcaatgttcgaattttccttgaatagcgttgatttaagaattcagcttaagcggtcgtttcgtttcgtttcgtttcgtttcgttttccattcgtcgccattctctccctttccccgccgggggattgagtgagtgagtgacccaaatgttatttcgcgattccggaacatggcgtgtgagagcggagtgggaggagggatcaccgagcgttggttaatcgaacatacggcacacagagaaaggcttcccacttctccgatcactttcgatcacttt

SEQ ID NO: 36917 - DNA, 724 bp, Heterodera glycines
aaaaaaatttattaaaattggaatctggagtagagatttactctcgacggtaattatatggaaaaggctcaaaaatgctcgggacagggtcattgacataaaaaatcggatcaacccctaatttttaatttaatttatttagttagaatttttatgtaaaaacctttagacaatccgatggttgctcacgaaggtgtgatcagtggccacttggacaggccgttttcgaacggcgccgccgccgccgctgctgctgtgcatcaccagcaacagcaacaacaattgttccatcaacgacatcaccaactgcaacaacagcaacaccaccatcaccatcaccaacaacaacaacatgctaaacaacacccttcctcatctgttggtgattgtggcgaagaacctatggacagcgcgagtggcgcgggcacattctgtgccagtagcagcaccatcagcaacacaaccagctcatccaacatggtggagaagtgcgagccgagcacggtggcggacgaggcgggcgaaccgatgccggcgaacattgccagcagcaacagtgggaacaacaccaacaacaacaacgccatgatggagtgcaacagcagtaacaagttggagatgggacagccaccaaatggatcaacaacaacagcaccaaaacagcacccatcaacaaggggaacacgttcgtttttgaataaaaaaattgaaaatgaaataaatg

SEQ ID NO: 36918 - DNA, 659 bp, Heterodera glycines
  misc_feature (13)..(13): n is a, c, g, or t
accaaattaatantttcgtggtatcattcaatagctttctttgttctctttcagaatataattttcttatatttttaacttaagtataaaagaagttataaagcattgaacaggctatgttttttgcaatggtaatgaatatataataataaacatttaaaattttaaagtctttaaaatgaaatttaaccaaaattaatttatatttcgataaccctaagaattctctatttatatttaaaattttagaaaatttcattgagtttcaaaaaagttctgaacaaaaaatgctgacttaagattttttgcaattttgtgaccataactttttttatacttaagttaaaaatataagaaaattatattctgaaagagaacaattaaagctattgaatgataccacgaaatattaatttggttgaatttgagccaagctattaatttaattattttacccattttttgttttcaaacccattggcagttttaacaaacgcgccagcacgaatggaatgcaattacaattaaaatgagaaataataaataataattcgatttattattaaaactattaattacaataatttataattaaaaaaatggagcaattcaattaagtaatttgtcaacagatttcgcgagaatggtctcacaaagca

SEQ ID NO: 36919 - DNA, 989 bp, Heterodera glycines
atgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactaaaaaaatatgagtgatcaaactttcactaaaaagttaagcctaaactttttcccaaagttaaaaagcaattaaaattttattcacctccattattgatagaaaaagcatcagagtgcctaaactaacatgtaaataaaatttggtgcgtttcagaaccctttctgaaaaaatatttatgaattaattttgcaaataaataaaaacgaaagactca

SEQ ID NO: 36920 - DNA, 1218 bp, Heterodera glycines
gggtgggcaatggcgattctcatcgagcaaatcgaaacttgaaacgaaactgcataaaattatcaaaacgaaactcggaacccaaaaaggcctgaaattctcgaaactttcgaacgctcgaacacatttttattattattttttttaattttggaattaatttattttgatttctttttattccattaaaaaatatcaaaaatttgatttttaatatcggatttaaattagggtaggagccagaaagaaggggcgggggaggagggggcgaatcgcgctcaaaccggggaacggggatgaaatattctatcttataaaagaaatattttattataaattttactcctctttatattttcatttactaattaattgtgatgcgccattttatttttattttttttgcattaaaaattttcaaataaaaatcttttcattgaattaagctgtcgattggagctgtaagtgttcagcttcgcttcgaattctttctcgatcgcaaaatgaagaacgcgagaatttcactcggagattcgataagcaaatttttaatccaatttcgaacatttggggcttcaattcgttcatcactttcaaggcaattagttataaaacaattacaaatggtaaaaattaattaaggaattgatggacacgcgaaacggactgtacaataagaaaaatacagtaaccctgggcattcaatttactgtggaaggcgaagacggaggtgaacaacaagcgatggaagccgactgaagaagcatttcgaaacacaaagcttgaagccggacactatcagtaccaaaataaattccaaaattttcgtcagcaatttgctaacaatttgctcctcttttttaaaattggacattcattggtgatgcttcaccacatccgtgccgaaggaaagaaaaataaatatttattgaatttaaaagatttttctcgaatgcaaaatttaaaggttttaagtagagtagagcgggaccgagaattttgggcaaaaccgggaccgggacttgccgggacctgagaagccgagaccgggacctcgatttttcttcgggaccgggaaccgggaccaaccgggaaattttaaaaattcaaaaaattcaaattttaatttatttcaagtgaaaataatacaaaattaaattttatattttttttatttaataaaatccaaaagttaaagctaaattaaattaaagaaaa

SEQ ID NO: 36921 - DNA, 777 bp, Heterodera glycines
aagtgcgctaaaaatgatcaaatgattatcaatttttattttcttaattccaaaatgaattcgaacgcaaaaaattaatcataatacatgtggtaaaaatgcattaaaaataaaaaattcttgaatttgcttctgaattttttaattttaaatagaaaattactttttcgaaattttgcacaaataagaggcgaagaaattcaacgaaatttttattaggattttgatttaaaatgttgagaggtttaacaaatttgtacactgaatgttggatcgtcaacaccaatgagaaatgactaacagaaaagagggagaaaagggcgttggcttaggaaaatagcttataataaaggagagacgagcagacgatgagtgagagaaaaatagtggtaaaaatggtcaactgctgcattggcagagtcagagaggggtcacaaagagttcgcacagcatcgaatatttccttcattttgggcgtcattcttccccactgcacttctttcttcggtttaattacccaagtttgaggtacttggcgtgtcctgcccataatatctgtggcatggaataaattttggaactgcgctgcctaacggcggtgcttaaagtgcgctaaaaatgatcaaatgattatcaatttttatttttcttaattccaaaatgaattcgaaacgcaaaaatttaatcataattcatgtggtaaaaaatgcatttaaaaataaaaaaattcttgaatttgcttctgaattttttaattttaaatagaaaattactttt

SEQ ID NO: 36922 - DNA, 966 bp, Heterodera glycines
gttctgctcccgctgctgccattccaatctcgaatcgcctttgacaatttggattgcttcctggagtcccctctccatggccaaaagtcgcgccgcttggtaccctgcctccccttcggtaaggtcttggtcgatcacttctcgagcctccgcaattcgagcggcgagagtcccggatgctctctcgattctgtcccgcgctgtccgtaccgggatggatacactccgcaaattgcgtgatgggaagggtagcatcccttgctgatttgtcgccacgcctgtcgccatgttgcttcctctcgttgcttcgtttactctggcaactttttgttgctcttcgttcgttgaagcgacgggaccatccccgtcctgcacattttcgtcgtgctgtgcgccgttgcgatggccctcattcgctaggtccatgttgctttcgctcccgtcctcgaactcgaatcgttgcatttttcgtttccgcctgctctgttcgtcgacagaaatgtttcgctggcgaccccctgctaacggcaccagtttgccgtgagcttctctaattcgcagtctgggctttggctgaccgatcgatttgtcgttgcagatgccccctgctaacggcaccagtttgtcgccaatcttttactctggcggggtttggccctgtgcggcttggcccagctgaggcgggattggtccccgctcctcttcaccgctctcgtcccttactgctctgctttctccgcttgctttgccgtaaagggaattgcgccctttttgccgttcgttttgatgggtctgatgctgctgaccgatccgatcagcgccaaagggggacgagaatgggagggggaggggtgacaaagttggactggtgcttgagggaattgtgcagcgatttgctgcttgcttaacggcaccaccgacaaggtttggagaagggcttgtcggacccctttgacttgccgaaca

SEQ ID NO: 36923 - DNA, 981 bp, Heterodera glycines
attttgaacgaaatagtgcacaaaagggagggatgcttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtacagcataattaaaagctaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatatttccattttccgttccacaactggccaaaggcgactgtgctcattgacacgtagttgtccaataaggtacttggactttccacagtaaaatgtggtacaaagttttggaactgtcccgcctcacggcggggcttaaaagcattgtacagcataattaaaagctaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatatttccattttccgttccacaacaggccaaaggcgactgtgctcattgacacgtagttgtccaataaggtacttggactttccacagtaaaatgtggtacaaaattttggaactgtcccgcctcacggcggggcttaaaagcattgtacagcgtaattaaaagctaaaataattttcgtatatttttcacaatttatttcaaaaagccaaaaagtccggaaccaatttaaaaactaaaatagtgcacaaaaggggagccgccgcacggcggggcttaaaagcattg

SEQ ID NO: 36924 - DNA, 1185 bp, Heterodera glycines
aaaagaaatggaaataaaagtgaacggatggaaaataatgtgaatgatatagagataggcaaagttggagaaatagcagaagaagaagaagaggaagaagaagaaaaagaagaagaggaagaagaagaggaagaagaagaggaagaagaagaaaaagaagaagaggaagaagaagaaaaagaagaagaggaagaagaagaggaagaagaagaggaagaagaagaaaaagaagaagaggaagaagaagaggaagaagaagaaaaagaagaagaggaagaagaagaaaaagaagaagaaaaagcgaaagaggaaaaaacggaagtaaaaccaaaatggaaaatttaaaaaaaaattaaattaaattttaattttaagctaccaaataaaaatgtgaagaaaaattattcagaagaaaaaaagcaaaaactcgtgaaaaaactattgaagctaaaagaaaagttaaaaggaaaaattccacagcaaaaaattgataaagcatttgcgaataaagtgggaagagatttcgcaacaattcgcaaatggaagcgcgaatttggactaacaggtggctaattatgcaacgataatgtaattgatacaaaaataactaatattcagaaaaaagacgggaatattcgactaaagaaaaaggggaaattgttgagaaatttgcccgattaaagaaagcatttgccaatgaaaaatgtgaggaaaaaaagacggcacgagaaattgactcaaaaattgaaaaaataattggctttggcattgcgacaatttatttgtggaaaagggaattggccttaaccggtaataaagcagcaaaggaggggaggaaatatttgacaaattattgtaatattattccattaattaggccaataattatatcaaaataatacgaaaaatttaatttcagaaaaatgtccacgtaaaaaatattcgtcagaagacaaaatgaaaattgtgcagcgatacgacgaaatgaaggcagaaacgccgtacctccgcttgaaggacatcgccaaaatgttggaagtgccggagagaactctcatagcaatgagaagggaactaagcacagagcaaagcccaaaagcatcgagtaattaaagataaaagggcaattaagacgctaattaataaatgacagaaacgaagtcagtttattggaattggcatcag

SEQ ID NO: 36925 - DNA, 830 bp, Heterodera glycines
tttttcatctccctgctgaaaaagggtcaaagcgacatctttccgccatttatcccaaaaaatgatatagccatttaattgctcatcggttggttcttggttcgcatatgtatccatatccatccctcatctcccccgccccaggctatgtttgatcggatcactgacaccgccacacatttttctttctgtgtgggtgctgaacaatcgaaaaaacgaggctagatgaagcattaccctgcaattacaacaaatgatgacaacacgactgaaactttactatggtggagttgttgatccatctttgacaaattttatgagataaagtaaacagtgctttaaatcttctaataggttagtgcttctacaatactcgattcacaattatttaattaggacgtaacaaaatattttcaataaaattatttccagttgtaaaaattaattttttgcttttaatatttattacgtgggaatgtcatttttaggcgaatgcctaaaatttctttgcatagataagtacaaaaaatgacgtttttcacttggtagaggaccagattcgtgctaagcgcctcggattatccaggaaaatatctttttagcaatttatttaaaaaaaattcgggaccaatgatctttatcattgccctttttgctttgcagccaattttcagtattttggaaaattccatatacaataaaaatgaaaaaaaaattgttttttttcatccgaatcagacatagcccaggggaaaaacggcgggtgattttctcgggccaatcgaacagtccgtagctgccgttggatgttgtagaagaaaagccaacct

SEQ ID NO: 36926 - DNA, 1513 bp, Heterodera glycines
agttattgtataaaaaccaggtattgtcaattcattggactcataaagtgcactagtgccgaattttcaatggaaaagcgagttgcaaacttttgccgcacactctgtaggaaaataggaataaagtgatcaccactgatcaatcttgatttatcatcacaggctttcggtttcggttacggtaacagtgtgaccatgaaatacgagacgctttcgctcaattcattttgcatttataacacaaaaattaaaagaaattgaattgggcgaaaacgaattgatggagcagaactcaattagaggttggaaaatagtgtcggacgcttcgtaaaagtgccacaattggtcgaccataatgtccgacccagcagaaatttaaattcttggtatcattcgaaaagttctctatgagccttggaactacaagaaactttccttaatttcaacaaaaaccaaattgggtccaacatggagttgacctggattttctggacaaaaatccaggttgccgaaaaaatatctcgatgtcaagttcggacttatgcccatttggcggatttacgaaccgtccctggcaccctgcgtcgccctcacacaattgggagtaatggcgaattcaaaaatcccaaaaatttgtttcggtatttcttccacttttgctcgtccgtttcttcttccatttcgaccttctccttctccgcattttccttcgtatttttgaacattaagctcattttcacctcaaaaagtttccgaattttcacttccgaatttttctgaaaattattttgaaaatatttcaactgtttttcgttcagcaaaattggcttcgtttccaattgggaaaagcctttcaatttgtaactttcagtccgtttgaaattctcgtcaaaataaaacattgaaatgcgaattaaatgttcgatttcgtcaagcacgggttccagcaattcgtcgtattgaaattttggcttaaccgcgggcatttgttggcttacggttttgtcactggctgttcaattttaaaaaagaaaaataatttttttctatatatatatatatatatatatatagtgatcattattgatttaatgatttaatctcactgctggtgagaaaatacggtagaggaaaatgcatgagagatcgaaagagagttttactatagtaaaattttctgaaaacttttaattgttaattggtttgtgaaggaacctacctgatttccaattacagtatacaattttcatatgaatttttctattcatcaaataacggaattaatgacttcagaatcagtacaaattacaaccctttatactaggactgagactccgaggtcagaattgggaaaagtcggagttggggtttgacggggtcagcaagttaggggccgggggcggggttgaccaattagtcggtaccggtgcttagagagtattttttctttgtcccataaagccaaactttccccccacgtatttatgtacgtggagaaatagaaaaattgaaa

SEQ ID NO: 36927 - DNA, 949 bp, Heterodera glycines
  misc_feature (816)..(816): n is a, c, g, or t
  misc_feature (834)..(834): n is a, c, g, or t
ggcgctgtgattgtctcggacgaaaaagctttacagctttacagtcctcatgacccaccacccaccttcctctgatgaatcgtcaatgataactttgcgatgacggcctgcaatctcctgatcatttctcgggacggtcttctgtcttttggcagcaactaaaatatttagtttaaaaaattgtctgggagagaaaccatccccataccacttgctagggggatggatcacatctaaagggatggcagccatcctttttgattatactttttccttaccagttccactgactgaagtctttttcttggtttgcccaactgctggtctacgacgtcgcacgcttttaagcgcacgcagccgcgtaattgcgtcggtctgttgtcgaaggcgcgcagtaatttggtcatacatccggtcattcttctccttcaatgctctaactttcgcatcgagctcaagagcggtcaatccgcgcgttaactcacgcacgtcatcagcggtgatgacgccaccctttaaaacacttgtcgttattttaatgaaacgaaaagggatattagggctccatccctttaccaatgcccatagggatgggttccatccctttaccaaagaccataaagatgatacccatttcttgtcttttctatgaggatagataaaacaacctgtgcttcgaattcttgcaccggatccaagtagataggctgctgcagttcctccggatcggctgcagtctcccgtcgcataagatcctgagccaccgcatgtctcaccaatgcgctgtccatttgatacgttaacagcttcacatcngggaggtttgtcgatgtnggcgtgggtcgtcttcattgatggcgatgtaacggccaaggcgagcattgtttgccgcatcacgccttgcagggcatgtgctctgcagcaatccctggcgccactttttcctgat

SEQ ID NO: 36928 - DNA, 987 bp, Heterodera glycines
  misc_feature (18)..(18): n is a, c, g, or t
  misc_feature (33)..(33): n is a, c, g, or t
  misc_feature (937)..(937): n is a, c, g, or t
  misc_feature (957)..(957): n is a, c, g, or t
ttacatttttggatatanaagaaattgaaatanttgagaatctcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggcttaaatataaactgtttaagtgttgcagacggatcaggttgataagcgccaataacctcaganttactattttcgcaccccanctttttgaattctgacattttcagctcatt

SEQ ID NO: 36929 - DNA, 1109 bp, Heterodera glycines
  misc_feature (41)..(41): n is a, c, g, or t
  misc_feature (87)..(87): n is a, c, g, or t
caaagaaaaaatttattttttaaaacctaatagagtcgtgnaagagattttgaccttagaataattaataaaattttgttttaaatntaaaaaatgtgtaacgctttatcaacaattttccccaagaaatgtgtgtctgatcttttctatatttttttttggcctatcaaattttcaaaaattttcacatcagaatttcttccaattcttcttccttcatttctttcaatgattcggcagaccctcaaaaaattgtgcttccgtgaaaaaattttgggacttcaaaaaatctttgatttgttttttggccttaagaattaaaatttaaaatagttaaaaaacattttacgactttttgcttttgtcgtggtgtgatgtcttcagcaaacataattttatgtggttctgttttgatgtctatcttttcaatcactaaatcacatttaaacatattttataagttaattaatgctaatttgtctaatgtattttttaaattattaaatataaagttttttaaataaattaattacaaatataaactttttatttattacttaattatcgctaatgtattttgaattattaaatttaatgttttttaaataaattaattttaaaaatatttattttttaaattactacttaattaacattaattgtattttttgaattattaaatataaagtttttaaataaattaattaaaaaacacaaataattatttaaatttttaaatgtatccgtacagtttttgtatttcttgtcacgtaattgttcgtgcatttcttctgcaatatatactggcacagaatctttgccggacaatgcatgaacaacgcacatgatcgtagaatgttcgataaagtctgccaccaattcttgagaataaatatttcccgatggttcccaactttcctcgtccgggtaatctaaaaaacaaattcaagtacaacagtcctggaaatcagattgccgctgtgatttagggcactttttttatttaaatttttttttatttttgccttgatctattaagctttatcgtgtttaagggttcgacatggacctggatccaggtctggatttttcctggatccaggcccagg

SEQ ID NO: 36930 - DNA, 1371 bp, Heterodera glycines
  misc_feature (84)..(84): n is a, c, g, or t
  misc_feature (1363)..(1363): n is a, c, g, or t
gcacgacttggcaactgactgtacgttttttcattctcgaatctttgtttatgaattcctcgtgatcaaattaacacttcaatntagtgctttcacagagcgccgctgggccattgtcgcaaaatgctctgtccttaaatcagcagcaacgttccaaaggcaatattttttctcgttgcccgaaaatcatactgttaaaacattatgtttgtagatccgttttatggccttcattctgcgctgaatgaggaggagcctcaaattcggctggaaaaatcgaacattgtccttcttgggccttcgggagttggtcggtttttcttttttttcattctattgagtttattcgtgttgttatattattaaggaaaaacatttgtcacccaagtcttggccaggatactcgacgtacctatcgctttgtgcgattggtaatattcaaataaacattttaaatcatttaaattacttcttccatttgctatagcacctcaatgacccaagcgggctatgtgggcgaagacgtagagtcagtgctgcaaaaattgctgcaaaatgcgcaagggaacgtggaaaaggcgcaacgtggcatcgtatttttggacgaaattgacaaaattgctgccactcgtgaggcgatcagtcacgcgtacagagacgtgagcggagagggcgtccaacacgctttgctaaaaatggtcgaaggtcagcaaaacattaaaaatccaaaatatcagtaacaaaattttcaaattaaataattataaaggtatagaattttactgctttattcgcttctttgttacaatactaaatttctaggcactgtcgtaaatgtgaagacaggacggaaaggacagcaggtaattcgagtgccactttcttgttaatggaaaatgtttcattcggaggaatctgtgccgatggacaccactgacattctcttcatcgcaagcggagcattcaatggacttgagcgggtggtcagccgacggttggacaaacggacagttggatttggttggaacatcttcttaatctttgtgtagaaaacgaaggattaaaggtgctgcattgctggaaaatagcataacggacgacgacaaagaacagcaggtgatcaaccagaagcgggacaaattattcctccaagcagaccaaggcgatatgatcaaatttggcatgatcccagaattggtaacctttttgaagaatccaaatttaacggaactgcatctctttaggtcggccgtttccctgtactcgttcctttccacagctttgacaagcaaatgctcatccgtgtgctgactgagcccaaaaactcattacttgcccaaaatgaaatttcaattctcaatgngataacgt

SEQ ID NO: 36931 - DNA, 1167 bp, Heterodera glycines
acctccctccctaatcactcttcattcatcacattatgcaatttccctttatcccccctttatgaatccgttccaccgcctaaaattgagtaatttaacggatgagatcaacacggtgaagaggggacaatgctctttgttgttgtcctggcgagagtgaagaatggacccaactaatccgggaattattcaatcagttgcagagaatgcatccgccatttcctttcaaatcccccaatgtttccacaacagtcatttcctctccctgtcgagacgagaacatttgatgtcaccgactctgtttctgattttttttaagtacttgtacatttgtttattcaatgtttttcatttaaacacggcgaaaataataatttttacgtttttcgccaaattgttaggaaaatttgttaacctcctttttgactgaaaaaaattttatgttttaaagtcctgaaaatgtgtgtttttggggttttttggaatcagttgaggtttttccttatttctacgatttgtccttgcttggagggagggttttagccccataatctgtgaacaaacgcattaaattttcaaaaatcttctcaacggcgcttccggcccaaatacttaattttaagattaaaataaggactgaaataaacaaatacatattataagaaaatgaataaatttataaaaccaacttttaactaaaaaaattagagctgcctacctatttttaaaatttttaagtcgattcatagggaatgcgaaacttcattagccgaattaccaaattctgctctcacagggattttgatccaatcataaaatattggttacacattatatacacaccgagtcaaaaaacgagacatgtgtcaataaagagagagtgcagagaaaaaaacatctctctttttggcgtactatttctttatctctgttaatagagaaaaaccgaatttacttctctctaagaaaattttttttacgttaacagattttctttaaattttgcatgtcgatagagaaaaaaattacgaacaaaattggagggtttttggaagcaaaaagtgggttagctaaaaagttattcgagaaacaaaatttcgaaccctcatatctttttcctaatcaatccaagtgcttagcatttgcttaggaaaagcttctactcat

SEQ ID NO: 36932 - DNA, 873 bp, Heterodera glycines
gcttcgtaaccgccataatgtggccattgttttggcaactggtgaccgtcggttggcattttcttcttccgaattggaaatcgtttgtggcactttcaacggccttcaacgatggaaatcattaacgagtgcaaaacttgagcctcttcatattggatatgcacatgcgccgtgtcgattggcaatttatcgcatcgtttgccaccctttccccttcaaaaatctgtccccgcggattgggctgaaaatcgaccaaagtgacccgattaaagttggctttccgatcagcgaccgattgattgtttggctttcagatcaaagtgacttttgctgatcagactccccgtcagattgtcgtctgtccgggacgcgtcttcctttttgagcaggtcctctttgtttgctcttcccaagtcagctaattgaatgtctcttccgttccgcagtggcatttgctgctcacttcgcttgaactgcatcgtcttcatcgtgttgacctcgtccttgtccacgtcctttccgtccatccctcagtcttttcgcttcttcgtttgtacgaaaaggagggtttggtttgggttcggcccagcctcaaattgccctccaccgaaagtggcaattcgccgacattcgatgcaaattcggagacattgtggaataatcagttggtcaatttccacgattgcctttacaccttcaaggaaagggtcgttcgtgcatttgatcatcaatcttccacttcagcttctatgttcagtaccgcgttcattgcttttcccgattgggatgaccttcttctcaccccctccccatcctcggttctctcttccacctcctttccttcttacgttccctcttcctctgccaccacct

SEQ ID NO: 36933 - DNA, 976 bp, Heterodera glycines
  misc_feature (865)..(865): n is a, c, g, or t
attacttttcttttcaatatttttcccaactgatcttatagcctcccccctcccttcccaaaaacagggccggggcgcttaaaagtgggggctctatcttgaaacactagttgatttatatgtatccaaaattgctgaatgaatgcatatcattatttctaattagcgaaaacgtttcaaaaaaatccaaatttaaattttgttgcttttgtcccaccaatttgaatgctttttcttcacttcgccgctttgtttaccatcgcttcgttttccgctcgccgcctgttttccaactcatttagtatatttattttctgtttgttcttgcgcccccgcgacgacactttcgagaaacaaatgcccccgggggcggcgattcgccggcgggcaaaaggcctccgccgccccccgggggccaaaagtgtaaagcgaaaaattaaaaaacacggagccattcaatttttggtcggctctttccggcttttctccaatttcacatatcacatcatcactcacaacaacattctcccatttatttatgcatttgaaaacattcatacttacgcttggtaaacaaatttttaattactaaaatttaaaaaaccgaagggttaattttcaaatttttaattttcccccgctttctggctttctttacttcaatttgttttaatatataaattttttattttaaaaatcttggaaatcccattattacctgggcttccaaatttacttactttagacaaattatttttctgcattggattaacatgaaattactcctggtaaataattttgttattaattatattttaaaattatatttcaactttgaaatttgatacctcttttttggtcttanatataaaaaaaatattattttatttcttggtttttattttctaagtgttttatttttttatattataaaaaagtgaggaaaacttcttcacttaaaaagtttcttttttaa

SEQ ID NO: 36934 - DNA, 1047 bp, Heterodera glycines
aaaatgattttcgggcctgttgagttttatggggggtatggtcggtccaaaaaaatgggctatctcttttttttgtcaattcgggtattagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatgggcggtccaaaaaaatggctatctctttttttggcaatctggtaatagaaatctctttggaaacaatgacagtggctgtcatcagttgttatgctctaaaaatgattttcgggccgtttgagtatatgtggggtatggtcggtccaaaaaaatggctatctctttttttggcaatctggtaatagaaatctctttggaaacatgacagtggctgtcatcgggcgaaggcccaccacgaggccgcgaagaggccgagtgagtttcgggccgtttgagtatatgtgagggtatggacggtccaaaaaatggctatctcttt

SEQ ID NO: 36935 - DNA, 885 bp, Heterodera glycines
  misc_feature (834)..(834): n is a, c, g, or t
  misc_feature (852)..(852): n is a, c, g, or t
  misc_feature (855)..(855): n is a, c, g, or t
tttatcttcgattgcactatgaaaagataaggtttaacaatttaataaaatcatatcatgtacctaaatctaatgaattattatttattattaattaaaaattatattaaataaaatgtttttatagcttttaagaagtaacgaattgtctattttactggtaattttgtaatatttgatttaaaattttcacgatagtattttattaaaaattcctaaaattttctagtatgatgagaagatttcgtcgatttcttcagggtctcaatttcatcattattatttgacaaattataataatattgttttatttattatcataaaataggcaattttagttagcaatcataaaagggtttttttaattttcataatttttgtttttttaattattatgacgcatttaatttatttttgcgaatgttagaaattaaacataaatatgcaataaatataaatatcctgtaggtttataaaaaaatatttttgtatgatttttttttgagtatcttatgtatcaaaatgattgaaaaattaaaaataaagtttttttttataaataattttttgataatttactataaatgaaattacaattacaaaattttcaatatatattatccaaaattaataataaaattttttgtaaaaagaactagttagaaaacctatttaaaataaaattatattactatatctaaactagagtgcagcgggaccgggaacgggcaaaaccgggacagcgacttgccgggacctgagaagccgggaccgggacagggacctcgcttttcgtccggcaccgggaaccgggacaaacccgggaatttttanaaattcaaaaaaattcanatntttatttatttcaagtgaaaataatacaaa

SEQ ID NO: 36936 - DNA, 1408 bp, Heterodera glycines
  misc_feature (247)..(247): n is a, c, g, or t
cccccccctcatcgtcgccttttcccctcactttttcacccccaatttcgccccaggggtcgttttacgggtgctgccttaaggtacaaagtgcgattttttcaactgcacccctcgggaaaaagataaggggaaaagacagaaacaaaacggaaaaagggacgacaaacggcgggcggaagagaaacgaaaagagcgaaaaagtgggggagagacaaacgacgacgacagatgctaaccccccccncctcgtttcctcatcaattttcaattttgagattggggtgcagcgaaagagtgctcccggcctcggctggggggaaagaacgattttgggagagagatgaaagtacagggaacagcgccaaaggacggaggacggggaaattgagggggggggggagatttgtcacggagattatcatttattatgcgaggagaacgggacggggaagccgagggggggggggaatgggttggcgcggcgtttctccttttttggattattgagccgggggcgaggggagatgcaagaggatgggggatcaattgggttttcataagccaatatgccagctgctgctcactaatttataagcggatattcaaacgcaaaatctatggcattaaatctaagtccaaaaccatttaattctaaaaatggccgcaaaagttaaattataatgcccaaattataatgagtatgctttttccttattatttgtacaatgtctgcgcatatttctttttgggctgtccgtcagactgattgtgagccgatagctttttaaatgagtaaatggcaatgtttaaaaggatgggcaagggattaaaagggaattgacattaattaccaaccgtagattttggtcctcctcacttaccgtaccttttcaatattattaataaattgtcttgactttttttttcatataatttaatggtttttttgtgtgacaaaaaaatgcaattaatttttcttcggcgtttaaaatattccaaatttaataggatcgaataaaaaaaaaatttgttctgcagcatttgtgggaaaacaaaatttatcattcattcattcatttcggaaaatcacagtcactgacaaatgaaggtttttttatacaacaaatacatatatatgtggatgggggggagggaaagtctcgtgactttttgcccatttttaaatggcctcgtgcctcgagaagggatggtagagagcggcagagccttggagttttaaatttttttttgaaatcttttgaataaattcagggttcaatgatcgatgttaaaatcgtaaataatacaaatagataattattaactaatgggtgcatacgcaaacaagtggcaaaaatgggggggaaggggtaatttgttgtgtgcacagcggccgaaagtgcca

SEQ ID NO: 36937 - DNA, 985 bp, Heterodera glycines
  misc_feature (6)..(6): n is a, c, g, or t
  misc_feature (24)..(24): n is a, c, g, or t
gcatantcattttttaaaaattantcggatttaaaaaacatataaacaaaatcagatttaagaaatagctcaatggctaattcaaattttatggattttttgacttatccaaatgttttttggaaataaattcaatttttttttaactttaaggacaaagagcttggctttggacaatggtttcatcatttttcggcttttactatttttggttggtgaagccagctgttttttcgccatcctacggcaattggttcctgaacccgtaccaggactacagtaacattagcgtcgatactcggaaagtaagaaattctcaaattttttttatatattttaacttatttttctaaggagacatgagaattaaatataagaatatgagatttaatatgtataggtttcggtttttatagctaaaaaccgacgaaaatgagaaaaaatgagctaaaaatgagaaattattttcatagcttactccaaattattacaaattaacaaccaaccattttgggatattttttggaaatttaaaatgtcgttctttgcaaggtagatttctatggaaaatatgatcatagtcaccaaactcaaaattgcttaaaaacgttcagaatcgatgtaaaaaggttagaaatgggtcggaaaaatagaattaggggcgcgcttgcctttttcaggctgaaaaagttgccggaattggagtgccaaacttagctgggactcaagtgaccgcactataaaaagcactaaaaagacattttaaataattttctagggtaatttgtggcggtgatcacgaatatgacctttattttgcaaaattctgaaccccgaacctcaattcgaacaaaatttaaaatttataaattaaaagaaatacaatttttaggggattttaaaagaacgtcaaatataaaagattgaatttagcttattgcgctaaaaaaccgccgcacactcgactacggcggccagtatgtgg

SEQ ID NO: 36938 - DNA, 907 bp, Heterodera glycines
  misc_feature (658)..(658): n is a, c, g, or t
  misc_feature (697)..(697): n is a, c, g, or t
  misc_feature (773)..(774): n is a, c, g, or t
  misc_feature (810)..(810): n is a, c, g, or t
  misc_feature (856)..(856): n is a, c, g, or t
taaattaaattatttgcaattataaacatgtaattagcatactttaatccggtgatcggagaccaaacgttgcaaaatgttgaaggcgtaccgcttgctgcacagcttacaccgtcccgagtccgccttgcgccgcgctttcgccaacaaatcggcagtgacgagcccacggaccatgaccaaatgccgttccaaacctaataatgtgtagatgatgtacaattgtaatcaagggagtaggacatgatggacaattatagatttaaatcgcggagcaagtcgtttaccgccctatttttttaaatttttaaaacagaaaattgaaagaaaaggatttttttaaaatttccagcatattctaaaacgataaaattttttattattttttaatttttggggagaaacgacagggagaaaaagaagttcatccttcagcagcagcaccttcgtatgtccagaaacggtctctgcagcgtgagcacgccaacggtgcaccgctggccatttccgcgttgttcttccccaacagttgacgatgtgcggcctgcaaatgcacccggtactgctcgcggtcggtcaactgtgccaagtcgcaaatttcgcacacataatggtgttggtgcgggtggctggtcggagcagcagcaccaccaccacncaccaacggcggtggcggccgagtgcgcagcggcggcgngcggcggatgttgcctttagctaaaatgaattacaattttttaatggcattaattacattcagaaataattgtaannttggggttgacatgcatagcatacaaataacataanatatcgaatgggcccgtaattcagtgttggtaggatatgagtctgngatgtgatacgaatccgcaactttttttttccttttttatttggatgcaaa

SEQ ID NO: 36939 - DNA, 1091 bp, Heterodera glycines
ttgaaaattcatgcaacaaaaagccttaagtaaaagtaatccatccattatatgttaacccttggaataatcaaattcaccaattatttattcacattattttaaaaatttgttttattttatgtaaccctaactttaaaatacgcataataaattccctccgtctcacgagcctaaccatcggagatattcatttttatatttggggggggggggaaggggcattattcgcggcgtacgccgggctaaaaaatggaataattggccaaagcaatgacaatttttttattgcatagcaaaaattttaaaaatcggaaaaataaattcagactaattcgctggggggaaaattttttcagtttcattaatcacacaattcgagaagatttttttaatttacaaaaaaaagaataggaatatagacaacaaaaaaggttgctgaaatctcgtgggattagtcagttgtgcccatttcggtcggcacacgtccggcaacagtaacgaccgtaacgcagcgtggcacagagtccgctcacagataccgtatggcacacatgcgggggcccattgtcgacggcgcatgcggcaaattgggggcctactgaggtgccgtagtggatgggattaggaaaatttttcaattccgaatgttgacaaaaatttcaatctcgagtatcgaaaaggaagcaccaaatcccaagtcttgactaattgtaagaaattttacaatccccaatcccgtcactcagaaaatttcagtcccgttaattaacaaatttaaaacccgactcgggttacccgagtaataagagttggaaaaatcccaatcaattattaagtcgggaaatttcaatcccgagtcaaaacttggaaaggcttccaatctggattctgaaaaccgagagtatcgagcaaccaatcactgttgatggcggatttcgatcggcttaccccgctgctccacaacacggacagtcactggatcggaaatgagagtgccaaatgagcatgcgtacgcgccagcatccgcagcggtaaccgtgcggaagcgcaattcgccaaccaccgccagccctccgtccgccgcctcc

SEQ ID NO: 36940 - DNA, 1263 bp, Heterodera glycines
  misc_feature (22)..(22): n is a, c, g, or t
  misc_feature (34)..(34): n is a, c, g, or t
tcacttaatggaattgggcaanttgagtgatcanctttaattgtggcaaaaattaaaatgcaacagatttatattcacataaattggctcagcttcaacaaaattaatacttcctactgatctcattcaatcctgtctaggtgctggtgacaggaattacgtggataaaaattctaattaccctaatttgtaaacaaaaattgatcaatattaagaaataaaaatgtctgtgcaattattatatgaaaaacatttttatgcaaatcgatgtttctcctcttttcttgagcaaaaaaataaatgttttattatataattttaattggtcaattaaaataataaatgctaataagataaacagatttgtataattcaactaccaaactaatcagtgtagcaagtgctgaaatataatgcatcaaaaattgggcgctagtttaaaagagtacttttttgaaatttttttgcacttttttggtctggtttttttttttgttttttttatacataatgatgaagacaaggggattttcgaagtcgctgatcacgaatatggcatccatttcgaccaactcgggattccggccccgaacttgaacaaaaaagtcgaaaatttgactttcggattttcgactttttgttaaatttgaaaaaaaaatagacaaaaaaagtgcaaaaaaaaaaagaataatttcaaaaaagtacattttaaactagagccaaaaattgcgtcaaatgccgaatcacggttaccccacattttcgtcccggacatttgcggcccggacatttgcgcgcccagctgaacgcagacaactgagaccacgacgaaagagaatacatcaaattcgacaaaaatgagaaaatcgccgaacgatacgacgcagcatcaaccaaacttcgggatttgcgagatctcgaagcaacactcagtgccgcagccaaactgcacagaggcagagccgacagggaagcaaaggcggatcaattggccaatccgcagcaacaaccgcccatgccaccagcaatggcagcaccaatgacaatgccaacattcacagcaccgctctaccaattccagccaattcaactggataaatttttcggccaaaagcgaaaatggcccgaattctacgaatccttcaaatcggcaatcggcagtcaatcaatcagtaaagcgcagaagctgaacttactccgcaatctactgggcggagaagcgcgagaaactctaccgggcttccggttggaagaagcaaacta

SEQ ID NO: 36941 - DNA, 1286 bp, Heterodera glycines
  misc_feature (25)..(25): n is a, c, g, or t
aacaaaacggtgattgattaccctnttgcgcttcaaaagtgccaacccaaacgaataatggtgccgaaagatgaatcaactgcggagaatggatgtgatgcatgggcgggggtttttatttaaaagcttttatttttataaaaattatatattttttaaatgtattcattcaacttttgttttgtattttgcatttatttatttatattgtagataaaaattatatatatcgtagctctacgatcccagttcggcagttctggtgaatttaagagtgccaaaatatttttaaaattgtcaatcgcagaattaaactaaatttttatttgtggttaaatgcctcatttgaaatttcgtattttttttttgagaaaaagatatactcgaacaattttttagctttttcatttagtttcaacacattcttttttttggggtcttagcatatatttgagcttttaagaaatattaagtatcaaaaaatctctctttttaattgtttttaaattagaaaatggaggaaatcatttggcataagtaattgctaaaatattagagagaaagaaaaatgaataagtttggcaaatcaaaaaagaactcaaaaattagtgaagagaaataaaattacaaatgggaaaagcaattttgaagaattaatctgaattagaagcggatggaaatttaaaaattgccaatattttttatagaatgaaaaataaatttttaccgttattttgttttctttttgctgaaaaaaatgaaataatttctattctttttaataatatttcggctgtccaattcatcataaaaaatattaaacaaaaatcatttaatgaaatatttggaggaaattgagaaaaagaaaatttgtaagaagagaaaaaaattaggggagaaattattagagaaattgcgaaaaaatgatttttttttctcgattattcgctaattttcgaaaattttaaaatacagtgatattttttaatgcgtatttattttaaatattaaagttatgtttcgattttcatttactaaatacataatttggaaaaagtgcaaaaatcaagcattcatttttacacatgatttttaatctgattattagattatttaaatatgtagaagagaattaatttttgctaattttcaaacggtataaaatataaaaaatttttggggtgtccccagtcaccatgaaggagtgatttgatcaatttaatgcaaaaaaacattttaatcagctaaaaattatatgtgggcatttttagactttctaggcaaaa

SEQ ID NO: 36942 - DNA, 1104 bp, Heterodera glycines
ataagaaaatgagaagaagcgcccgcactggggaagtgccttttttctcttcaaatcgcacctgaccattcccttcactttgccatcaattgaaattgcccatatgtatggatgtgaaaagtttgaaaagatggttcccaacttttggacgggtggcggggggggggggggtaagtggaacttatcatcctcatcatcatcatcatctcatccgatcacctgccgaccaccctcaatctttccccccccccccccccgaaggcgtgcgatcgaatcactgactccgtttgcctctgatcacttcgcttcccatgggaagcgaatttgaggcttctttctgctgatgttgggatgtctttaatggcaattgtcagtgtgaaatgggaggagacacacacagaacaaatccattcgatttgaagtgagcgagcggataaatgtttcaattggaaatggaaagaggaaaagcatttccgagcaaaaaagtgatcagaaatatgttaaaagcatgttttaagttttcgggaaatgggaaaggaaaatgaaaggcaaaaaaaactgatgaaattcgatcgcgattgattgactttggcatttccccgctgtccttccagcaaactttgacaaccaacaccgatctgaaacagcaaaatgaagagttgaaaattgtggaagggatcacaaatttaaattaatcagaaaatgaaaatttgcctgaatttccaaaataaatattcaaataaaaaagagacaattaaaaatggaataaataatttttaccctttttaggctatgggaagatcgaacccgaaactatccaggtattttttattgcttatcaatatttggttttagtgttcaaaaaaaaactggcaataagaaggtaatacaaatttaaaaaaaatttttgtttaaactgattttttttgacttttgctgtaaaggctcgccttttcactgtcgtttggggctttttcggcgtccctttcactgtgatcattctcaccaacttgggcctttacatgcgccgttttgaacggcacattcggcgccattattgtcagaagaggcaaagggaacgcttcgcggagggaatcgacgatt

SEQ ID NO: 36943 - DNA, 1023 bp, Heterodera glycines
  misc_feature (331)..(331): n is a, c, g, or t
ttttactgatttttgtgttttaaattttaaagtattaatgcaaatttccctacagaatatgtaacaaattatttttaacaaggtcttgcttaaggactaacaagcattacgaatcaaattattttcaacacatcgaaatacgaaaatcgtcttttttcgtcttacaaaatttttccaccggacgcccctgtccatctcgcaaaattttttgaaaaaacgcgccgcaaacaaagcgtttttagaggcaaaaaaaagttcgtcacttggctattaattgcaaaaattggcctttttagtgaaaatctgttaacaaatcagaaccaaattacanaaatttttcccggcggcgcctatcggcaccggcggaccctctctccttcgaccatttcccaagttatttggaaaaatctgccgcaaaaaattgttaaaaattgattttttgatcccgaatgtgctaaaattcatgagttgttaattttctccccaaaattgttaaaatcgttaatgggagaccaaaaatataatatttgatacatttttgatagaataaatgtaaaaataactgatttgaagtaattttgcaaaatgtcctgattttcgacgccaaaatctggttttttgggtccgatgtcctgattttgaaaaatttttgatcgcacccctgatttaggggcccgttgtgccaattccttaccagttgtggttgccatcatctgctgttgtttatgctgttcgtgttcactggaaggtgttttttcttcttgagttattctctgcctttgttgttgttgttgggtttctcctccgtttcctttgtcctttccttcctccttttcatgtttactgtttttggcatctccaaaaacggcgtcttctctccgtcttgctcttttcctccttgcgatccttccctttttcctgttcaccagcgtcggcgtcgtcgtccgactcgggcagtaaatggtcgatggatgaacgccggtggatgaggagccgttcggccaattcctcagcagataaatc

SEQ ID NO: 36944 - DNA, 1156 bp, Heterodera glycines
gaattgaaattgaaggaccaataaattatgcggtgaattgtttggtcaaaatttcgcaattttattttaattcaattgacgacgacctttattctgaatataaattaaacatacatttcaataattataataattttgaaccaaaattgttgaatgagcaaagattgacttatttaattaattttgaaaatgaattaccaaaagtgccaattaatgaaatgattttgcaattggcaattgacacagcgaatgaatggcaattaaatgaaattatggacgtaataattcgagaaatttttgatcaaaatttagaggaaatgtttaaaaaagcggaagaaaaggcaaaaaaggacaaaccatcgagagcatatacaataaataatgacaaacataacataattttatattcaaaattcgacgatcaaaatacatgggtatgatttaattaaattaaaataaaaaataaattattacccaattttagtttaatgatgctttgttttgaaaaaaatttacgaaagaaaaagattcgaaattgaatataattcgcaaatatgatggcacacttacgacaattcatttcttactgttttctagtccaaaagttttacctaaaaatgcgcttttttctaaatttagttaaaattataaaaaaaaatttcaaaactacgttttcggaaaaaccattattttggttttttgaattttcaacaatctttttcgttggttttacctcttttttttttactttgtctgaaaattctcttatatatttttttggataaatttagaaattatttgtgggaattaatcattttttcggtattatttttaattagtaccctaatttaaagtagataatgatttagaccaataaattgttttcatttactgaattctgaatttagattcgttaaaaaatcggaaaaatttttttctcttagtgttgatttttcatttttccaatttcattaaatttacacaaaattgtatcaaatccgtaacctacgaaatcttcgtttttctattttgtaatttttttacgaagttggatttagtttttattttataaattttatgaaattctatttcttgttttccaatttcgttaaatatctaagaaattgtatcatttttcgtgatttgcgaaattaaa

SEQ ID NO: 36945 - DNA, 1103 bp, Heterodera glycines
  misc_feature (1032)..(1032): n is a, c, g, or t
  misc_feature (1065)..(1065): n is a, c, g, or t
  misc_feature (1071)..(1071): n is a, c, g, or t
  misc_feature (1093)..(1093): n is a, c, g, or t
ttaaaagaggtacaacagtgattagaagaggtgcaacagtgattagaagaaatacaacagtgattagaagagttacaacagtgattagaagaggtacaacaatgattagaagaggtggaacaatgattaaaagaggtacaacagtgattaaaggaggaacaaaagtgattaaaagaggtacaaaaatgattagaagaggtacaacaatgattagaagaggtacagcagtgatcagaagaggtacaacattattagaaggggtacaaatctgattaaaagaggtacaaaagtgatcagaagaggtacaacagtgattggaagaggtacaacagtgattaaaagaggtacaacagtgattaaaagaggtacaaaagtgatcagaagaggtacaacagtgattagaagaggtacaacagtgattaaaagacgtcataagtgattaaaagaggtacaaaagtgaattaaaagaggtacaacattgattagaagaggtacaacagtgattagaagaggtgcaacagtgattagaagaggtacaacagcgattagaagaggtacaacagtgattagaagaggtacaaaagtgattagaagaggtgcaacagagattagaagaggtacaacagggattagaagaggtacaaatttgatgaagaggtacaacagtgattagaagaggtacaacagagattagaagaggtacaacaatgattagaagaggtacaacagagattagaagaggtacaaatttgatgaagaggtacaacagtgattaaaagacgtcataagtgattaaaagaggtacaaatttgatgaagaggtacaacagtgattagaagaggtacaacagagattagaagaggtacaacaatgattagaagaggtacaacagagattagaagaggtacaaatttgatgaagaggtacaacagtgattagaagaggtacaaaagtgattagaagaggtgcaacagtgattagaagaggtacaacagagattagaagaggtacaacagggattagaagaggttncacagtgatcagaagagggttcacatattgaancaggancacattattcaaaattaataanataaggaaat

SEQ ID NO: 36946 - DNA, 715 bp, Heterodera glycines
atgattaaaggcattattatgctcagttcgccagcggatgagtcattttttgcccaactcgataaatatgatattccggtggtggtgattggcaaagttgaaggtcaatatgcccatgtttattctgtcgataccgataattttggcgacagcattgcgttgaccgatgcattaattgaaagtgggcatcaaaatattgcctgcctgcatgctccgcttgatgtccatgtttcggttgatcgcgttaatggttataagcagagcctggctgcgcataatattgcagtgcgtgatgaatggattgttgatggcggttatacccatgaaactgcattaaaagcagcacggcaattattaagccagtcaccgttgcctgaggcggtgtttgccactgacagcctgaaattaatgagcatttatcgtgcggcagcagagaaaaatattgctattccgcagcagttagcggtggtgggttatagcaatgaaacgctgtcatttattttaacgcctgcaccgggcggcatcgatgttccgacgcaggagttaggtcaacaaagctgcgagttattattccgcttaatttctggaaaaccgtcaccacagaatattaccgttgccacgcatatgacgctgaaataaataccagctaccttgcctgaatgccagatgcgatgctagcgcatcttatccggcctacatttatagatcggataaa

SEQ ID NO: 36947 - DNA, 389 bp, Heterodera glycines
cccaaatgtcgggatccccaaatgtcagatccccaaaagtcgggtccccaaatgtcgggatccctaagtgtcggatccccaaaaggcgggtccccaaatgtcgggatgcccaaatgtcgggatccccaaatgtcgggatccctaagtgtcggatccccaaaagtcgggtccccaaatgtcgggatccccaaatgtcgggatccctaagtgtcggatccccaaaaggcgggtccccaaatgtcgggtccccaagttgcaaatccccaaaagtcgggtagccgcagagaaaagcctagtactatcacgtcgttactctttttctttgtaatttctctcactttggcgtactatctccattttttaatagaaaaaacagcatttacttacta

SEQ ID NO: 36948 - DNA, 993 bp, Heterodera glycines
tcgttttggtttggctttatgataccgaataacattcggaaattatggaaacaaaattggagaattcgattaattttttgacttcaaattttttcccagttttgattgggttttaaaatagtagtttggttcagaatttttccctctacaaaaaaaaatttataatagaattttttattattaattcgaaatctttaatttattggacaaatccaagacttaaaattgggagaagcatggggctgtagctgaggaccaaaaatggggccccattggggaattttacatgatttctgaaaagtccctgaaatgtcgattttttctttctatagcttcttgtagagctcgagctgctctttccaatggtcttatcccggtctcgatccgtgcagaactcaaaaagttatgcagtgaaatgtgaaatattgttttcgccacaattgggagaagcatggggctgtagctgaggacccaaaatggggccccattggggaattaaacatgatttctgaaaagtccctgaaatgtcgattttttctttccatagcttcttgtagagctcgagctgctctttccaatggtcttatcccggtctcgatccgtgcagaactcaaaaagttatgaagtgaaatgtgaaatatgtttgcaccacaagggattttttctgaaacccatcggaaccaaaaatctagggtttggtataagcgttttagaaattgcggagaaaaaagcttcgatattgagaaaccaagtcaagtccagaaaagaatattttaaaacgaattcgttttggtttggcattatgataccgaataacattcggaaattatggaaacaaaattggagaaattcgaataattttttgacttcaaatttttcccagttttgattgggttttcaaatagtagtttggttcagaattttcccctctacaaaaaaaatttataatagaatattttattattaattcgaaatcgttaatttatttgacaa

SEQ ID NO: 36949 - DNA, 1217 bp, Heterodera glycines
  misc_feature (27)..(27): n is a, c, g, or t
  misc_feature (41)..(41): n is a, c, g, or t
  misc_feature (75)..(76): n is a, c, g, or t
  misc_feature (139)..(139): n is a, c, g, or t
tccgaaagttattcggtatcataatgnccaaacaaacgaanaatcgtataaaatatttcctttctggactgactnnggtttctgatatcgaaagctgttttctacgctatttctaaaacggtttataccaaaaccccangatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaaacgaaatcgttttaaaatattcctttctggacttgacttggtttcttgatatcgaagctgttttctacgctatttctaaaaacggttataccaaaaccccagattttttgaatcc

SEQ ID NO: 36950 - DNA, 918 bp, Heterodera glycines
aaaagagggagcgaattgaggccgaaggcgcggtcagtccaatgccatcatcgatcactcgtccgcagcgggtttgtccgtctccggctgttcttctttgggctccgcggcgccatcagcagcaggagcatcgccgggcggttggtcggtcgtcgtctccgcatccttcttgcggctttcctctcgcccttcttcgataatttcccctcttcttgctgcgccgcttctccttgtccttgccgcccttctcgtccttctcctcctctttcttcggctcctccttctatatacctaagtgtctttttttgttttaaatttctaaattaggcaattttttgatgaagaccgacacattttaggtcttaggattgccaaaatcatccttttttcttttttaaatttttctcaggtcgccaaattttctcaacaaatttctccatagcataagaaaatcgccggaagcgtttccctccggcgttcactttcgtctgttccaataattttgccgattccaattgttcgtctccattttctttcagtggttgtgtaattaattgcttgccatgcgtaactgtcctggagcaataatattggaaaaacgggactgaccaaataaagctgaattgcatcttgctaactaatgcaaattaaattatggtaaatatcgttcatatagtccagagtcaaaacaggacgaaatatataccaaacgacgtctctcggtctgtaatggaagaatccgaaaaaaaaattgttgggcaaccaatccctgaagagttacagacccgggactgaaatggccaaatgcctttgggactgaaccgtccaactggtaaaaatgcatgtaattgtgacaaaatagatatcaatcgattcatctcggcatgtaaccctcgaagctgaaagaattttggataa

SEQ ID NO: 36951 - DNA, 117 bp, Heterodera glycines
cgcgatcaggcatccctgctggagcagctgagcgcacgcctggctgcgctggagggggcctctcaaagtaccggcgtggcacccggcagcgatgcgggcctcgatgcacaggtggct

SEQ ID NO: 36952 - DNA, 974 bp, Heterodera glycines
  misc_feature (14)..(14): n is a, c, g, or t
ttgcaaaatttttnttgtcataataaatcttttataggcgttttcggtgtccctgatcatgaatgtgccactaattttgattagttccgaaccaaactcggaaaaagtagaaaattcaaatttttcaagttacgactttttttgttcacgtttgttttagggtgttttatcgaaatggtaccaaatcgaagtcgttcaattttactgccattcattagaaaaaagatttattatgacaaaaaaattttgaaaaacaaaagggtccccccttttgtttcaaaatctgtcacttttacagtagcgcctgttaccgaatttgccaattgtttggacttcttcagattcgtgaccagcgccctagcagaaattttaaaaaaattttgcaaaccaaaagggtcctccccccctggggaaaagttcgaattaatttaccatttatttattgtggtacaaaaaaaagcgactttttttgttcgaatccgggtccgggcttcggaattgggcaaatccaacttcatattcgtaatcagaaccctcgaaaacccacagaaactaaatatgagcacaaaagaaataagttaaattagaaacccccattcttctggattgccatattttttgcgtgtttcaggcctacaatagtcccggaaaaaaattggacttagccgacaaaattttagtcttttgttttttttgccctaatttagttgcatttaaggctaattcgattgacacaaatatttaccaacaacaaaatgagtgaaaaaaacaaaaaaaaaaaattcagagcgaaaaaaacaaagtaaatttgagaaaattattaacaaatcttccgcccgccccgtcacatcgtcagttgccccgggtacgcgtccgcgcggtgtttgcgcaccaaaaatttgagtttgcggtcgcggtcctcctccagaattgccttcgacgcctcgatggacagttgagaacgctgaaaaaaa

SEQ ID NO: 36953 - DNA, 835 bp, Heterodera glycines
tccttttcctctttcgtccacgttttcctccttttcctaattgcttccgtgcctcagggtaaacatttgccaattcatttcactttttcatcggtgcctttttcggctccgccgttttggccccggactcattaggaggccataattaaaatatgttgtgttgaagcacttccgctcactttgggtgcccaacttttgctggtcgcgcgtcggctgcgtcaaaagtgcggcggaatgctcctgcgccaggcgggggttgcggatgccctcgggcgcacttccctattaatggtctgtccaccaaattcgctgctttgccaagtcacaaaacaaaggtccattcgcccttcgttttgtgctcaaattgtccgacggtgtccgatctttggttggctgctcaaaacaaaacgataaacgcggcaaaaatggcgggcgatggcaaaacgccaagcgaaagggcggaggacgaaatgttacgaacgatcgaactgagcacaaagagagccggaaacgaacaaatgccgagaggaaagacgcaagaatgcgcaacggaaggacatcccacggaaagggcactggcgaaagtaaacggcgaccgatcgatccaccgccggcacttttctctcccctccctttacagtttttgtgccaaattcaaccgccaaaatcttttgggctttttccgctccgagaaaacgaatgccccgagagtattttgcaatctgtcaagcgacacccttctctgaatttggtggcgtccaaaaggcaaactccgccaaaaaattcaaataacggcgcgaatgaaactttggcgttttgccatcggaaggcagcg

SEQ ID NO: 36954 - DNA, 1395 bp, Heterodera glycines
  misc_feature (1355)..(1355): n is a, c, g, or t
ggggagaagcatgcaaaacagacggagagagaagagaaaatgagacgatcagaaatggaagttatacacaaagcaatgaggacggagaaattggggtgatggtcgaacgaggacaatcactttgtataaattactgtatagtcactctgtattactgtaaatttgtagatagaagagaaaaatgatttgtgctaaattgcatttagttaaatggagcaaaggggtcaatcagtgagtcaatgactcattaaattagtttttacaaaataaaacagcttaggcctagcctgagccattgtacaagctgccttttgtacgagttgtcatgacacccaattagtttgtcgtaaaagagaagcaacgcaattaaacatatcgatttccgttgctaggaaatacacacggtagtcgagtggcattattcccatgaatcattccaaaattttaagaatgaaataaatacacccattttaggaccaacaaatcattacaataaaaagaattgaaagaatgaaaaaattagaaaaatgaaaaaaagatctaaaatgtttgtttattgtgcctcgctttcaaagaactccgacggatgtccttgccttgcgatttgtccgttgctcatttctgtcaataaaattgattgtgaaattattcttgaaaaaggcatttgctaaccgatgatccagtcaaattccgccagtccggtcgtccgatgtaaaatggccaacaccgtacagcccatcctcgcgattaattgactgtaataaaacaaccatttattaattctccgatcacttgttgtttgcccacctgatcagcttgtgattgttctcgtccatgtgcgcggtggcctcgtcgatgagaataattcgcgggttggacaaagccaaccgaagcagcgaaatcagttgcctctccccaaaggacaaattccgtcccccttcggtgagttcggcgctcagaccaccaaaatggtccaaccattggccaagtccgatggacgaaatgcaattgagcagcgattggtcgtcgacggagggcgaggaatcattggccaagcgaaggcaaaggttgtcccgaagagtgcccgagaagaggaacggatgctgggagcagaagccgaactgaacagcagcaaaagggacttaatgagtgctaatgagttgcccaaaacaccgaccaatgaccgcgccgagtccaatccgacactgtccaagtcgatcacttcgtcaacaaaaatcttcccactttcaagtggcactgctcggagaagggcctttaggggataatcaagagtcattaggaaagaaaaaaagaaaagtcgcctgaagaatggtgcttttgcctaagtggtattnatggcattcgatgaggacgatctgacagtaaccgacctga

SEQ ID NO: 36955 - DNA, 671 bp, Heterodera glycines
tcgtaaatcttattaaaaaaattctctaaaaattgcaaaaacctatcattttttggacaaaatctattaacagatccatcagttttcaaaaaattttcccggcggcgcctatctgcaccgccggacctctacgctcgcacattcaccaagtttttttttttgaaaaatgtgccacaagaaaatatgttacaaatctgagttccaattttgcttgagtaaatcatgataatttaatatattaaaaaacaaaaatttatctaaaaattttattttttttttgtaaacatctgttagaaatcgagcttaaatttcaaaatctgccaggcggcctatcggcaccgccggccccccaaaaacctattttttcttaaaaaattagccaaaaatctctaaaatttggtaattctttagacaaaatctaggtaatttatgccaaagggaattgaattgaggcgatacattgactaaaggaatgtggagccatcacatcattcataaaaaattaattttttgtaaaatttttggagttaattcaaatcaaacccccgcccccgcccccgcccccgcgggggcggaattatcgtgcccccgtccccgcccccgcgactctgacccccgccatcccccgcccccgtgaaaagccacccccgcccacggggtccgaaccctaa

SEQ ID NO: 36956 - DNA, 784 bp, Heterodera glycines
  misc_feature (99)..(99): n is a, c, g, or t
  misc_feature (106)..(106): n is a, c, g, or t
  misc_feature (110)..(110): n is a, c, g, or t
  misc_feature (115)..(115): n is a, c, g, or t
  misc_feature (123)..(124): n is a, c, g, or t
  misc_feature (126)..(126): n is a, c, g, or t
  misc_feature (134)..(134): n is a, c, g, or t
  misc_feature (137)..(138): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (168)..(168): n is a, c, g, or t
ctctgagcacgaatttgatatcccattttatcaaatccctcaaagtagtttgacaaaataaattatctaacaaaacattcctcaaagcaaaaagcccanaccgcangaangaagngacaagcnncncagcggcngannccggcngcngcngctgcccgggctgattgntactgttattattctgctgcgctggtggcggtggttgttgttgctgttgttcaactgctgctggtggagctgctgaagaagttgacgtaagaacaatggaagacgtagcgatggaaggggaggcactcgtacaaggaacagaaggcggaggaggacagtgcgacgacgacgacagcggcggcggcggcggcggctgctgctgttgttgttgatgttcaacagcagcgacaacgacgacaacactgtccggtggtgcactcttggccggaacagcaacagcatcaacagtttgttttggttgttgttcttgctgacaatgagactgctcctcctcaacgatgatgatgctgggcgagttcggtgcctgagactgctgctcctccacgatgatgggcgagttcggcacagcattctgattcaattggtgttgttgttgctgagactgctgctcctcgatgatgatggtggacgaattcggtgtaggtgtagtatagctttgttgctgctgtccttgctcatcgacaacgatgacaattgggtggtcatcattggaaacaacaacagggcaatgttcgacgataggggcaaccgccgatgacaatgatggactctagag

SEQ ID NO: 36957 - DNA, 155 bp, Heterodera glycines
  misc_feature (81)..(81): n is a, c, g, or t
  misc_feature (108)..(108): n is a, c, g, or t
ctatgttactagatcggggatcgatccccgggcggccgctcgagcaggacccgcagaagctagcttgatggggaccagacngccgcccccgaaaaacaggaaaagganacaggagagggaggagagaggcggaagaagaagaagggaggggggag

SEQ ID NO: 36958 - DNA, 1198 bp, Heterodera glycines
ctggaaataagcttaattgggcctagttaagctgtaaaaatatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttgttaagccaaaaaaaaatccaaacatttaaaaatctataaaaaatttaaaaatgagaattcatgcgagattttctggaaataagcttaatagggcctagttaagctgtaagacacccaccacttttgcacttaaaaaaatttcaaaaaatttgatcgtccataaataatttgtaattgatcagcggctcaccaaattttgcagagatacgtatcggaacactacaaaagcttactaattttcctagatttattaaacccggtgaaaattttttgcagacacccaccacttttgcacttaaaaaaatttcaaaaaatttgatcgtccataaataatttgtaattgatcaggggctcaccaaattttgcagagatacgtatcggagcactacaaaagcttactaattttcctagatttattaaacccggtgaaaattttttgcaaacacccaccactttttcacttaaaaaaatttcaaaaaatttgatcgtccataaataatttgtaattgatcagcggctcaccaaattttgcagagatacgtatcggaacactacaaaagcttactaattttcctagatttattaaacccggtgaaaattttttgcaaacacccaccactttttcacttaaaaaaatttcaaaaaatttgatcgtccataaataatttgtaattgatcagcggctcaccaaattttgcagagatacgtatcggagcactacaaaagcttactaattttcctagatttattaaacccggtgaaaattttttgcagacacccaccacttttgcacttaaaaaaatttcaaaaaatttgatcgtccataaataatttgtaattgatcaggggctcaccaaattttgcagagatacgtatcggagcactacaaatgcttactaatttttctagattttttaaacccgctgaaaaagttaagcct

SEQ ID NO: 36959 - DNA, 1194 bp, Heterodera glycines
  misc_feature (84)..(84): n is a, c, g, or t
  misc_feature (114)..(114): n is a, c, g, or t
  misc_feature (164)..(164): n is a, c, g, or t
aaattttttttctttagacccatttcgttttctatttttgactaattttctaatatttacctttatctattaaattgctaaatntgatagttttttattaaaaacattttagantaattatagtttgatcgaaataaatttaattaattttatctaaataattntaaaaatcttttttatttatttttacaaaatggtagatccatctaaacatttaagagttatatctatttaattttaataaataaataatctcaataatagttaattgacaaatttcattgcttaaaattgtaatcttagtatacttctttttggttccttagtatgtttaatactttttatggtctaaaatgatttctaaagttaataataacttattatcttttttgtttttaaagtatattttagtttgtttagattttaatacaatttccgagtttattgttatccgtgttgcaaaattgtgacgtgaacatataaatcttttgtccacgcttgaagttattggaatattttcgattaacatccgctgaattacttttttatttttattttctatctttttatcatatgctaagtttattttttagttttggtgcataattttttagtttacaattgtcattatatttgcttgcattaatcttagttaaatcaaattaatatattatctgaaacttttttttattgtggtaaaacacaaaattttgatgcatttaagcatcgacgtaaataaatttaaacataattaaaaagcaaaaaaattgataaaaatcacaggaacaataaatgtttgatttaagtattttttgtgatgtgacctagcaaccccgagttataacatttttatgattttattctattaatagatattttcaacagcgtaattaataattattttagattgctaataaaaataattacacaaacttataatttataatcaatgaatttatctcaattttatgatatggtgcaaaattccaatgccgcgcaatgcaatggtaagaaaaaaaataataaaatctaaaatttaaattatatgtaaaaaaggtttcaacttcataaattggaatagatcacaagcgttttttttgtaaattattttcgcataaattaaagacaaattaatacatatataattatattatatatatctcatagatataaaaaatgttttctttacctaat

SEQ ID NO: 36960 - DNA, 947 bp, Heterodera glycines
atattcgcttgaaaaaattattcaattatttaatcaaaatcttttttgtcatttttcattattttagaacatttttgggaaaaggagtgactatttacacgttttttacagcgcgattttttcaaaaactttttgggaacttggaggagagtacagcggtgccggtaggcgccgccgggaaaattttcttaacagattttgtccaaaaaattacaaaattttgcgattttgagcaaattttgcaagaaaaatagggatttttatggtccggcggtgccgataggcgccgccgggaaatttttaaaaatttcagttcaatttcttaacagaaattgtacaaaacttactagttttttgaaaaaaaaagttaaaaaaatttacgacttttcatcaaaaatttcggaagtcggaattccgaccccaaaaatgtcgaaaattggaagtctttccgtgccatacctggtgcctatcgacatctgcgaaaaattttatgaaatttaatgcgatttgtttacagattttgtctaaaattgaccaaatgacgcagtttttgactcaatttctacaggattattaagtaaaagcctatccggcggcgcctatcggcaccgccgggaaaatttcacaaattttgaatgaaatttgcgatgaaaaatgagttaactttaattaaatttattatttaatttatttaaaaatatttggcattctgtcttagaaaaattttcaaaaaatcaataaaatcccgcatgatcccgcacaaaaaatcaaatttgcggatcccgctgcgggattggaactcaaaattctttgcgggacaggatcccgcgggattaatcccgcaaatcccgcgcgggatcccgtcccgcgccggtctctactttgaaccttcaactgatacaaaaaatgtaggcaaatgaaaaaagatatggcctgtaaaactgaga

SEQ ID NO: 36961 - DNA, 810 bp, Heterodera glycines
  misc_feature (28)..(28): n is a, c, g, or t
cctaaaatcatattgttggaagattttntggtgaaaaaaatttttcactcaaaaatcatggtcacacccctgtggtcccggatgccaaaatcacttttatttctataactttttttaaaaaagtgataaaaagctaaattaaaatttataaaatagagcaaaaaattgcggattttttgagtatatcatttttataaaatactttttcagaaccgagttctgaattttattctgaaaaatcgaatttttccagaaattctggaacaacttttttattttggaagatagaaattccaaataaatctcataaaattctcctgatttttctctatttttcaaactttatttcactaaatttgatcaaaaacgaagagagttatgaattttcgaaatttcactggattttccggggctcaaattttgacgatttttcaaaaaattttaatcaccttccaaaaaatccaaaacgcaatataaagcgtatatacgtattcagcacctcaaattatgccataaaaatgcattttggctaatttaggagtaaaaaaatttttcatgaaatgcaaaaccatggggtcccccctatggttttgagtttcaaaatcacaattaattttataactttttttaaactcatggtataaacatgagataaagcacattagattgggcttaaaattctctacaaaaaagctcttagacgattttttgataaaatcaactcctgacaagttatagccacagaactgaaattgaggcctaccaatcaaaaattttctatttccaaaaaaattttgaaaattttttttg

SEQ ID NO: 36962 - DNA, 851 bp, Heterodera glycines
  misc_feature (742)..(742): n is a, c, g, or t
  misc_feature (759)..(759): n is a, c, g, or t
accctcctctccttctgacataaatatattaatgattttttctaattaaaaacaattttttttgtgtgtgtaaaaatgccctacaggcaaatgttttagcaaaaaaaaagggataatgtctttagatcaccccttcttgaagaaaattctgaaactaattgtatctaatggtatgttttaggaattcttaacaatttttcttaattataaaaaatttttttgtgtatagacacaggttttacaaaataggggaaaataacctaagggtatatgttaacaggccaacaaaaggctttgggttatttaccaccacccctcctcccctcgaataagtgctaaaatatatttactttttaaaaaaattaatcacacacttttgattttaaaaacggtatacacttttatttaaaaattacaaaaaaaatggtccacacctttggatttttttaaaaaattgcaaaaaaacggtccacacctttggattttttaaaaattgtaaaaaaatatggttcacacctttgggtcgaagcgatgagatttaattctaaaaaataattcgcagccaaggggactcgaactttaggggccaaatagggggtagtaactacttaccttcccataccagtaaatgccataccattccatgacatacccatgttaagtcacacaaagccatttaaaactaacattatgaataattttactaaaattcttttaaaatttttcttatcataaactcganatttgatatttgtttanatataaatatttatgcgattcttagggctgtttttttcatttttattcttagcattaagcacaaaaataccaatttaagcaaaatcagcatg

SEQ ID NO: 36963 - DNA, 1863 bp, Heterodera glycines
  misc_feature (70)..(70): n is a, c, g, or t
  misc_feature (1526)..(1526): n is a, c, g, or t
  misc_feature (1807)..(1807): n is a, c, g, or t
  misc_feature (1840)..(1840): n is a, c, g, or t
  misc_feature (1848)..(1848): n is a, c, g, or t
aaaatgatcatttttgttattgcttttttatattgaaataatgttttgttttaaataaggacgccaacgnaattaggcttttttgtaaaccaaatgaggtttttgagaatttttatctgggaactttgatttaaagatttaaactatgattaaaaagaataaagttgaaaatttttgaataaattttcagaaatacccagaaataaaattaaataaaaaaaactaatttatcaaaatcgtattgaattacttaaatgatcgcttacaaaaaatgcagcgtgaggtataatgaataaatgatcgaatttcccttgtaataattaacaaattccattttaattgcatcaaatcccccattatttgtaatttattccttctcatttttggctttgttagccttcgcacactttgctgatcgcacttttttgaccaatttggcgatggcattcatctgaaaaaagtagacttaaaatactgtaatggaggatgaaagagggggtatacggtagcaaaaattaatttaaaaaaagactgactggaaaagtgacggcacgccaaaacaaacgacggcacttggcacggccacgagcggcactgaccgaagtgcaaccgacagaagcaacgccaatggcattggcattcagctgagactgcggcaccgtttggtggacaatccgttggccacactcaacacaaactttggcaccaacaacagcagcattttgttgttgttgtgccttaaaattattttaataattgatacgataaaaatgattaccgtatatactctttttatatgccagtctccattaatctgccggcctccaattatatacccccttctgaggaggttgaaaaataatatgccagtctccatttatgtgccaggggggataaatagaattttttaaataatttttttggcacattttccaaaaaaaaaaattaaactcaattcaacagtaaaaggggctaataaatgaacaattcgttcccatctccgactccatccagcccgggtcggggtcacttcggcgcggaccatttcggcgccgcaaattttgaaatgctatcttttttatttgtcagttagctttagccaatctggcatcatttgaaagctctatgtgtgctctatatttacacgtaaaaatagaaattaatgattcaaaaataaaaaagttatgccacgcggcgccgaaaaagccaagaaaaagttaatttttgaggttttttggcaataacttttttgtaaactgacgaaattttttgaaattttacaggctaatagagaatctgaagagctatcgaatgataacaaaaatttttaatttggttgatcaggaaaaaagttgttagcaacggcgccgaagtgggcggttcccatccagccctgcatcatcatcagagtagggtcgctacttttagtgacggaaaatctcgaaatagttaactaaaaaaaaaaaattgtgggaagaattttaaaatcgctaaaaaatctttctcctcgtgaagaacatccctangaaaaacaaaggatttgctgagatgtgaacagcggggaaaggacggagggagggagcgcgccccggaggacaaaaaggaacagaacggacggatggacggacggacggctctaggaaaatccccgacacaggaaaatccgacactaacattaaattttaaaaataatttttgattctatgagttaatatttaaaatacatataaaaagttacagtactgaagttatttaaaataaatattcttattgccataatctattctatctaggtgggcatatgaantattttttgtatgcccttttttgattatctcanaaaaatanataatctctgtgatc

SEQ ID NO: 36964 - DNA, 521 bp, Heterodera glycines
ataataaaatgaatataaaaaataataaattaattttacaaaaataattgatgaaatttaaagagaaaaatttaattaggtagttatattttttaaatttaatgaatgcattatctatcgcctattgtatatgattattaatagtgaagaaagaagacaaaatgagacggacctataatataaatccaaaatgaaaccatttattaaaattattgtagtgtcctctttttatccaggcggcaatcctgaagaatggttgtccctaatttttaatttttttttaattttgtgctcaaaaccagtttttaggcgtttttgagggtgctgataacggatcttaactcgggtttgcccaattccgaactccggacctgaattcgaacaaaaaaatattgagtttttttaatcaagaatagttttttcagggtaaaagcttctaagtcattatgaactattttggtgtaaaacaatgtttcaatttttaattaaataaaaataagcaattttcgccgaaaattgac

SEQ ID NO: 36965 - DNA, 1305 bp, Heterodera glycines
cgaatatttttgtgcagaaaaactctctgtaaaaggcgaatatttaattgcttttgcattttcatttttgattattttctttaaatataatttataataagaaaattgtgcacccaaattgtgcaaatagctttggtaacgtggcaccaaaaaggtggcggaatcggcattatatgccgaaaactttttcattattccgggcaatggagcaaaggtcggcgaaatcaaaaggtcgtcccagtcgagaaaagcgatgaattcggcactgtctctgtgttcatagagacagtcgtgcaggtcgacaaccttaggaggacgaacaaattaaaacccggacgacaaattcacctaataaatgccaaagctaagaaaaaaaacgtaaaaataaagtggaattaagccgcagatttacagttagattttcatctcgaaattaaacaaattagcaaacccctgaatgggtttgtgcctgaatggcaaattctgccccgtccgtccctccttcggcggttgtctctcctttctttcttcacctggttgctccactccgtctcgccgttcggattgaatttgtcggccgtgccgtgcactgtctccgtcggcatttccatgttcgccctcactctgagcagtccgtccctctcgtacaatcgcataagttcgtacagtgtcgggtgcacactcatcacataagcgactacggtgtccacgcgttgcatacggtacatttccatggcggtgacgaacaaatgccattgctcgaagaagaacacgcggcccatgcacaacagcagcgaggcctttttcattgtatttggcaatgggtcaggcacagagacggggaactaaatgatcaacaacatacttacaattagtgggtgaaattaggggtaattaattgacaaacagtcgaccccctcctccttctcctccccccccccctcgttcgtcaaaaggtggagagaggggatagaccaccgtggggcgtgggggtcggaccgtgttgggtcttttgtaaaatttgcatttgaattattggaattgtatttaatcaattatattgcctaattattttttctatgattacgataattgccaataccgtaatcggtttgctgcccgcgaaacggaagacgacttcgtccacggggcgcccgtggggacagatcagtgcgcagatggccagccgacattggcccacgctgtgcagaacgatcagttgaggggacacgtgccgagtggggaaaaggccgttggacgaatggaccaggcatttggcgtcgagccaattcaatcggcggaaga

SEQ ID NO: 36966 - DNA, 931 bp, Heterodera glycines
  misc_feature (133)..(133): n is a, c, g, or t
tgacccgtcccattccttcataaatgcaaaatcacttcatatggaggcggcggttcatcgggcggcactatttgctggaagctgaaattgctcatctccatttggttctgttccgtcctggtggagatgggcncaagcaacggttccctgtcagtgccgattcgttgttgcgggtgatgcttttggcaccgaatcctttaaaatgcgaaaatggaattcaattcattcaattttctttgtccagttttgttgacctcgtcattgttggcacgtgccgcgtttttatgctcaattttcgcggcctatgcggatccgctgatgcaattgcagcaatacctttaattaaaatgatattaatttaatttaatattttaaattatttatttaatttttctcttttgttcgaccatcaccttctgaaattgtgatggaacgtggtggattttggcgatttgttgttggcatgcctgcccgagttgacagatggtgtttcttcgtcggtccattagaatttctgaaatattcgaaaatcggaatttcggggacctaaaaatttcggaaatcggaattcccttaaaatgggttaaagtgttgaataaaatttatttacatgaggccaacaaattaaaaatctaattcgtttatttacccattttctctcccaaaaaaggaaatggagcgactgcgcttcatcaaatcatttgtcgccgttggaactgtcagatttttcttaaaaaatagctgttaccttgcttttccaagaattttattttcatttcaactttgttataatgaatttatttctgtctcacaactgtaatcaccgattaccattaaagtgtactgtggctgttcatcatcgccaatggtaccgtaaaaagcgtgatgtgccgccacctcatggccaataggcacattaccattggcaggc

SEQ ID NO: 36967 - DNA, 927 bp, Heterodera glycines
  misc_feature (35)..(35): n is a, c, g, or t
  misc_feature (860)..(860): n is a, c, g, or t
actaaaaccaattctcctatttttggggaacgttngggaggaaatttttaattttttatccttttcacgaagtgataacagataatcccatttccacttcgaataaaataattgggtaagggtgctaattgagccccacatgtcagataagaatttttgcgtaatttggtttgggttatattcctggtcagtgtctggggtttctagtagggaattaacaaaattcagcgaatacccaaatgggcgcaggaaatcaatagggcgtaagggaagtggattagagggattattagacaaaaatgtgattggtcgagagttaattattgactcaatttctactattattgtgctaagatttggaagggaaatggaccgagctgagcaggcagagaaaacacggcgcaaatgatgtttaattagtgctattaagcgttcatagtggcctccacgccagggggcgaatggtaccctcaaataccattcaattgggtgtattggaagaatgaaatttttgaaagacacaaatgttggtgcttgatcggaaaagattgattttgggtatacatatttagcacaaaaacggcgaaatgctaataaaaaggtcggtgctgattggtctggcaccaaatctaaggaaattccacgtgtaattagacatacccatacaacaatccaatatttttcaatggctttgcgggcattttttcgggggttggggtcttcatttactgagataatacgtacagggccacaaaagtcaagaccaacagaggaaaatggggatgaaaaattgacccgctcttttggtaatggtggaaggggagggaggtcaaatgctcggactgtaaacttacgacaangtatacaacactttaaaatggcgcgtccggaaatttttcgttccttggggtacccaaaattgtcgtc
